United States Patent 12,397,048 (BUNYAVIRALES VACCINE) - sequence listing, part 10

SEQ ID NO: 11760 - RNA, 3408 nt, synthetic construct
  misc_feature 1..3408: note = derived and/or modified CDS sequence (opt1) from HTNV(Aa14_186)__KX687228.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatgatcgaggagtcctaccgcagccggaagtccatcacctgctacgacctcagctgcaacaacacgtactgcaagcccaccctgtacatgatcgtgcccatccacgcctgcaacatgatgaagtcctgcctgatcgccctcgggccctaccgcgtccaggtggtgtacgagcggacctactgcatgaccggcgtcctgatcgagggcaagtgcttcgtgccggaccagagcgtggtctccatcatcaagcacgggatcttcgacatcgccagcgtgcacatcgtgtgcttcttcgtcgcggtgaagggcaacacgtacaagatcttcgagcaggtgaagaagagcttcgagtccacctgcaacgacaccgagaacaaggtccaggggtactacatctgcatcgtgggcgggaacagcgcccccatctacgtccccaccctggacgacttccgctccatggaggccttcacgggcatcttccggagcccccacggcgaggaccacgacctcgccggggaggagaccgcgacctactccatcgtgggcccggccaacgccaaggtgccccacagcgcctccagcgacaccctgtccctgatcgccttcagcgggatcccctcctacagctccctcagcatcctgacgtccagcaccgaggcgaagcacgtcttctcccccggcctgttcccgaagctcaaccacaccaactgcgacaagggcgccatccccctgatgtggaccgggatgatcgacctgcccggctactacgaggccatccacccctgcacggtgttctgcgtgctcagcgggccgggcgcctcctgcgaggccttcagcgaggggggcatcttcaacatcaccagccccatgtgcctggtctccaagcagaaccgcttccggctgaccgagcagcaggtgaacttcgtgtgccagcgcgtcgacgtggacatcgtggtctactgcaacggccagcggaaggtgatcctcaccaagacgctggtgatcgggcagtgcatctacaccatcaccagcctgttctccctcctgcccggcgtcgcgcacagcatcgccgtggagctgtgcgtgcccgggttccacggctgggccaccgccgccctcctggtcacgttctgcttcgggtgggtgctgatcccggcgatcaccttcatcatcctcaccatcctgaagttcatcgccaacatcttccacacctccaaccaggagaaccgcctgaagagcgtgctccggaagatcaaggaggagttcgagaagacgaagggctccatggtctgcgacatctgcaagtacgagtgcgagacctacaaggagctgaaggcccacggcgtgagctgcccccagtcccagtgcccctactgcttcacccactgcgagcccaccgaggccgccttccaggcgcactacaaggtgtgccaggtcacccaccgcttccgggacgacctgaagaagacggtgaccccgcagaacttcacccccgggtgctaccgcaccctcaacctgttccggtacaagagccgctgctacatcttcacgatgtggatcttcctgctcgtgctggagtccatcctgtgggccgccagcgcctccgagacccccctcaccccggtctggaacgacaacgcgcacggcgtggggagcgtgcccatgcacaccgacctggagctggacttctccctgacgagctccagcaagtacacctaccggcgcaagctcaccaaccccctggaggaggcccagagcatcgacctgcacatcgagatcgaggagcagaccatcggcgtcgacgtgcacgccctcgggcactggttcgacggccggctgaacctgaagacgtccttccactgctacggcgcctgcaccaagtacgagtacccctggcacaccgccaagtgccactacgagcgcgactaccagtacgagaccagctgggggtgcaacccgtccgactgccccggcgtggggacgggctgcaccgcgtgcggcctctacctggaccgcctgaagcccgtcgggagcgcctacaagatcatcaccatccggtactcccgccgggtgtgcgtgcagttcggcgaggagaacctctgcaagatcatcgacatgaacgactgcttcgtcagccgccacgtgaaggtgtgcatcatcgggaccgtctccaagttcagccagggcgacacgctgctgttcttcgggcccctcgagggcggcgggctgatcttcaagcactggtgcacctccacctgccagttcggcgacccgggggacatcatgagcccccgggacaagggcttcctgtgccccgagttccccgggtccttccgcaagaagtgcaacttcgccaccacgccgatctgcgagtacgacggcaacatggtgagcggctacaagaaggtgatggccaccatcgactccttccagagcttcaacacctccaccatgcacttcacggacgagcggatcgagtggaaggaccccgacgggatgctccgcgaccacatcaacatcctggtcaccaaggacatcgacttcgacaacctgggcgagaacccctgcaagatcgggctccagaccagctccatcgagggcgcctgggggagcggcgtgggcttcaccctgacgtgcctggtgtccctcaccgagtgccccaccttcctgaccagcatcaaggcgtgcgacaaggccatctgctacggggccgagagcgtcacgctgacccggggccagaacaccgtgaaggtgtccgggaagggcgggcacagcggctccaccttcaagtgctgccacggcgaggactgcagccagatcgggctccacgccgccgcgccgcacctggacaaggtcaacggcatctccgaggtggagaacagcaaggtgtacgacgacggggccccccagtgcggcatcaagtgctggttcgtcaagtccggcgagtggatcagcgggatcttctccggcaactggatcgtgctgatcgtcctctgcgtgttcctgctgttcagcctcgtgctgctgtccatcctctgccccgtccgcaagcacaagaagagctga

SEQ ID NO: 11761 - RNA, 3408 nt, synthetic construct
  misc_feature 1..3408: note = derived and/or modified CDS sequence (opt1) from HTNV(Aa14_234)__KX687230.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagacgtccttcgagaccgtgagcaccgaggtcgacctgaagggcacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagagctgcctgatcgccctcgggccctaccgcgtgcaggtggtctacgagcggacctactgcatgacgggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacctacaagatcttcgagcaggtcaagaagtccttcgagagcacctgcaacgacaccgagaacaaggtgcaggggtactacatctgcatcgtcggcgggaactccgcccccatctacgtgcccacgctggacgacttccgcagcatggaggccttcaccggcatcttccggtccccccacggcgaggaccacgacctcgccggggaggagaccgcgacctacagcatcgtgggcccggccaacgccaaggtcccccactccgccagctccgacacgctgagcctgatcgccttctccgggatccccagctactccagcctctccatcctgaccagctccaccgaggcgaagcacgtgttcagccccggcctgttcccgaagctcaaccacacctcctgcgacaagggcgccatccccctgatgtggacggggatgatcgacctgcccggctactacgaggccatccacccctgcaccgtgttctgcgtcctcagcgggccgggcgccagctgcgaggccttctccgaggggggcatcttcaacatcaccagccccatgtgcctggtgtccaagcagaaccgcttccggctgaccgagcagcaggtgaacttcgtctgccagcgcgtggacgtggacatcgtcgtgtactgcaacggccagcggaaggtgatcctcacgaagaccctggtcatcgggcagtgcatctacaccatcaccagcctgttctccctcctgcccggcgtggcgcacagcatcgccgtggagctgtgcgtccccgggttccacggctgggccacggccgccctcctggtgaccttctgcttcgggtgggtgctgatcccggcgatcaccttcatcatcctcaccgtcctgaagttcatcgccaacatcttccacacgtccaaccaggagaaccgcctgaagagcgtgctccggaagatcaaggaggagttcgagaagaccaagggctccatggtgtgcgacatctgcaagtacgagtgcgagacctacaaggagctgaaggcccacggcgtcagctgcccccagtcccagtgcccctactgcttcacccactgcgagcccaccgaggccgccttccaggcgcactacaaggtgtgccaggtgacgcaccgcttccgggacgacctgaagaagaccgtcaccccgcagaacttcacccccgggtgctaccgcacgctcaacctgttccggtacaagagccgctgctacatcttcaccatgtggatcttcctgctcgtgctggagtccatcctgtgggccgccagcgcctccgagacccccctcaccccggtgtggaacgacaacgcgcacggcgtcgggagcgtgcccatgcacacggacctggagctggacttctccctgaccagcagctccaagtacacctaccggcgcaagctcaccaaccccctggaggaggcccagagcatcgacctgcacatcgagatcgacgagcagacgatcggcgtggacgtccacgccctcgggcactggttcgacggccggctgaacctgaagacctccttccactgctacggcgcctgcaccaagtacgagtacccctggcacaccgccaagtgccactacgagcgcgactaccagtacgagacgagctgggggtgcaacccgtccgactgccccggcgtggggaccggctgcaccgcgtgcggcctctacctggaccgcctgaagcccgtggggagcgcctacaagatcatcaccatccggtactcccgccgggtctgcgtgcagttcggcgaggagaacctctgcaagatcatcgacatgaacgactgcttcgtgagccgccacgtcaaggtgtgcatcatcgggacggtgtccaagttcagccagggcgacaccctgctgttcttcgggcccctcgagggcggcgggctgatcttcaagcactggtgcacctccacctgccagttcggcgacccgggggacatcatgagcccccgggacaagggcttcctgtgccccgagttccccgggtccttccgcaagaagtgcaacttcgccacgaccccgatctgcgagtacgacggcaacatggtcagcggctacaagaaggtgatggccaccatcgactccttccagagcttcaacacctccacgatgcacttcaccgacgagcggatcgagtggaaggaccccgacgggatgctccgcgaccacatcaacatcctggtgaccaaggacatcgacttcgacaacctgggcgagaacccctgcaagatcgggctccagaccagctccatcgagggcgcctgggggagcggcgtcggcttcacgctgacctgcctggtgagcctcaccgagtgccccaccttcctgacgtccatcaaggcgtgcgacaaggccatctgctacggggccgagagcgtgaccctgacccggggccagaacaccgtcaaggtgtccgggaagggcgggcacagcggctccaccttcaagtgctgccacggcgaggactgcagccagatcgggctccacgccgccgcgccgcacctggacaaggtgaacggcatctccgagatggagaacagcaaggtctacgacgacggggccccccagtgcggcatcaagtgctggttcgtgaagtccggcgagtggatcagcgggatcttctccggcaactggatcgtcctgatcgtgctctgcgtgttcctgctgttcagcctcgtcctgctgtccatcctctgccccgtgcgcaagcacaagaagagctga

SEQ ID NO: 11762 - RNA, 3408 nt, synthetic construct
  misc_feature 1..3408: note = derived and/or modified CDS sequence (opt1) from HTNV(Aa14_239)__KX687231.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccgtcctgaagttcatcgccaacatcttccacaccagcaaccaggagaaccgcctgaagtccgtgctccggaagatcaaggaggagttcgagaagacgaagggcagcatggtgtgcgacatctgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgacgagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgagatggagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11763 - RNA, 3408 nt, synthetic construct
  misc_feature 1..3408: note = derived and/or modified CDS sequence (opt1) from HTNV(Aa14-172)__KU207162.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtcagcttcggggagaacagcgtgatcggctacgtggagctcccgcccatgcccctgacggacaccgcccagctggtccccgagtccagctgctccatggacaaccaccagagcctcaacaccatcaccaagtacacccaggtgtcctggcgggggaaggcggaccagagccagtccagccagaactccttcgagaccgtgagcaccgaggtcgacctgaaggggacctgcgtgctgaagcacaagatgatcgaggagtcctaccgcagccggaagtccatcacgtgctacgacctcagctgcaacaacacctactgcaagcccaccctgtacatgatcgtgcccatccacgcctgcaacatgatgaagtcctgcctgatcgccctcgggccctaccgcgtccaggtggtgtacgagcggacctactgcatgacgggcgtcctgatcgagggcaagtgcttcgtgccggaccagagcgtggtctccatcatcaagcacgggatcttcgacatcgccagcgtgcacatcgtgtgcttcttcgtcgccgtgaagggcaacacctacaagatcttcgagcaggtcaagaagtccttcgagagcacgtgcaacgacaccgagaacaaggtgcaggggtactacatctgcatcgtgggcgggaacagcgcgcccatctacgtccccacgctggacgacttccgctccatggaggccttcaccggcatcttccggagcccccacggcgaggaccacgacctcgccggggaggagaccgccacctactccatcgtgggcccggcgaacgccaaggtgccccacagcgcctccagcgacacgctgtccctgatcgccttcagcgggatcccctcctacagctccctcagcatcctgacctccagcaccgaggccaagcacgtcttctcccccggcctgttcccgaagctcaaccacaccaactgcgacaagggcgcgatccccctgatgtggacggggatgatcgacctgcccggctactacgaggccatccacccctgcaccgtgttctgcgtgctcagcgggccgggcgcctcctgcgaggccttcagcgagggcggcatcttcaacatcaccagccccatgtgcctggtctccaagcagaaccgcttccggctgaccgagcagcaggtcaacttcgtgtgccagcgcgtggacgtggacatcgtggtctactgcaacggccagcggaaggtgatcctcacgaagaccctggtgatcgggcagtgcatctacaccatcaccagcctgttctccctcctgcccggcgtcgcccacagcatcgcggtggagctgtgcgtgcccgggttccacggctgggccacggccgccctcctggtcaccttctgcttcgggtgggtgctgatcccggccatcaccttcatcatcctcaccatcctgaagttcatcgcgaacatcttccacacgtccaaccaggagaaccgcctcaagagcgtgctgcggaagatcaaggaggagttcgagaagaccaagggctccatggtctgcgacatctgcaagtacgagtgcgagacctacaaggagctgaaggcccacggcgtgagctgcccccagtcccagtgcccctactgcttcacccactgcgagcccaccgaggccgccttccaggcccactacaaggtgtgccaggtcacgcaccgcttccgggacgacctgaagaagaccgtgaccccgcagaacttcacccccgggtgctaccgcacgctcaacctgttccggtacaagagccgctgctacatcttcaccatgtggatcttcctgctcgtgctggagtccatcctgtgggcggccagcgcctccgagacgcccctcaccccggtctggaacgacaacgcccacggcgtggggagcgtgcccatgcacaccgacctggagctggacttctccctgaccagctccagcaagtacacctaccggcgcaagctcaccaaccccctggaggaggcgcagagcatcgacctgcacatcgagatcgaggagcagacgatcggcgtcgacgtgcacgccctcgggcactggttcgacggccggctgaacctgaagacctccttccactgctacggcgcctgcaccaagtacgagtacccctggcacaccgccaagtgccactacgagcgcgactaccagtacgagacgagctgggggtgcaacccgtccgactgccccggcgtggggaccggctgcaccgcctgcggcctctacctggaccgcctgaagcccgtcgggagcgcgtacaagatcatcaccatccggtactcccgccgggtgtgcgtgcagttcggcgaggagaacctctgcaagatcatcgacatgaacgactgcttcgtcagccgccacgtgaaggtgtgcatcatcgggacggtctccaagttcagccagggcgacaccctgctgttcttcgggcccctcgagggcggcgggctgatcttcaagcactggtgcacctccacgtgccagttcggcgacccgggggacatcatgagcccccgggacaagggcttcctgtgccccgagttccccgggtccttccgcaagaagtgcaacttcgccaccaccccgatctgcgagtacgacggcaacatggtgagcggctacaagaaggtgatggccaccatcgactccttccagagcttcaacacctccacgatgcacttcaccgacgagcggatcgagtggaaggaccccgacgggatgctccgcgaccacatcaacatcctggtcaccaaggacatcgacttcgacaacctgggcgagaacccctgcaagatcgggctccagaccagctccatcgagggcgcctgggggagcggcgtgggcttcacgctgacctgcctggtgtccctcaccgagtgccccaccttcctgacgagcatcaaggcctgcgacaaggcgatctgctacggggccgagagcgtcaccctgacccggggccagaacaccgtgaaggtgtccgggaagggcgggcacagcggctccaccttcaagtgctgccacggcgaggactgcagccagatcgggctccacgccgccgccccgcacctggacaaggtcaacggcatctccgaggtggagaacagcaaggtgtacgacgacggggcgccccagtgcggcatcaagtgctggttcgtcaagtccggcgagtggatcagcgggatcttctccggcaactggatcgtgctgatcgtcctctgcgtgttcctgctgttcagcctcgtgctgctgtccatcctctgccccgtccgcaagcacaagaagtcctga

SEQ ID NO: 11764 - RNA, 3408 nt, synthetic construct
  misc_feature 1..3408: note = derived and/or modified CDS sequence (opt1) from HTNV(Aa14-175)__KU207163.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagatcaaggaggagttcgagaagacgaagggcagcatggtgtgcgacgtgtgcaagtacgagtgcgagacctacaaggagctgaaggcccacggcgtctcctgcccccagagccagtgcccctactgcttcacccactgcgagcccaccgaggccgccttccaggcgcactacaaggtgtgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatcctgtgggccgcctccgccagcgagacccccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacacgctgctgttcttcgggcccctcgagggcggcgggctgatcttcaagcactggtgcaccagcacctgccagttcggcgacccgggggacatcatgtccccccgggacaagggcttcctgtgccccgagttccccgggagcttccgcaagaagtgcaacttcgccaccacgccgatctgcgagtacgacggcaacatggtctccggctacaagaaggtgatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtccgtgacgctgacccggggccagaacaccgtcaaggtgagcgggaagggcgggcactccggcagcaccttcaagtgctgccacggcgaggactgctcccagatcgggctccacgccgccgcgccgcacctggacaaggtgaacggcatcagcgaggtcgagaactccaaggtgtacgacgacggggccccccagtgcggcatcaagtgctggttcgtcaagagcggcgagtggatctccgggatcttcagcggcaactggatcgtgctgatcgtgctctgcgtcttcctgctgttctccctcgtgctgctgagcatcctctgccccgtgcgcaagcacaagaagtcctga

SEQ ID NO: 11765 - RNA, 3408 nt, synthetic construct
  misc_feature 1..3408: note = derived and/or modified CDS sequence (opt1) from HTNV(Aa14-184)__KU207164.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatgatcgaggagtcctaccgcagccggaagtccatcacctgctacgacctcagctgcaacaacacgtactgcaagcccaccctgtacatgatcgtgcccatccacgcctgcaacatgatgaagtcctgcctgatcgccctcgggccctaccgcgtccaggtggtgtacgagcggacctactgcatgaccggcgtcctgatcgagggcaagtgcttcgtgccggaccagagcgtggtctccatcatcaagcacgggatcttcgacatcgccagcgtgcacatcgtgtgcttcttcgtcgcggtgaagggcaacacgtacaagatcttcgagcaggtgaagaagagcttcgagtccacctgcaacgacaccgagaacaaggtccaggggtactacatctgcatcgtgggcgggaacagcgcccccatctacgtccccaccctggacgacttccgctccatggaggccttcacgggcatcttccggagcccccacggcgaggaccacgacctcgccggggaggagaccgcgacctactccatcgtgggcccggccaacgccaaggtgccccacagcgcctccagcgacaccctgtccctgatcgccttcagcgggatcccctcctacagctccctcagcatcctgacgtccagcaccgaggcgaagcacgtcttctcccccggcctgttcccgaagctcaaccacaccaactgcgacaagggcgccatccccctgatgtggaccgggatgatcgacctgcccggctactacgaggccatccacccctgcacggtgttctgcgtgctcagcgggccgggcgcctcctgcgaggccttcagcgaggggggcatcttcaacatcaccagccccatgtgcctggtctccaagcagaaccgcttccggctgaccgagcagcaggtgaacttcgtgtgccagcgcgtcgacgtggacatcgtggtctactgcaacggccagcggaaggtgatcctcaccaagacgctggtgatcgggcagtgcatctacaccatcaccagcctgttctccctcctgcccggcgtcgcgcacagcatcgccgtggagctgtgcgtgcccgggttccacggctgggccaccgccgccctcctggtcacgttctgcttcgggtgggtgctgatcccggcgatcaccttcatcatcctcaccatcctgaagttcatcgccaacatcttccacacctccaaccaggagaaccgcctgaagagcgtgctccggaagatcaaggaggagttcgagaagacgaagggctccatggtctgcgacgtgtgcaagtacgagtgcgagacctacaaggagctgaaggcccacggcgtgagctgcccccagtcccagtgcccctactgcttcacccactgcgagcccaccgaggccgccttccaggcgcactacaaggtctgccaggtgacccaccgcttccgggacgacctgaagaagacggtgaccccgcagaacttcacccccgggtgctaccgcaccctcaacctgttccggtacaagagccgctgctacatcttcacgatgtggatcttcctgctcgtcctggagtccatcctgtgggccgccagcgcctccgagacccccctcaccccggtgtggaacgacaacgcgcacggcgtggggagcgtccccatgcacaccgacctggagctggacttctccctgacgagctccagcaagtacacctaccggcgcaagctcaccaaccccctggaggaggcccagagcatcgacctgcacatcgagatcgaggagcagaccatcggcgtggacgtgcacgccctcgggcactggttcgacggccggctgaacctgaagacgtccttccactgctacggcgcctgcaccaagtacgagtacccctggcacaccgccaagtgccactacgagcgcgactaccagtacgagaccagctgggggtgcaacccgtccgactgccccggcgtcgggacgggctgcaccgcgtgcggcctctacctggaccgcctgaagcccgtggggagcgcctacaagatcatcaccatccggtactcccgccgggtgtgcgtccagttcggcgaggagaacctctgcaagatcatcgacatgaacgactgcttcgtgagccgccacgtgaaggtctgcatcatcgggaccgtgtccaagttcagccagggcgacacgctgctgttcttcgggcccctcgagggcggcgggctgatcttcaagcactggtgcacctccacctgccagttcggcgacccgggggacatcatgagcccccgggacaagggcttcctgtgccccgagttccccgggtccttccgcaagaagtgcaacttcgccaccacgccgatctgcgagtacgacggcaacatggtgagcggctacaagaaggtcatggccaccatcgactccttccagagcttcaacacctccaccatgcacttcacggacgagcggatcgagtggaaggaccccgacgggatgctccgcgaccacatcaacatcctggtgaccaaggacatcgacttcgacaacctgggcgagaacccctgcaagatcgggctccagaccagctccatcgagggcgcctgggggagcggcgtgggcttcaccctgacgtgcctggtctccctcaccgagtgccccaccttcctgaccagcatcaaggcgtgcgacaaggccatctgctacggggccgagagcgtgacgctgacccggggccagaacaccgtgaaggtctccgggaagggcgggcacagcggctccaccttcaagtgctgccacggcgaggactgcagccagatcgggctccacgccgccgcgccgcacctggacaaggtgaacggcatctccgaggtggagaacagcaaggtctacgacgacggggccccccagtgcggcatcaagtgctggttcgtgaagtccggcgagtggatcagcgggatcttctccggcaactggatcgtcctgatcgtgctctgcgtgttcctgctgttcagcctcgtcctgctgtccatcctctgccccgtgcgcaagcacaagaagagctga

SEQ ID NO: 11766 - RNA, 3408 nt, synthetic construct
  misc_feature 1..3408: note = derived and/or modified CDS sequence (opt1) from HTNV(LR1)__AF288293.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccgcgacctggccggcgaggagatcgcgagctactccatcgtggggccggccaacgccaaggtgccccacagcgcctccagcgacaccctccggctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccgcttccggctgacggagcagcaggtcaacttcgtgtgccagcgcgtggacatggacatcgtggtctactgcaacggccagcggaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttccgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgggctgaagaagaccgtcacgccccagaacttcaccccgggctgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggggtcggctccgtgccgatgcacaccgacctcgagctggacttcagcctgaccagctccagcaagtacacctaccgccgcaagctgacgaaccccctcgaggaggcccagtccatcgacctgcacatcgagatcgaggagcagaccatcggggtggacgtccacgccctgggccactggttcgacggccggctcaacctgaagaccagcttccactgctacggggcctgcaccaagtacgagtacccctggcacacggccaagtgccactacgagcgcgactaccagtacgagacctcctggggctgcaaccccagcgactgcccgggggtgggcaccggctgcaccgcgtgcgggctgtacctcgaccagctgaagcccgtgggctccgcctacaagatcatcacgatccggtacagccgccgggtctgcgtgcagttcggggaggagaacctgtgcaagatcatcgacatgaacgactgcttcgtgtcccgccacgtcaaggtgtgcatcatcggcaccgtgagcaagttctcccagggggacaccctcctgttcttcggccccctggagggcgggggcctcatcttcaagcactggtgcaccagcacgtgccagttcggggaccccggcgacatcatgtccccgcgggacaaggggttcctgtgccccgagttccccggcagcttccgcaagaagtgcaacttcgccaccacccccatctgcgagtacgacggcaacatggtctccgggtacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacctgggggagaacccctgcaagatcggcctgcagacgtccagcatcgagggggcctggggcagcggcgtcgggttcaccctgacctgcctcgtgtccctgaccgagtgccccacgttcctcaccagcatcaaggcgtgcgacaaggccatctgctacggcgccgagtccgggaccctgacccggggccagaacacggtgaaggtcagcgggaagggcggccactccgggagcaccttcaagtgctgccacggcgaggactgctcccagatcgggctgcacgccgccgcgccccacctcgacaaggtgaacggcatcagcgagatcgagaactccaaggtctacgacgacggcgccccgcagtgcgggatcaagtgctggttcgtcaagagcggcgagtggatctccgggatcttcagcggcaactggatcgtgctgatcgtgctgtgcgtgttcctcctgttctccctggtgctcctgagcatcccctgccccgtccgcaagcacaagaagtcctga

SEQ ID NO: 11767 - RNA, 3408 nt, synthetic construct
  misc_feature 1..3408: note = derived and/or modified CDS sequence (opt1) from HTNV(SN7)__AF288656.1__GP
  source 1..3408: mol_type = other RNA
atgggcgtgtggaagtggctggtcatggccagcctcgtgtggcccgcctgcaccctgcgcaacgtgtacgacatgaagatcgagtgcccgcacaccgtctccttcggggagaacagcgtgatcggctacgtggagctgccgcccatgcccctcgccgacacgacccagctggtccccgagtccagctgctccatggacaaccaccagagcctgaacaccatcaccaagtacacccaggtgtcctggcggaagaaggccgaccaggcccagagctcccagaacagcttcgagaccgtgtccgtcgaggtggacctcaaggggacctgcgtgctgaagcacaagatgatcgaggagagctaccgctcccgcaagagcatcacgtgctacgacctgtcctgcaacagcacgtactgcaagcccaccctctacatgatcgtccccatccacgcctgcaacatgatgaagtcctgcctgatcgccctgggcccctaccgggtccaggtggtgtacgagcggacctactgcatgaccggggtgctcatcgagggcaagtgcttcgtgccggaccagagcgtcgtgtccatcatcaagcacggcatcttcgacatcgcgagcgtgaagatcgtctgcttcttcgtggccgtgaagcgcaacacgtacaagctgttcgagcaggtcaagaagtccttcgactccacgtgcaacgacaccgagaacaaggtgcaggggtactacatctgcatcgtcggcgggaacagcgcccccatctacgtgcccaccctggacgacttccggtccatggaggccttcagcggcatcttccgcagcccccacggggaggaccacgacctcgcgggcgaggaggtggccagctactccatcgtcggcccggccaacgccaaggtgccccacagcgcctccagcgacaccctgtccctgatcgcgtacagcgggatcccctcctacagctccctcagcatcctgacctccagcaccgaggccaagcacgtgttctcccccggcttcttcccgcagctgaaccacaccaagtgcgacaagacggccatccccctcacctggaccgggatgatcgacctgcccggctactacgaggccatccacccctgcaccgtcttctgcgtgctgagcggcccgggggccagctgcgaggcgttctccgagggcgggatcttcaacatcacgagccccatgtgcctcgtgtccaagcagaaccggttccgcctgaccgagcagcaggtcaacttcgtgtgccagcgggtggacatggacatcgtcgtgtactgcaacggccagcgcaaggtgatcctgaccaagaccatggtcatcgggcagtgcatctacacgatcaccagcctcttctccctgctgcccggcgtggcccacagcatcgccgtggagctctgcgtccccggcttccacgggtgggccaccgccgcgctgctggtgaccttctgcttcggctgggtgctcatcccggccgtcacgttcatcatcctgaccgtgctgaagttcgtggccaacatcttccacacctccaaccaggagaaccggctcaagagcgtcctgcgcaagatcaaggaggagttcgagaagaccaaggggtccatggtgtgcgacgtgtgcaagtacgagtgcgagacgtacaaggagctgaaggcccacggcgtcagctgcccccagtcccagtgcccctactgcttcacccactgcgagcccaccgaggccgcgttccaggcccactaccgggtgtgccaggtgacccaccgcttccgggacgacctcaagaagaccgtcacgccgcagaacttcacccccgggtgctaccgcaccctgaacctgttccggtacaagagccgctgctacatcttcaccatgtgggtgttcctcctggtgctggagtccatcctctgggccgccagcgcgtccgaggtccccctgaacccgatctggaacgacaacgcccacggcgtgggcagcgtgcccatgcacacggacctggagctcgacttctccctgaccagcagctccaagtacacctaccggcgcaagctgaccaaccccctggaggagacgcaggccatcgacctccacatcgagatcgaggagcagaccatcggggtcgacgtgcacgccctgggccactggttcgacgggcgcctgaacctcaagaccagcttccactgctacggcgcctgcaccaagtacgagtacccctggcacacggcgaagtgccactacgagcgggactaccagtacgagacctcctgggggtgcaacccgagcgactgccccggcgtgggcaccgggtgcaccgcctgcggcctgtacctggaccagctcaagcccgtcgggtccgcctacaagatcatcacgatccgctacagccggcgcgtgtgcgtgcagttcggcgaggagaacctgtgcaaggtcatcgacatgaacgactgcttcgtgtcccggcacgtgaaggtctgcatcatcggcaccgtgagcaagttctcccagggggacaccctcctcttcttcggccccctggagggcggcgggctgatcttcaagcactggtgcaccagcacgtgccagttcggggacccgggcgacatcatgagcccccgcgacaaggggttcctctgccccgagttccccggcagcttccggaagaagtgcaacttcgccaccaccccgctgtgcgagtacgacgggaacatgatctccggctacaagaaggtgatggccaccatcgacagcttccagtccttcaacacgagcaccatgcacttcaccgacgagcgcatcgagtggaaggaccccgacgggatgctgcgggaccacatcaacatcctcgtcaccaaggacatcgacttcgacaacctgggcgagaacccctgcaagatcggcctgcagacgtccagcatcgagggggcgtggggctccggggtgggcttcaccctgacctgcctggtgagcctgaccgagtgccccacgttcctcaccagcatcaaggcctgcgacaaggccatctgctacggggccgagtccgtcaccctgacccgcggccagaacacggtgaaggtcagcggcaagggcgggcactccgggagcaccttcaagtgctgccacggcgaggactgctcccagaccgggctgcacgccgcggccccgcacctcgacaaggtgaacggcatcagcgagtccgagaacagcaaggtgtacgacgacggcgcgccccagtgcgggatcaagtgctggttcgtcaagtccggcgagtggatcagcgggatcttctccggcaactggatcgtgctgatcgtgctgtgcgtcttcctcctgttcagcctggtgctcctgtccgtgctgtgccccgtccggaagcacaagaagtcctga

SEQ ID NO: 11768 - RNA, 3408 nt, synthetic construct
  misc_feature 1..3408: note = derived and/or modified CDS sequence (opt1) from HTNV(84FLi)__AF366569.1__GP
  source 1..3408: mol_type = other RNA
atgggcgtgtggaagtggctggtcatggccagcctcgtgtggcccgcctgcaccctgcgcaacgtgtacgacatgaagatcgagtgcccgcacaccgtcagcttcggggagaacagcgtgatcggctacgtggagctgccgcccatgcccctcgccgacacgacccagctggtccccgagtccagctgctccatggacaaccaccagagcctgaacaccatcaccaagtacacccaggtgtcctggcggaagaaggccgaccaggcccagagctcccagaacagcttcgagaccgtgtccgtcgaggtggacctcaaggggacctgcgtgctgaagcacaagatgatcgaggagagctaccgctcccgcaagagcatcacgtgctacgacctgtcctgcaacagcacgtactgcaagcccaccctctacatgatcgtccccatccacgcctgcaacatgatgaagtcctgcctgatcgccctgggcccctaccgggtccaggtggtgtacgagcggacctactgcatgaccggggtgctcatcgagggcaagtgcttcgtgccggaccagagcgtcgtgtccatcatcaagcacggcatcttcgacatcgcgagcgtgaagatcgtctgcttcttcgtggccgtgaaggggaacacgtacaagctgttcgagcaggtcaagaagtccttcgactccacgtgcaacgacaccgagaacaaggtgcagggctactacatctgcatcgtcgggggcaacagcgcccccatctacgtgcccaccctggacgacttccgctccatggaggccttcagcgggatcttccggagcccccacggcgaggaccacgacctcgcgggcgaggaggtggccagctactccatcgtcgggccggccaacgccaaggtgccccacaacgccagctccgacaccctgagcctgatcgcgtactccggcatccccagctactccagcctctccatcctgaccagctccaccgaggccaagcacgtgttcagccccgggttcttcccgcagctgaaccacaccaagtgcgacaagacggccatccccctcacctggaccggcatgatcgacctgcccggctactacgaggccatccacccctgcaccgtcttctgcgtgctgtccgggccgggcgccagctgcgaggcgttcagcgagggcgggatcttcaacatcacgtcccccatgtgcctcgtgagcaagcagaaccgcttccggctgaccaagcagcaggtcaacttcgtgtgccagcgcgtggacatggacatcgtcgtgtactgcaacgggcagcggaaggtgatcctgaccaagaccatggtcatcggccagtgcatctacacgatcacctccctcttcagcctgctgcccggcgtggcccactccatcgccgtggagctctgcgtccccgggttccacggctgggccaccgccgcgctgctggtgaccttctgcttcgggtgggtgctcatcccggccgtcacgttcatcatcctgaccgtgctgaagttcgtggccaacatcttccacaccagcaaccaggagaaccgcctcaagtccgtcctgcggaagatcaaggaggagttcgagaagaccaagggcagcatggtgtgcgacgtgtgcaagtacgagtgcgagacgtacaaggagctgaaggcccacggggtctcctgcccccagagccagtgcccctactgcttcacccactgcgagcccaccgaggccgcgttccaggcccactaccgcgtgtgccaggtgacccaccggttccgcgacgacctcaagaagaccgtcacgccgcagaacttcacccccggctgctaccggaccctgaacctgttccgctacaagtcccggtgctacatcttcaccatgtgggtgttcctcctggtgctggagagcatcctctgggccgcctccgcgagcgaggtccccctgaacccgatctggaacgacaacgcccacggcgtggggtccgtgcccatgcacacggacctggagctcgacttcagcctgacctccagcagcaagtacacctaccgccggaagctgaccaaccccctggaggagacgcaggccatcgacctccacatcgagatcgaggagcagaccatcggcgtcgacgtgcacgccctggggcactggttcgacggccgcctgaacctcaagacctccttccactgctacggggcctgcaccaagtacgagtacccctggcacacggcgaagtgccactacgagcgcgactaccagtacgagaccagctggggctgcaacccgtccgactgccccggcgtggggaccggctgcaccgcctgcgggctgtacctggaccagctcaagcccgtcggcagcgcctacaagatcatcacgatccggtactcccgccgggtgtgcgtgcagttcggcgaggagaacctgtgcaaggtcatcgacatgaacgactgcttcgtgagccgccacgtgaaggtctgcatcatcgggaccgtgtccaagttcagccagggcgacaccctcctcttcttcgggcccctggagggcgggggcctgatcttcaagcactggtgcacctccacgtgccagttcggcgacccgggggacatcatgagcccccgggacaagggcttcctctgccccgagttccccgggtccttccgcaagaagtgcaacttcgccaccaccccgctgtgcgagtacgacggcaacatgatcagcgggtacaagaaggtgatggccaccatcgactccttccagagcttcaacacgtccaccatgcacttcaccgacgagcggatcgagtggaaggaccccgacggcatgctgcgcgaccacatcaacatcctcgtcaccaaggacatcgacttcgacaacctgggcgagaacccctgcaagatcgggctgcagacgagctccatcgagggcgcgtgggggagcggcgtggggttcaccctgacctgcctggtgtccctgaccgagtgccccacgttcctcaccagcatcaaggcctgcgacaaggccatctgctacggcgccgagagcgtcaccctgacccggggccagaacacggtgaaggtctccgggaagggcgggcacagcggctccaccttcaagtgctgccacggggaggactgcagccagaccggcctgcacgccgcggccccgcacctcgacaaggtgaacggcatctccgagatcgagaacagcaaggtgtacgacgacggggcgccccagtgcggcatcaagtgctggttcgtcaagtccggggagtggatcagcggcatcttctccggcaactggatcgtgctgatcgtgctgtgcgtcttcctcctgttcagcctggtgctcctgtccgtgctgtgccccgtccgcaagcacaagaagtcctga

SEQ ID NO: 11769 - RNA, 3408 nt, synthetic construct
  misc_feature 1..3408: note = derived and/or modified CDS sequence (opt1) from HTNV(Aa08-1111)__KY594715.1__GP
  source 1..3408: mol_type = other RNA
atgggcatctggaagtggctggtgatggccagcctcgtctggcccgtgttcaccctgcgcaacgtgtacgacatgaagatcgagtgcccgcacaccgtctccttcggggagaacagcgtgatcggctacgtggagctgccccccatgcccctcgccgacacggcgcagatggtcccggagtccagctgctccatggacaaccaccagagcctgaacaccatcaccaagtacacccaggtgtcctggcgggggaaggccgaccagagccagtccagccagaactccttcgagacggtgagcaccgaggtcgacctgaagggcacctgcgtgctcaagcacaagatggtggaggagtcctaccgcagccggaagtccatcacctgctacgacctgagctgcaactccacgtactgcaagcccaccctgtacatgatcgtccccatccacgcctgcaacatgatgaagagctgcctcatcgccctggggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgcccccaccctcgacgacttccgcagcatggaggccttcacgggcatcttccggtccccccacggcgaggaccacgacctggcgggggaggagatcgccagctactccatcgtgggcccggccaacgccaaggtgccccacagcgcctccagcgacaccctgtccctcatcgcgtacagcgggatcccctcctacagctccctgagcatcatcacctccagcaccgaggccaagcacgtcttctcccccggcctgttcccgaagctcaaccacacgaactgcaacaagggcgccatccccctgatctggaccgggatgatcgacctgcccggctactacgaggccgtgcacccctgcaccgtgttctgcgtcctcagcgggccgggcgccagctgcgaggcgttctccgaggggggcatcttcaacatcaccagccccatgtgcctggtgtccaagcagaaccgcttccggctgacggagcagcaggtgaacttcgtctgccagcgcgtggacatggacatcgtggtctactgcaacggccagcggaaggtgatcctcaccaagaccctggtgatcgggcagtgcatctacaccatcacgagcctgttctccctcctgcccggcgtcgcccacagcatcgccgtggagctgtgcgtgcccgggttccacggctgggccaccgccgcgctcctggtcaccttctgcttcgggtgggtgctgatcccggccatcaccttcatcatcctcacggtgctgaagttcatcgccaacatcttccacacctccaaccaggagaaccgcctgaagagcgtcctccggaagatcaaggaggagttcgagaagaccaagggctccatggtgtgcgacatctgcaagtacgagtgcgagacctacaaggagctgaaggcccacggcgtgagctgcccccagtcccagtgcccctactgcttcacgcactgcgagcccaccgaggccgcgttccaggcccactacaaggtctgccaggtgacccaccgcttccgggacgacctgaagaagaccgtgaccccgcagaacttcacgcccgggtgctaccgcaccctcaacctgttccggtacaagagccgctgctacatcttcaccatgtggatcttcctgctcgtcctggagtccatcctgtgggccgccagcgcgtccgagacccccctcacgccggtgtggaacgacaacgcccacggcgtggggagcgtccccatgcacaccgacctggagctggacttctccctcaccagcagctccaagtacacctaccggcgcaagctgacgaaccccctggaggaggcccagagcatcggcctgcacatcgagatcgaggagcagaccatcggggtggacgtgcacgccctcggccactggttcgacggccggctgaacctgaagacctccttccactgctacggggcctgcaccaagtacgagtacccctggcacacggcgaagtgccactacgagcgcgactaccagtacgagaccagctggggctgcaacccgtccgactgccccggggtcggcaccggctgcaccgcctgcgggctctacctggaccagctgaagcccgtgggcagcgcctacaagatcatcacgatccgctactcccggcgcgtgtgcgtccagttcggggaggagcacctctgcaagatcatcgacatgaacgactgcttcgtgagccggcacgtgaaggtctgcatcatcggcaccgtgtccaagttcagccagggggacaccctgctgttcttcggccccctcgagggcgggggcctgatcttcaagcactggtgcacctccacgtgccagttcggggacccgggcgacatcatgagcccccgcgacaaggggttcctgtgccccgagttccccggctccttccggaagaagtgcaacttcgccaccaccccgatctgcgagtacgacggcaacatggtgagcgggtacaagaaggtcatggccaccatcgactccttccagagcttcaacacgtccaccatgcacttcaccgacgagcgcatcgagtggaaggaccccgacggcatgctccgggaccacatcaacatcctggtgaccaaggacatcgacttcgacaacctgggggagaacccctgcaagatcggcctccagacgagctccatcgagggggcgtggggcagcggcgtggggttcaccctgacctgcctggtcagcctcaccgagtgccccacgttcctgacctccatcaaggcctgcgacaaggccatctgctacggcgccgagagcgtgaccctgacccgcgggcagaacacggtgaaggtctccggcaaggggggccacagcggctccaccttcaagtgctgccacggggaggagtgcagccagatcggcctccacgccgcggccccgcacctggacaaggtgaacgggatctccgagatcgagaacagcaaggtgtacgacgacggcgccccccagtgcggcatcaagtgctggttcgtcaagtccggggagtggatcagcggcatcttctccgggaactggatcgtgctgatcgtcctctgcgtgttcctgctgttcagcctcgtgctgctgtccatcctctgccccgtccggaagcacaagaagagctga

SEQ ID NO: 11770 - RNA, 3408 nt, synthetic construct
  misc_feature 1..3408: note = derived and/or modified CDS sequence (opt1) from HTNV(Aa09-189)__KY594716.1__GP
  source 1..3408: mol_type = other RNA
atgggcatctggaagtggctggtgatggccagcctcgtctggcccgtgttcaccctgcgcaacgtgtacgacatgaagatcgagtgcccgcacaccgtctccttcggggagaacagcgtgatcggctacgtggagctgccccccatgcccctcgccgacacggcgcagatggtcccggagtccagctgctccatggacaaccaccagagcctgaacaccatcaccaagtacacccaggtgtcctggcgggggaaggccgaccagagccagtccagccagaactccttcgagacggtgagcaccgaggtcgacctgaagggcacctgcgtgctcaagcacaagatggtggaggagtcctaccgcagccggaagtccatcacctgctacgacctgagctgcaactccacgtactgcaagcccaccctgtacatgatcgtccccatccacgcctgcaacatgatgaagagctgcctcatcgccctggggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgcccccaccctcgacgacttccgcagcatggaggccttcacgggcatcttccggtccccccacggcgaggaccacgacctggcgggggaggagatcgccagctactccatcgtgggcccggccaacgccaaggtgccccacagcgcctccagcgacaccctgtccctcatcgcgtacagcgggatcccctcctacagctccctgagcatcatcacctccagcaccgaggccaagcacgtcttctcccccggcctgttcccgaagctcaaccacacgaactgcgacaagggcgccatccccctgatctggaccgggatgatcgacctgcccggctactacgaggccgtgcacccctgcaccgtgttctgcgtcctcagcgggccgggcgccagctgcgaggcgttctccgaggggggcatcttcaacatcaccagccccatgtgcctggtgtccaagcagaaccgcttccggctgacggagcagcaggtgaacttcgtctgccagcgcgtggacatggacatcgtggtctactgcaacggccagcggaaggtgatcctcaccaagaccctggtgatcgggcagtgcatctacaccatcacgagcctgttctccctcctgcccggcgtcgcccacagcatcgccgtggagctgtgcgtgcccgggttccacggctgggccaccgccgcgctcctggtcaccttctgcttcgggtgggtgctgatcccggccatcaccttcatcatcctcacggtgctgaagttcatcgccaacatcttccacacctccaaccaggagaaccgcctgaagagcgtcctccggaagatcaaggaggagttcgagaagaccaagggctccatggtgtgcgacatctgcaagtacgagtgcgagacctacaaggagctgaaggcccacggcgtgagctgcccccagtcccagtgcccctactgcttcacgcactgcgagcccaccgaggccgcgttccaggcccactacaaggtctgccaggtgacccaccgcttccgggacgacctgaagaagaccgtgaccccgcagaacttcacgcccgggtgctaccgcaccctcaacctgttccggtacaagagccgctgctacatcttcaccatgtggatcttcctgctcgtcctggagtccatcctgtgggccgccagcgcgtccgagacccccctcacgccggtgtggaacgacaacgcccacggcgtggggagcgtccccatgcacaccgacctggagctggacttctccctcaccagcagctccaagtacacctaccggcgcaagctgacgaaccccctggaggaggcccagagcatcggcctgcacatcgagatcgaggagcagaccatcggggtggacgtgcacgccctcggccactggttcgacggccggctgaacctgaagacctccttccactgctacggggcctgcaccaagtacgagtacccctggcacacggcgaagtgccactacgagcgcgactaccagtacgagaccagctggggctgcaacccgtccgactgccccggggtcggcaccggctgcaccgcctgcgggctctacctggaccagctgaagcccgtgggcagcgcctacaagatcatcacgatccgctactcccggcgcgtgtgcgtccagttcggggaggagcacctctgcaagatcatcgacatgaacgactgcttcgtgagccggcacgtgaaggtctgcatcatcggcaccgtgtccaagttcagccagggggacaccctgctgttcttcggccccctcgagggcgggggcctgatcttcaagcactggtgcacctccacgtgccagttcggggacccgggcgacatcatgagcccccgcgacaaggggttcctgtgccccgagttccccggctccttccggaagaagtgcaacttcgccaccaccccgatctgcgagtacgacggcaacatggtgagcgggtacaagaaggtcatggccaccatcgactccttccagagcttcaacacgtccaccatgcacttcaccgacgagcgcatcgagtggaaggaccccgacggcatgctccgggaccacatcaacatcctggtgaccaaggacatcgacttcgacaacctgggggagaacccctgcaagatcggcctccagacgagctccatcgagggggcgtggggcagcggcgtggggttcaccctgacctgcctggtcagcctcaccgagtgccccacgttcctgacctccatcaaggcctgcgacaaggccatctgctacggcgccgagagcgtgaccctgacccgcgggcagaacacggtgaaggtctccggcaaggggggccacagcggctccaccttcaagtgctgccacggggaggagtgcagccagatcggcctccacgccgcggccccgcacctggacaaggtgaacgggatctccgagatcgagaacagcaaggtgtacgacgacggcgccccccagtgcggcatcaagtgctggttcgtcaagtccggggagtggatcagcggcatcttctccgggaactggatcgtgctgatcgtcctctgcgtgttcctgctgttcagcctcgtgctgctgtccatcctctgccccgtccggaagcacaagaagagctga

SEQ ID NO: 11771 - RNA, 3408 nt, synthetic construct
  misc_feature 1..3408: note = derived and/or modified CDS sequence (opt1) from HTNV(CJilin93)__AY748307.1__GP
  source 1..3408: mol_type = other RNA
atgggcatgtggaagtggctggtgatcgccagcctcgtctggcccgccctggcgctgcgcaacgtgtacgacatgaagatcgagtgcccccacaccgtgtccttcggggagaacagcgtcatcggctacgtggagctcccgcccatgcccctggccgacaccgcccagatggtgcccgagtccagctgctccatggacaaccaccagagcatcaacacgatcaccaagtacacccaggtcacctggcgggggaaggccgaccccggccagtccagccagaactccttcgagacgctgagcgccgaggtggacctcaaggggacctgcgtgctgaagcacaagatggtcgaggagtcctaccgcagccggaagtccatcacgtgctacgacctgagctgcaactccacctactgcaagcccaccctctacatgatcgtgcccatccacgcgtgcaacatgatgaagtcctgcctgatcgccctgggcccgtaccgcgtgcaggtcgtgtacgagcggacctactgcatgaccggcgtgctcatcgaggggaagtgcttcgtccccgaccagtccgtggtgagcatcatcaagcacggcatcttcgacatcgcctccgtccacatcgtgtgcttcttcgtggccgtcaaggggaacacctacaagctgttcgagcaggtcaagaagtccttcgagagcacgtgcaacgacaccgagaacaaggtgcagggctactacatctgcatcgtcgggggcaacagcgcgcccatctacgtgcccaccctggacgacttccgcagcatggaggccttcaccggcatcttcaagtccccgcacggggaggaccacgacctcgccggcgaggagatcgccagctactccatcgtggggcccgccaacgcgaaggtgccccacagcgcctccagcgacacgctgtccctgatcgcctacagcggcatcccctcctacagctccctcagcatcctgacctccagcaccgacgccaagcacgtgttctccccgggcctgttccccaagctcaaccacaccaactgcgacaagagcgccatccccctgacgtggaccgggatgatcgacctgcccggctactacgaggcgatccacccgtgcaccgtcttctgcgtgctctccgggcccggcgccagctgcgaggccttcagcgagggcgggatcttcaacatcacctcccccatgtgcctggtgagcaagcagaaccggttccgcctgacggagcagcaggtcaacttcgtgtgccagcgggtggacatggacatcgtcgtgtactgcaacggccagcgcaaggtgatcctcaccaagaccctggtcatcgggcagtgcatctacaccatcacgtccctgttcagcctcctgcccggcgtggcccactccatcgccgtggagctgtgcgtcccggggttccacggctgggcgaccgccgccctcctggtgacctactgcttcgggtgggtgctgatccccgccatcaccttcatcatcctcacggtcctgaagttcatcgccaacatcttccacaccagcaaccaggagaaccggctgaagtccgtgctccgcaagatcaaggaggagttcgagaagaccaagggcagcatggtgtgcgacgtctgcaagtacgagtgcgagacctacaaggagctgaaggcgcacggcgtgtcctgcccccagagccagtgcccctactgcttcacgcactgcgagccgaccgaggccgccttccaggcccactacaaggtgtgccaggtcacccaccggttccgcgacgacctgaagaagaccgtgacgccccagaacttcacccccgggtgctaccggaccctcaacctgttccgctacaagtcccggtgctacatcttcaccatgtgggtgttcctgctcatcctggagagcgtcctgtgggcggcctccgccagcgagaccccgctcacgcccgtgtggaacgacaacgcccacggcgtggggtccgtccccatgcacaccgacctggagctggacttcagcctgacctccagcagcaagtacacctaccgccggaagctcacgaaccccctggaggaggcccagtccatcgacctgcacatcgagatcgaggagcagaccatcggcgtggacgtgcacgcgctcgggcactggttcgacggccgcctgaacatcaagaccagcttccactgctacggcgcctgcaccaagtacgagtacccgtggcacacggccaagtgccactacgagcgggactaccagtacgagacctcctgggggtgcaaccccagcgactgccccggcgtcgggaccggctgcaccgcctgcggcctgtacctcgaccagctgaagcccgtggggtccgcctacaagatcatcacgatccgctacagccgccgggtgtgcgtccagttcggcgaggagaacctgtgcaagatcatcgacatgaacgactgcttcgtgtcccgccacgtgaaggtctgcatcatcgggaccgtgagcaagttctcccagggcgacaccctcctgttcttcgggccgctggagggcggcgggctcatcttcaagcactggtgcaccagcacgtgccagttcggcgaccccggggacatcatgagcccccgggacaagggcttcctgtgccccgagttcccggggagcttccgcaagaagtgcaacttcgcgaccacccccatctgcgagtacgacggcaacatggtgtccggctacaagaaggtcatggccaccatcgacagcttccagtccttcaacacgagcaccatgcacttcaccgacgagcggatcgagtggaaggaccccgacgggatgctgcgcgaccacatcaacatcctcgtgaccaaggacatcgacttcgacaacctgggcgagaacccctgcaagatcgggctgcagacgtccagcatcgagggcgcctgggggtccggcgtgggcttcaccctgacctgcctcgtcagcctgaccgagtgcccgacgttcctcaccagcatcaaggcctgcgacaaggccatctgctacggggcggagtccgtgaccctgacccggggccagaacacggtgaaggtcagcgggaagggcgggcactccggcagcaccttcaagtgctgccacggcgaggactgctccaagatcgggctgcacgccgccgccccgcacctcgacaaggtgaacggcatcagcgagatcgagaactccaaggtgtacgacgacggggcgccccagtgcggcatcaagtgctggttcgtcaagagcggcgagtggatctccgggatcttcagcggcaactggatcgtgctgatcgtcctgtgcgtgttcctcctgttctccctggtgctcctgagcatcctgtgccccgtccgcaagcacaagaagtcctga

SEQ ID NO: 11772 - RNA, 3408 nt, synthetic construct
  misc_feature 1..3408: note = derived and/or modified CDS sequence (opt1) from HTNV(KHF,clone:4)__LC209208.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccaagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcggtcaccttcatcatcctcgccatcctgaagttcatcgccaacatcttccacaccagcaaccaggagaaccgcctgaagtccgtgctccggaagatcaaggaggagttcgagaagaccaagggcagcatggtgtgcgacgtctgcaagtacgagtgcgagacgtacaaggagctgaaggcccacggcgtgtcctgcccccagagccagtgcccctactgcttcacccactgcgagcccaccgaggccgcgttccaggcccactacaaggtgtgccaggtcacccaccgcttccgggacgacctgaagaagaccgtgacgccgcagaacttcacccccgggtgctaccgcaccctcaacctgttccggtacaagtcccgctgctacatcttcaccatgtggatcttcctgctcgtgctggagagcatcctgtgggccgcctccgcgagcgagacgcccctcaccccggtctggaacgacaacgcccacggcgtggggtccatccccatgcacaccgacctggagctggacttcagcctgacctccagcagcaagtacacgtaccggcgcaagctcaccaaccccctggaggaggcccagtccatcgacctgcacatcgagatcgaggagcagaccatcggcgtggacgtccacgccctcgggcactggttcgacggccggctgaacctgaagaccagcttccactgctacggcgcctgcacgaagtacgagtacccctggcacaccgcgaagtgccactacgagcgcgactaccagtacgagacctcctgggggtgcaacccgagcgactgccccggcgtggggaccggctgcacggcctgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacaccctgctgttcttcgggcccctcgagggcggcgggctgatcttcaagcactggtgcacgagcacctgccagttcggcgacccgggggacatcatgtccccccgggacaagggcttcctgtgccccgagttccccgggagcttccgcaagaagtgcaacttcgccaccaccccgatctgcgagtacgacggcaacatggtctccggctacaagaaggtgatggccacgatcgacagcttccagtccttcaacaccagcaccatgcacttcaccgacgagcggatcgagtggaaggaccccgacgggatgctccgcgaccacatcaacatcctggtgacgaaggacatcgacttcgacaacctgggcgagaacccctgcaagatcgggctccagacctccagcatcgagggcgcgtgggggtccggcgtcggcttcaccctgacctgcctggtgagcctcacggagtgccccaccttcctgaccagcatcaaggcctgcgacaaggccatctgctacggggccgagtccgtgaccctgacgcggggccagaacaccgtcaaggtgagcgggaagggcgggcactccggcagcaccttcaagtgctgccacggcgaggactgctccccgaacgggctccacgccgcggccccccacctggacaaggtgaacggcatcagcgagatcgagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11773 - RNA, 3408 nt, synthetic construct
  misc_feature 1..3408: note = derived and/or modified CDS sequence (opt1) from HTNV(KHF,clone:5)__LC209209.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccccccatgcccctggccgacacggcgcagctggtcccggagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgcgtgctgaagcacaagatggtggaggagtcctaccgcagccggaagtccatcacctgctacgacctcagctgcaactccacgtactgcaagcccaccctgtacatgatcgtccccatccacgcctgcaacatgatgaagagctgcctgatcgccctcgggccctaccgcgtgcaggtggtctacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacctgcaacgacaccgagaacaaggtgcaggggtactacatctgcatcgtcggcgggaactccgcccccatctacgtgcccaccctggacgacttccgcagcatggaggccttcacgggcatcttccggtccccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaggggggcatcttcaacatcacctcccccatgtgcctggtgagcaagcagaaccgcttccggctgaccgagcagcaggtgaacttcgtctgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccgggttccacggctgggccaccgccgccctcctggtgacgttctgcttcgggtgggtgctgatcccggcggtcaccttcatcatcctcgccatcctgaagttcatcgccaacatcttccacaccagcaaccaggagaaccgcctgaagtccgtgctccggaagatcaaggaggagttcgagaagaccaagggcagcatggtgtgcgacgtctgcaagtacgagtgcgagacgtacaaggagctgaaggcccacggcgtgtcctgcccccagagccagtgcccctactgcttcacccactgcgagcccaccgaggccgcgttccaggcccactacaaggtgtgccaggtcacccaccgcttccgggacgacctgaagaagaccgtgacgccgcagaacttcacccccgggtgctaccgcaccctcaacctgttccggtacaagtcccgctgctacatcttcaccatgtggatcttcctgctcgtgctggagagcatcctgtgggccgcctccgcgagcgagacgcccctcaccccggtctggaacgacaacgcccacggcgtggggtccatccccatgcacaccgacctggagctggacttcagcctgacctccagcagcaagtacacgtaccggcgcaagctcaccaaccccctggaggaggcccagtccatcgacctgcacatcgagatcgaggagcagaccatcggcgtggacgtccacgccctcgggcactggttcgacggccggctgaacctgaagaccagcttccactgctacggcgcctgcacgaagtacgagtacccctggcacaccgcgaagtgccactacgagcgcgactaccagtacgagacctcctgggggtgcaacccgagcgactgccccggcgtggggaccggctgcacggcctgcggcctctacctggaccgcctgaagcccgtggggtccgcctacaagatcatcaccatccggtacagccgccgggtctgcgtgcagttcggcgaggagaacctctgcaagatcatcgacatgaacgactgcttcgtgtcccgccacgtcaaggtgtgcatcatcgggaccgtgagcaagttctcccagggcgacaccctgctgttcttcgggcccctcgagggcggcgggctgatcttcaagcactggtgcacgagcacctgccagttcggcgacccgggggacatcatgtccccccgggacaagggcttcctgtgccccgagttccccgggagcttccgcaagaagtgcaacttcgccaccaccccgatctgcgagtacgacggcaacatggtctccggctacaagaaggtgatggccacgatcgacagcttccagtccttcaacaccagcaccatgcacttcaccgacgagcggatcgagtggaaggaccccgacgggatgctccgcgaccacatcaacatcctggtgacgaaggacatcgacttcgacaacctgggcgagaacccctgcaagatcgggctccagacctccagcatcgagggcgcgtgggggtccggcgtcggcttcaccctgacctgcctggtgagcctcacggagtgccccaccttcctgaccagcatcaaggcctgcgacaaggccatctgctacggggccgagtccgtgaccctgacgcggggccagaacaccgtcaaggtgagcgggaagggcgggcactccggcagcaccttcaagtgctgccacggcgaggactgctccccgaacgggctccacgccgcggccccccacctggacaaggtgaacggcatcagcgagatcgagaactccaaggtctacgacgacggggccccccagtgcggcatcaagtgctggttcgtgaagagcggcgagtggatctccgggatcttcagcggcaactggatcgtcctgatcgtgctctgcgtgttcctgctgttctccctcgtcctgctgagcatcctctgccccgtgcgcaagcacaagaagtcctga

SEQ ID NO: 11774 - RNA, 3405 nt, synthetic construct
  misc_feature 1..3405: note = derived and/or modified CDS sequence (opt1) from HTNV__D00376.1__GP
  source 1..3405: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggccgacacggcccagctggtccccgagtccagctgctccatggacaaccaccagagcctcaacaccatcaccaagtacacccaggtgtcctggcgggggaaggccgaccagagccagtccagccagaactccttcgagacggtgagcaccgaggtcgacctgaaggggacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagtcctgcctgatcgccctcgggccctaccgcgtccaggtggtgtacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaagtccttcgagagcacgtgcaacgacaccgagaacaaggtgcaggggtactacatctgcatcgtcggcgggaactccgcccccatctacgtgcccaccctggacgacttccgcagcatggaggccttcaccggcatcttccggagcccccacggcgaggaccacgacctcgccggggaggagaccgcgacctacagcatcgtgggcccggccaacgccaaggtcccccactccgccagctccgacaccctgagcctgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacgtgccccgctactacgacggcatccaccccttcacggtcttctgcgtgctgtccgggccgggcgccagctgcgaggccttcagcgagggcggcatcttcaacatcacctcccccatgtgcctcgtgagcaagcagaaccggttccgcctgaccgagcagcaggtcaacttcgtgtgccagcgggtggacgtcgacatcgtggtgtactgcaacggccagcgcaaggtcatcctgaccaagacgctcgtgatcgggcagtgcatctacaccatcacctccctgttcagcctgctccccggcgtggcccactccatcgcggtcgagctgtgcgtgcccgggttccacggctgggccaccgccgccctgctcgtgacgttctgcttcgggtgggtcctgatcccggccgtgaccttcatcatcctggcgatcctcaagttcatcgccaacatcttccacaccagcaaccaggagaaccggctgaagtccgtgctgcgcaagatcaaggaggagttcgagaagaccaagggcagcatggtctgcgacgtgtgcaagtacgagtgcgagacgtacaaggagctcaaggcccacggcgtgtcctgcccccagagccagtgcccctactgcttcacccactgcgagcccaccgaggccgccttccaggcgcactacaaggtctgccaggtgacccaccggttccgcgacgacctgaagaagaccgtgacgccgcagaacttcacccccgggtgctaccggaccctgaacctcttccgctacaagtcccggtgctacatcttcaccatgtggatcttcctgctggtcctcgagagcatcctgtgggccgcctccgccagcgagacgcccctgaccccggtgtggaacgacaacgcgcacggcgtggggtccatccccatgcacaccgacctcgagctggacttcagcctgacctccagcagcaagtacacgtaccgccggaagctgaccaaccccctcgaggcccagtccatcgacctgcacatcgagatcgaggagcagaccatcggcgtcgacgtgcacgccctggggcactggttcgacggccgcctcaacctgaagaccagcttccactgctacggcgcctgcacgaagtacgagtacccctggcacaccgccaagtgccactacgagcgcgactaccagtacgagacctcctgggggtgcaacccgagcgactgccccggctgcgggaccggctgcacggcgtgcggcctgtacctcgaccggctgaagcccgtggggtccgcctacaagatcatcaccatccgctacagccggcgcgtctgcgtgcagttcggcgaggagaacctgtgcaagatcatcgacatgaacgactgcttcgtgtcccggcacgtcaaggtgtgcatcatcgggaccgtgagcaagttctcccagggcgacaccctcctgttcttcgggcccctggagggcggcgggctcatcttcaagcactggcgcacgagcacgtgccagttcggcgacccgggggacatcatgagcccccgggacaagggcttcctgtgccccgagttccccgggtccttccgcaagaagtgcaacttcgccaccaccccgatctgcgagtacgacggcaacatggtctccggctacaagaaggtgatggccaccatcgacagcttccagtccttcaacaccagcaccatgcacttcaccgacgagcggatcgagtggaaggaccccgacgggatgctgcgcgaccacatcaacatcctcgtgacgaaggacatcgacttcgacaacctgggcgagaacccctgcaagatcgggctgcagacctccagcatcgagggcgcctgggggtccggcgtcggcttcaccctgacctgcctcgtgagcctgacggagtgccccaccttcctcaccagcatcaaggcgtgcgacaaggccatctgctacggggccgagtccgtgaccctgacgcggggccagaacaccgtcaaggtgagcgggaagggcgggcactccggcagcaccttcaagtgctgccacggcgaggactgctccccgaacgggctgcacgccgccgcgccccacctcgacaaggtgaacggcatcagcgagatcgagaactccaaggagtacgacgacggggcgccccagtgcggcatcaagtgctggttcgtcaagagcggcgagtggatctccgggatcttcagcggcaactggatcgtgctgatcgtcctgtgcgtgttcctcctgttctccctggtgctcctgagcatcctgtgccccgtccgcaagcacaagaagtcctga

SEQ ID NO: 11775 - RNA, 3417 nt, synthetic construct
  misc_feature 1..3417: note = derived and/or modified CDS sequence (opt1) from LANV(510B)__AF005728.1__GP
  source 1..3417: mol_type = other RNA
atggagggctggctgttcaccatcctcggggtgtgctacatcatgaccacggtcctgcccaagaccatctacgagctgaagatggagtgcccgcacaccgtgggcctcgggcagggctacatcatcgggagcgccgagctgggcctgatcgacatcgccaccgtgcccgagatcaagctcgagtccagctgcaacttcgacctgcacacgacctccagcacccagaagtccttcacccagctggagtggcgcaagaaggcggagacgaccgacaccacccaggccgccagcacgaccttcgaggcccagaccaagaccgtcaacatccggggcacgtgcatcctcgcctccgacctgtacgacaccctgaagcgcgtgaagaagaccgtgctctgctacgacctgacctgcaaccagacgcagtgccagcccaccgtctacctgatcacccccgtggggacctgcatgagcatccggtcctgcatggcgaacctcctgagcaaccgcatccagatcacgttcgagaagacccactgcgtgaccggccagctggtcgaggggcagtgcttcaacccgtcccacagcctcaccctgtcccagccgccccacacgtacgacgtggtgaccctgcccacgacctgcttcttcaccgccaagaaggccgaccagtacaagatcgtcaagaccttcgagggcatcatcagcaagaccgggtgcaccgagaactccatccagggctactacgtgtgcttcatcggcagccactccgagcccctcatcatccccacgctggaggacatccggagcgccgagctggcgtcccgcatgctcctgcacccccgcggggaggaccacgaccccctgcagaacgcccaggccgtgctccggatcgtcggcccgatcaccgccaaggtgcccagcagctccagcaccgagaccctgcaggggatcgccttcgcgggcgtgcccatgtactccagcttctccaccctggtccggaacgccgaccccgagtacgtgttcagcccgggcatcatccccgagtccaaccagagcgtgtgcgacaagaagacgctccccctgacctggaccgggtacctgcccatctccggcgagatggagaaggtcaccgggtgcacggtgttctgcaccctcgccggcccgggggccaactgcgaggcctacagcgagtccggcatcttcaacatcagctccccgacctgcctggtgaacaaggtccagcgcttccggggcagcgagcagaagatcaacttcatgtgccagcgcatcgacaacaacgtggtcgtgtactgcaacgggcagaagaaggtgatcctgaccaagacgctcgtcatcggccagtgcatctacaccttcacctccctgttcagcctgatgcccgacgtggcgcactccctcgccgtggagctgtgcgtccccgggctgcacggctgggccaccatcgccctcctgagcacgttctgcttcgggtggctgctcatccccggcatcaccctgatcgtgctgaagatcctcaagatcctgacctactcctgcagccactacagctccgagagcaagttcaagatgatcctggagaaggtgaaggtcgagtaccagaagaccatgggctccatggtgtgcgacatctgccaccacgagtgcgagacggtgaaggagctggagagccacaagcagtcctgcgtcgaggggcagtgcccctactgcatgaccgtgaccgaggccacccagagcgcgctccaggcccacttctccatctgcaagctgacgggccggttccacgaggccctgaagaagtccctcaagaagcccgaggtgcaccgcgggtgctaccggaccctgggcgtcttccgctaccggagccgctgctacgtggggctggtgtggggctgcctcctgaccatcgagctggtcctctgggccgccagcgcggagacgcccctgctggagccgggctggtccgacaccgcccacggggtgggcgagctccccctgaagaccgacctggagctcgacttcagcctgccctccagctccagctactcctaccggcgccggctgaccaacccggccaacaaggaggagagcctccccttccacttccagatggagaagcaggtcatccacgccgagatccagagcctggggcactggatggacgcgaccttcaacatcaagacggccttccactgctacggcgcctgcaagcagtactcctacccctggcagaccgccaagtgcttcttcgagaaggactaccagtacgagaccggctgggggtgcaaccccggcgactgcccgggggtgggcaccgggtgcacggcctgcggcatctacctggacaagctcaagagcgtgggcaaggcgtacaaggtgatctccctgaagtacacccgcaaggtctgcatccagctggggaccgagcaggtctgcaagcacatcgacgccaacgactgcctcgtgacccccagcgtgaaggtgtgcatcatcggcacggtgtccaagatccagcccagcgacaccctgctgttcctcgggcccctggagcagggcggggtcatcctgaagcagtggtgcaccacctcctgcaccttcggcgacccgggcgacatcatgagcacgacctccgggatgcgctgccccgagcacaccggcagcttccggaagatctgcgggttcgccaccacgcccgtgtgcgagtaccagggcaacaccatctccgggtaccagcgcctcatggccaccaaggacagcttccagtccttcaacctgaccgacccccacatcacgagctccaagctggagtggatcgacccggacggcaacacccgggaccacgtgaacctcatcctgaaccgcgacgtcagcttccaggacctgtccgacaacccctgcaaggtggacctccacacccagagcatcgacggcgcctgggggtccggcgtggggttcaccctgacgtgcgtcgtgggcctgaccgagtgccccagcttcatcaccagcatcaaggcgtgcgacctcgccatgtgctacgggtccaccgtggccacgctggcccggggcagcaacaccgtcaaggtggtgggcaagggcgggcactccgggagctccttcaagtgctgccacgacagcgactgctccagcgagggcctgatggcctccgcgccccacctcgagcgcgtcaccggcttcaaccagatcgacagcgacaaggtgtacgacgacggggccccgccctgctccttcaagtgctggttcaccaagagcggcgagtggctgctggggatcctcaacggcaactggatcgtgatcgccgtcctggtgatcatcctgatcatctccatcatcctcttcagcttcctgtgcccccggcgctcccacaagaagaacgtgtga

SEQ ID NO: 11776 - RNA, 3402 nt, synthetic construct
  misc_feature 1..3402: note = derived and/or modified CDS sequence (opt1) from LQUV(Longquan-Rs-32)__JX465402.1__GP
  source 1..3402: mol_type = other RNA
atgaagtccatcctgctcatcctgctgctcgagcaggtccgcagcaaggccaccaacgagatcaagctggagtgcccccacgaccagcgggtggagaccggcttcagccacgggttcacggacctgtccccgatcctctacaccaagggcctgttcaccaagcacctggagaacaactgccccttcgacatcagcatcatcaaccgcctcgtgcgggacgtgcgcatctccacctggcaggccaagagcacgaacaccgacgcgaccgtcgcctccgccaccagcttcgagacgaaggacaccgacgacaagctggccggggtgtgcggcttcttcgacgacatcaccaagcccaagcaggggcagcggaaggccatcatctgctacgacctgtcctgcaaccagacccactgcctccccacgctgcacctgatcttcccgcagcagttctgccagagcctcaagcagtgctccatcaacgcgtacgaccacaagatcctgatcaccatcagcctgtccttctgccccgagggcctcatcatcggcgggaactgcatcgtgcccgtcctggcccagagccagctgctccacaaccacatgacctacaacatcaaggtgacctgcttcttcgagtactccatggcccgcgagagcctggacaacaagttcctggaggagatgaaccggctcgtgctgggccgcaactgcgagaagacggagtacctcgggggctacgtctgcttcctcgccgggtacggcaccgcgatccacgtgccctacgacaacacctacctgtccggcgccgtggtcaacagcatgaaggccaacctgcacggggaggaccacgaccggctcaagctgggcgacacctccgccgtgatcgccgggaacctgaagttcgtgatcgacagcacggcgccggagaagtcctaccagggcgagtgcttcaccggccacatggggtacaccagcctctacttctaccccgtccgcagcaagggcaagtacgtgaccatcctgacgaagggggtgatccccgtcatcaacaagacgacctgcatgcccaagatcgtgccgctggtgtggaccggcatggtcgagatgcgggggatcgaggagaagctcgaggcctgcaccatgcactgcatcatggtgggcaacggcgcgacctgcgaggccttctccgccaccgggatcttcgacatcaagagcaccacgtgccagatcggcaagacccacaagtaccgccggaccgaggaccagatcaccttcacgtgccaggacctgaacaaggacatctccgtgatctgcaacggggagaacatcaccgtccccgtcaagagcctgatcgtgggccagtgcatctacaccatcacctccatcttcagcatcttccccgccaccgcccactccatcgccacggagatgtgcgtgcaggggatccacggctggctcaccatcatcatcttcttcaccttctgcttcggctggctgctgatccccatcctgacctgcctgatcatcaacacgatcgcctacagcctgatcaccctcgcctacttcaagaacggggcgcgcctgggcaacctgatcaagcggatgaagtccgagttccagcgcaccatcgggaacaccacgtgcaacatctgcctccgggagtgcgagagcgagtccgagtacaagagccacgaggagctgtgcaagaacggctcctgcccgtactgcatgaaggacatcggggtgagccaggtcctgctgaacgagcactacaacgcctgcatgctcatcgaccgctacgagaagcggctgacccacaccctgaaccagacgcccctctactcccgcaaggtgcggaagatccagagcttccgctaccgcaaccggtgcttcatcctgaccgtgtggatcatcctgctcaccgtcgagtccctgatctgggccagcagcgccgaggacatcaagcccgcccccaagtggcagaacaccgcgcacggcatcggcaccatcaagctgaactccgactacgagctcgacttcagcgtggtggccgggtccgagttcacgcacaagcgcatgctgcagagcccggagtccggcaagaagaacatccccttcaccgtctacctgagcgagcagctcatcacctccaccgtgcagatcctggggaactggatggacgccgagatcaacgtcaagagcgtgttccactgctacggcacgtgcaagaagtactcctacccctggcagagctccccctgccacaaggaggtggacttcgagttccagagctcctggggctgcaacccgatcagctgccccgggatcaactccggctgcaccgcctgcgggacctacgtggacaagctgaagaccatcgcgaaggcctaccggatcatcacggtcaagtacagccgcaaggtgtgctaccagatcggcaccaagaaggcctgcaagaccctcgagtccaacgactgcctggtgagcaacggggtcaagatctgcgccatcggcaccatcagcacgctgcagaccggcatgaccctcgtgttcttcgggcccctgaacggcggggccctgctcatcaaggactggtgcatctccagctgcaagttcggcgaccccggggacatcatgcagatctccaacaacatcacgtgcccgagcttcgacggcaccatgcagcgggtgtgccgcttcggcctggagcccatgtgctcctacagcgggaacaagatctccggcgtcaagcgggtgctggagaccaaggacagctacctctccgtgaacctgaccaagcccaagctggtcgggagcaccctcctgtggaactccctggacagctccatcaaggaccacatcaacatcgtggtgagcaacgacatcgacttcgaggacctcgcggagacgccgtgcaaggtcaccatcaagaacctgaagatcgagggcgcctgggggtccggcatcggcatcaagctgcactgcgaggtgagcctctccgagtgcagcgagtacctgaccaccatcaaggtgtgcgacaacgccatctgctacgggggcaacgtcgcccacctgtcccgcgggctcaacaccgtgatcatcaagggcgccgggggccacagcggcagctccttcaagtgctgccacgagacgagctgctccgacatcgggttcaaggcggaggcgccccacctggcccggatcgtggacgacggcatcaccaccagcatgtcctacagcgacggggcccccgaggccggcatcgtctcctggatctacaaggtggccgagtggatcaagggcatgttcaacgggaactggttcgtgctgatcatcatgatcctcttcctgatcatcagcatcgtcctgctcatcttcctgtgccccgtgaagaagtacaagtga

SEQ ID NO: 11777 - RNA, 3402 nt, synthetic construct
  misc_feature 1..3402: note = derived and/or modified CDS sequence (opt1) from LQUV(Longquan-Ra-25)__JX465397.1__GP
  source 1..3402: mol_type = other RNA
atgaagtccatcctgctcatcctgctgctcggccaggtgcgcagcaaggccaccaacgagatcaagctggagtgcccccacgaccagcgggtcgagaccgggttcagccacggcttcacggacctgtccccgatcctctacaccaaggggctgttcaccaagcacctggagaacaactgccccttcgacatcagcatcatcaaccgcctcgtgcgggacgtgcgcatctccacctggcaggccaagagcacgaacaccgacgcgaccgtcgcctccgccaccagcttcgagacgaaggacaccgacgacaagctggccggcgtgtgcgggttcttcgacgacatcaccaagcccaagcagggccagcggaaggccatcatctgctacgacctgtcctgcaaccagacccactgcctccccacgctgcacctgatcttcccgcagcagttctgccagagcctcaagcagtgctccatcaacgcgtacgaccacaagatcctgatcaccatcagcctgtccttctgccccgagggcctcatcatcgggggcaactgcatcgtgcccgtcctggcccagagccagctgctccacaaccacatgacctacaacatcaaggtgacctgcttcttcgagtactccatggcccgcgagagcctggacaacaagttcctggaggagatgaaccggctcgtgctggggcgcaactgcgagaagacggagtacctgggcgggtacgtctgcttcctcgccggctacggcaccgcgatccacgtgccctacgacaacacctacctgtccggggccgtggtcaacagcatgaaggccaacctgcacggcgaggaccacgaccggctcaagctgggggacacctccgccgtgatcgccggcaacctgaagttcgtgatcgacagcacggcgccggagaagtcctaccagggcgagtgcttcaccgggcacatgggctacaccagcctctacttctaccccgtccgcagcaaggggaagtacgtgaccatcctgacgaagggcgtgatccccgtcatcaacaagacgacctgcatgcccaagatcgtgccgctggtgtggaccgggatggtcgagatgcggggcatcgaggagaagctcgaggcctgcaccatgcactgcatcatggtgggcaacggggcgacctgcgaggccttctccgccaccggcatcttcgacatcaagagcaccacgtgccagatcgggaagacccacaagtaccgccggaccgaggaccagatcaccttcacgtgccaggacctgaacaaggacatctccgtgatctgcaacggcgagaacatcaccgtccccgtcaagagcctgatcgtggggcagtgcatctacaccatcacctccatcttcagcatcttccccgccaccgcccactccatcgccacggagatgtgcgtgcagggcatccacggctggctcaccatcatcatcttcttcaccttctgcttcgggtggctgctgatccccatcctgacctgcctcatcatcaacacgatcgcctacagcctgatcaccctcgcctacttcaagaacggcgcgcgcctggggaacctgatcaagcggatgaagtccgagttccagcgcaccatcggcaacaccacgtgcaacatctgcctccgggagtgcgagagcgagtccgagtacaagagccacgaggagctgtgcaagaacgggtcctgcccgtactgcatgaaggacatcggcgtgagccaggtcctgctgaacgagcactacaacgcctgcatgctcatcgaccgctacgagaagcggctgacccacaccctgaaccagacgcccctctactcccgcaaggtgcggaagatccagagcttccgctaccgcaaccggtgcttcatcctgaccgtgtggatcatcctgctcaccgtcgagtccctgatctgggccagcagcgccgaggacatcaagcccgcccccaagtggcagaacaccgcgcacggcatcgggaccatcaagctgaactccgactacgagctcgacttcagcgtggtggccggctccgagttcacgcacaagcgcatgctgcagagcccggagtccgggaagaagaacatccccttcaccgtctacctgagcgagcagctcatcacctccaccgtgcagatcctgggcaactggatggacgccgagatcaacgtcaagagcgtgttccactgctacggcacgtgcaagaagtactcctacccctggcagagctccccctgccacaaggaggtggacttcgagttccagagctcctgggggtgcaacccgatcagctgccccggcatcaactccgggtgcaccgcctgcggcacctacgtggacaagctgaagaccatcgcgaaggcctaccggatcatcacggtcaagtacagccgcaaggtgtgctaccagatcgggaccaagaaggcctgcaagaccctcgagtccaacgactgcctggtgagcaacggcgtcaagatctgcgccatcggcaccatcagcacgctgcagaccgggatgaccctcgtgttcttcggccccctgaacgggggcgccctgctcatcaaggactggtgcatctccagctgcaagttcggggaccccggcgacatcatgcagatctccaacaacatcacgtgcccgagcttcgacggcaccatgcagcgggtgtgccgcttcgggctggagcccatgtgctcctacagcggcaacaagatctccggggtcaagcgggtgctggagaccaaggacagctacctctccgtgaacctgaccaagcccaagctggtcggcagcaccctcctgtggaactccctggacagctccatcaaggaccacatcaacatcgtggtgagcaacgacatcgacttcgaggacctcgcggagacgccgtgcaaggtcaccatcaagaacctgaagatcgagggggcctggggctccggcatcgggatcaagctgcactgcgaggtgagcctctccgagtgcagcgagtacctgaccaccatcaaggtgtgcgacaacgccatctgctacggcgggaacgtcgcccacctgtcccgcggcctcaacaccgtgatcatcaagggggccggcggccacagcgggagctccttcaagtgctgccacgagacgagctgctccgacatcggcttcaaggcggaggcgccccacctggcccggatcgtggacgacgggatcaccaccagcatgtcctacagcgacggcgcccccgaggccggcatcatctcctggatctacaaggtcgccgagtggatcaaggggatgttcaacggcaactggttcgtgctgatcatcatgatcctcttcctgatcatcagcatcgtgctgctcatcttcctgtgccccgtcaagaagtacaagtga

SEQ ID NO: 11778 - RNA, 3402 nt, synthetic construct
  misc_feature 1..3402: note = derived and/or modified CDS sequence (opt1) from LQUV(Longquan-Ra-5)__JX465398.1__GP
  source 1..3402: mol_type = other RNA
atgaagtccatcctgctcatcctgctgctcggccaggtgcgcagcaaggccaccaacgagatcaagctggagtgcccccacgaccagcgggtcgagaccgggttcagccacggcttcacggacctgtccccgatcctctacaccaaggggctgttcaccaagcacctggagaacaactgccccttcgacatcagcatcatcaaccgcctcgtgcgggacgtgcgcatctccacctggcaggccaagagcacgaacaccgacgcgaccgtcgcctccgccaccagcttcgagacgaaggacaccgacgacaagctggccggcgtgtgcgggttcttcgacgacatcaccaagcccaagcagggccagcggaaggccatcatctgctacgacctgtcctgcaaccagacccactgcctccccacgctgcacctgatcttcccgcagcagttctgccagagcctcaagcagtgctccatcaacgcgtacgaccacaagatcctgatcaccatcagcctgtccttctgccccgagggcctcatcatcgggggcaactgcatcgtgcccgtcctggcccagagccagctgctccacaaccacatgacctacaacatcaaggtgacctgcttcttcgagtactccatggcccgcgagagcctggacaacaagttcctggaggagatgaaccggctcgtgctggggcgcaactgcgagaagacggagtacctgggcgggtacgtctgcttcctcgccggctacggcaccgcgatccacgtgccctacgacaacacctacctgtccggggccgtggtcaacagcatgaaggccaacctgcacggcgaggaccacgaccggctcaagctgggggacacctccgccgtgatcgccggcaacctgaagttcgtgatcgacagcacggcgccggagaagtcctaccagggcgagtgcttcaccgggcacatgggctacaccagcctctacttctaccccgtccgcagcaaggggaagtacgtgaccatcctgacgaagggcgtgatccccgtcatcaacaagacgacctgcatgcccaagatcgtgccgctggtgtggaccgggatggtcgagatgcggggcatcgaggagaagctcgaggcctgcaccatgcactgcatcatggtgggcaacggggcgacctgcgaggccttctccgccaccggcatcttcgacatcaagagcaccacgtgccagatcgggaagacccacaagtaccgccggaccgaggaccagatcaccttcacgtgccaggacctgaacaaggacatcggcgtgatctgcaacggggagaacatcaccgtccccgtgaagtccctgatcgtcggccagtgcatctacaccatcaccagcatcttctccatcttccccgccaccgcccacagcatcgccacggagatgtgcgtgcagggcatccacgggtggctcaccatcatcatcttcttcaccttctgcttcggctggctgctgatccccatcctgacctgcctcatcatcaacacgatcgcctactccctgatcaccctcgcctacttcaagaacggggcgcgcctgggcaacctgatcaagcggatgaagtccgagttccagcgcaccatcgggaacaccacgtgcaacatctgcctccgggagtgcgagagcgagagcgagtacaagtcccacgaggagctgtgcaagaacggcagctgcccgtactgcatgaaggacatcggcgtgtcccaggtcctgctgaacgagcactacaacgcctgcatgctcatcgaccgctacgagaagcggctgacccacaccctgaaccagacgcccctctacagccgcaaggtgcggaagatccagtccttccgctaccgcaaccggtgcttcatcctgaccgtgtggatcaccctgctcaccgtcgagagcctgatctgggcctccagcgccgaggacatcaagcccgcccccaagtggcagaacaccgcgcacgggatcggcacgatcaagctgaacagcgactacgagctcgacttctccgtggtggccgggagcgagttcacccacaagcgcatgctgcagtccccggagagcggcaagaagaacatccccttcaccgtctacctgtccgagcagctcatcaccagcacggtgcagatcctgggcaactggatggacgccgagatcaacgtgaagtccgtcttccactgctacgggacctgcaagaagtacagctacccctggcagtccagcccctgccacaaggaggtggacttcgagttccagtccagctggggctgcaacccgatctcctgccccgggatcaacagcggctgcaccgcctgcgggacctacgtggacaagctgaagacgatcgcgaaggcctaccggatcatcaccgtcaagtactcccgcaaggtgtgctaccagatcggcaccaagaaggcctgcaagaccctcgagagcaacgactgcctggtgtccaacggcgtcaagatctgcgccatcgggacgatcagcaccctgcagaccggcatgaccctcgtgttcttcgggcccctgaacggcggggccctgctcatcaaggactggtgcatcagctcctgcaagttcggcgaccccggcgacatcatgcagatcagcaacaacatcacgtgcccgtccttcgacgggaccatgcagcgggtgtgccgcttcggcctggagcccatgtgcagctactccgggaacaagatcagcggcgtcaagcgggtgctggagaccaaggactcctacctcagcgtgaacctgaccaagcccaagctggtcgggtccacgctcctgtggaacagcctggactccagcatcaaggaccacatcaacatcgtggtgtccaacgacatcgacttcgaggacctcgcggagaccccgtgcaaggtcaccatcaagaacctgaagatcgagggcgcctggggcagcgggatcggcatcaagctgcactgcgaggtgtccctcagcgagtgctccgagtacctgaccaccatcaaggtgtgcgacaacgccatctgctacgggggcaacgtcgcccacctgagccgcgggctcaacacggtgatcatcaagggcgccggcgggcactccggcagcagcttcaagtgctgccacgagacctcctgcagcgacatcgggttcaaggcggaggcgccccacctggcccggatcgtggacgacggcatcaccacctccatgagctactccgacggcgcccccgaggccgggatcgtcagctggatctacaaggtggccgagtggatcaagggcatgttcaacgggaactggttcgtgctgatcatcatgatcctcttcctgatcatctccatcgtcctgctcatcttcctgtgccccgtgaagaagtacaagtga

SEQ ID NO: 11779 - RNA, 3402 nt, synthetic construct
  misc_feature 1..3402: note = derived and/or modified CDS sequence (opt1) from LQUV(Longquan-Ra-56)__JX465399.1__GP
  source 1..3402: mol_type = other RNA
atgaagtccatcctgctcatcctgctgctcggccaggtgcgcagcaaggccaccaacgagatcaagctggagtgcccccacgaccagcgggtcgagaccgggttcagccacggcttcacggacctgtccccgatcctctacaccaaggggctgttcaccaagcacctggagaacaactgccccttcgacatcagcatcatcaaccgcctcgtgcgggacgtgcgcatctccacctggcaggccaagagcacgaacaccgacgcgaccgtcgcctccgccaccagcttcgagacgaaggacaccgacgacaagctggccggcgtgtgcgggttcttcgacgacatcaccaagcccaagcagggccagcggaaggccatcatctgctacgacctgtcctgcaaccagacccactgcctccccacgctgcacctgatcttcccgcagcagttctgccagagcctcaagcagtgctccatcaacgcgtacgaccacaagatcctgatcaccatcagcctgtccttctgccccgagggcctcatcatcgggggcaactgcatcgtgcccgtcctggcccagagccagctgctccacaaccacatgacctacaacatcaaggtgacctgcttcttcgagtactccatggcccgcgagagcctggacaacaagttcctggaggagatgaaccggctcgtgctggggcgcaactgcgagaagacggagtacctgggcgggtacgtctgcttcctcgccggctacggcaccgcgatccacgtgccctacgacaacacctacctgtccggggccgtggtcaacagcatgaaggccaacctgcacggcgaggaccacgaccggctcaagctgggggacacctccgccgtgatcgccggcaacctgaagttcgtgatcgacagcacggcgccggagaagtcctaccagggcgagtgcttcaccgggcacatgggctacaccagcctctacttctaccccgtccgcagcaaggggaagtacgtgaccatcctgacgaagggcgtgatccccgtcatcaacaagacgacctgcatgcccaagatcgtgccgctggtgtggaccgggatggtcgagatgcggggcatcgaggagaagctcgaggcctgcaccatgcactgcatcatggtgggcaacggggcgacctgcgaggccttctccgccaccggcatcttcgacatcaagagcaccacgtgccagatcgggaagacccacaagtaccgccggaccgaggaccagatcaccttcacgtgccaggacctgaacaaggacatctccgtgatctgcaacggcgagaacatcaccgtccccgtcaagagcctgatcgtggggcagtgcatctacaccatctccagcatcttctccatcttccccgccaccgcccacagcatcgccaccgagatgtgcgtgcagtccatccacggctggctcacgatcatcatcttcttcaccttctgcttcggctggctgctgatccccatcctgacctgcctcatcatcaacaccatcgcctacagcctgatcacgctcgcctacttcaagaacggggcgcgcctgggcaacctgatcaagcggatgaagtccgagttccagcgcaccatcgggaacacgacctgcaacatctgcctccgggagtgcgagagcgagtccgagtacaagagccacgaggagctgtgcaagaacggctcctgcccgtactgcatgaaggacatcggggtgagccaggtcctgctgaacgagcactacaacgcctgcatgctcatcgaccgctacgagaagcggctgacccacaccctgaaccagacgcccctctactcccgcaaggtgcggaagatccagagcttccgctaccgcaaccggtgcttcatcctgaccgtgtggatcatcctgctcaccgtcgagagcctgatctgggcctccagcgccgaggacatcaagcccgcccccaagtggcagaacaccgcgcacggcatcggcaccatcaagctgaactccgactacgagctcgacttcagcgtggtggccgggtccgagttcacccacaagcgcatgctgcagagcccggagtccggcaagaagaacatccccttcacggtctacctgagcgagcagctcatcacctccaccgtgcagatcctggggaactggatggacgccgagatcaacgtcaagagcgtgttccactgctacgggacctgcaagaagtactcctacccctggcagagctccccctgccacaaggaggtggacttcgagttccagagctcctggggctgcaacccgatcagctgccccggcatcaactccggctgcacggcctgcgggacctacgtggacaagctgaagaccatcgcgaaggcctaccggatcatcaccgtcaagtacagccgcaaggtgtgctaccagatcggcacgaagaaggcctgcaagaccctcgagagcaacgactgcctggtgtccaacggggtcaagatctgcgccatcggcaccatcagcaccctgcagacgggcatgaccctcgtgttcttcgggcccctgaacggcggggccctgctcatcaaggactggtgcatctccagctgcaagttcggcgaccccggggacatcatgcagatctccaacaacatcacgtgcccgagcttcgacggcaccatgcagcgggtgtgccgcttcggcctggagcccatgtgctcctacagcgggaacaagatctccggcgtcaagcgggtgctggagaccaaggacagctacctctccgtgaacctgaccaagcccaagctggtcgggagcaccctcctgtggaactccctggacagctccatcaaggaccacatcaacatcgtggtgagcaacgacatcgacttcgaggacctcgcggagaccccgtgcaaggtcacgatcaagaacctgaagatcgagggcgcctgggggtccggcatcggcatcaagctgcactgcgaggtgagcctctccgagtgcagcaagtacctgaccaccatcaaggtgtgcgacaacgccatctgctacgggggcaacgtcgcccacctgagccgcgggctcaacaccgtgatcatcaagggcgccgggggccactccggcagctccttcaagtgctgccacgagaccagctgctccgacatcgggttcaaggcggaggcgccccacctggcccggatcgtggacgacggcatcacgaccagcatgtcctacagcgacggggcccccgaggccggcatcgtctcctggatctacaaggtggccgagtggatcaagggcatgttcaacgggaactggttcgtgctgatcatcatgatcctcttcctgatcatcagcatcgtcctgctcatcttcctgtgccccgtgaagaagtacaagtga

SEQ ID NO: 11780 - RNA, 3402 nt, synthetic construct
  misc_feature 1..3402: note = derived and/or modified CDS sequence (opt1) from LQUV(Longquan-Ra-90)__JX465400.1__GP
  source 1..3402: mol_type = other RNA
atgaagtccatcctgctcatcctgctgctcggccaggtgcgcagcaaggccaccaacgagatcaagctggagtgcccccacgaccagcgggtcgagaccgggttcagccacggcttcacggacctgtccccgatcctctacaccaaggggctgttcaccaagcacctggagaacaactgccccttcgacatcagcatcatcaaccgcctcgtgcgggacgtgcgcatctccacctggcaggccaagagcacgaacaccgacgcgaccgtcgcctccgccaccagcttcgagacgaaggacaccgacgacaagctggccggcgtgtgcgggttcttcgacgacatcaccaagcccaagcagggccagcggaaggccatcatctgctacgacctgtcctgcaaccagacccactgcctccccacgctgcacctgatcttcccgcagcagttctgccagagcctcaagcagtgctccatcaacgcgtacgaccacaagatcctgatcaccatcagcctgtccttctgccccgagggcctcatcatcgggggcaactgcatcgtgcccgtcctggcccagagccagctgctccacaaccacatgacctacaacatcaaggtgacctgcttcttcgagtactccatggcccgcgagagcctggacaacaagttcctggaggagatgaaccggctcgtgctggggcgcaactgcgagaagacggagtacctgggcgggtacgtctgcttcctcgccggctacggcaccgcgatccacgtgccctacgacaacacctacctgtccggggccgtggtcaacagcatgaaggccaacctgcacggcgaggaccacgaccggctcaagctgggggacacctccgccgtgatcgccggcaacctgaagttcgtgatcgacagcacggcgccggagaagtcctaccagggcgagtgcttcaccgggcacatgggctacaccagcctctacttctaccccgtccgcagcaaggggaagtacgtgaccatcctgacgaagggcgtgatccccgtcatcaacaagacgacctgcatgcccaagatcgtgccgctggtgtggaccgggatggtcgagatgcggggcatcgaggagaagctcgaggcctgcaccatgcactgcatcatggtgggcaacggggcgacctgcgaggccttctccgccaccggcatcttcgacatcaagagcaccacgtgccagatcgggaagacccacaagtaccgccggaccgaggaccagatcaccttcacgtgccaggacctgaacaaggacatctccgtgatctgcaacggcgagaacatcaccgtccccgtcaagagcctgatcgtggggcagtgcatctacaccatcacctccatcttcagcatcttccccgccaccgcccactccatcgccacggagatgtgcgtgcagggcatccacggctggctcaccatcatcatcttcttcaccttctgcttcgggtggctgctgatccccatcctgacctgcctcatcatcaacacgatcgcctacagcctgatcaccctcgcctacttcaagaacggcgcgcgcctggggaacctgatcaagcggatgaagtccgagttccagcgcaccatcggcaacaccacgtgcaacatctgcctccgggagtgcgagagcgagtccgagtacaagagccacgaggagctgtgcaagaacgggtcctgcccgtactgcatgaaggacatcggcgtgagccaggtcctgctgaacgagcactacaacgcctgcatgctcatcgaccgctacgagaagcggctgacccacaccctgaaccagacgcccctctactcccgcaaggtgcggaagatccagagcttccgctaccgcaaccggtgcttcatcctgaccgtgtggatcatcctgctcaccgtcgagtccctgatctgggccagcagcgccgaggacatcaagcccgcccccaagtggcagaacaccgcgcacggcatcgggaccatcaagctgaactccgactacgagctcgacttcagcgtggtggccggctccgagttcacgcacaagcgcatgctgcagagcccggagtccgggaagaagaacatccccttcaccgtctacctgagcgagcagctcatcacctccaccgtgcagatcctgggcaactggatggacgccgagatcaacgtcaagagcgtgttccactgctacggcacgtgcaagaagtactcctacccctggcagagctccccctgccacaaggaggtggacttcgagttccagagctcctgggggtgcaacccgatcagctgccccggcatcaactccgggtgcaccgcctgcggcacctacgtggacaagctgaagaccatcgcgaaggcctaccggatcatcacggtcaagtacagccgcaaggtgtgctaccagatcgggaccaagaaggcctgcaagaccctcgagtccaacgactgcctggtgagcaacggcgtcaagatctgcgccatcggcaccatcagcacgctgcagaccgggatgaccctcgtgttcttcggccccctgaacgggggcgccctgctcatcaaggactggtgcatctccagctgcaagttcggggaccccggcgacatcatgcagatctccaacaacatcacgtgcccgagcttcgacggcaccatgcagcgggtgtgccgcttcgggctggagcccatgtgctcctacagcggcaacaagatctccggggtcaagcgggtgctggagaccaaggacagctacctctccgtgaacctgaccaagcccaagctggtcggcagcaccctcctgtggaactccctggacagctccatcaaggaccacatcaacatcgtggtgagcaacgacatcgacttcgaggacctcgcggagacgccgtgcaaggtcaccatcaagaacctgaagatcgagggggcctggggctccggcatcgggatcaagctgcactgcgaggtgagcctctccgagtgcagcgagtacctgaccaccatcaaggtgtgcgacaacgccatctgctacggcgggaacgtcgcccacctgtcccgcggcctcaacaccgtgatcatcaagggggccggcggccacagcgggagctccttcaagtgctgccacgagacgagctgctccgacatcggcttcaaggcggaggcgccccacctggcccggatcgtggacgacgggatcaccaccagcatgtcctacagcgacggcgcccccgaggccggcatcgtctcctggatctacaaggtggccgagtggatcaaggggatgttcaacggcaactggttcgtgctgatcatcatgatcctcttcctgatcatcagcatcgtcctgctcatcttcctgtgccccgtgaagaagtacaagtga

SEQ ID NO: 11781 - RNA, 3423 nt, synthetic construct
  misc_feature 1..3423: note = derived and/or modified CDS sequence (opt1) from NYV(Rhode Island-1 (RI-1))__U36801.1__GP
  source 1..3423: mol_type = other RNA
atggtgggctgggtctgcatcttcctggtggtgctcgccaccaccacggccgggctgacccgcaacctgtacgagctcaagatcgagtgcccccacaccgtcggcctggggcagggctacgtgaccgggagcgtggagacgaccccgatcctgctcacccaggtcaccgacctgaagatcgagtccagctgcaacttcgacctgcacgtgccctccacgagcatccagaagtacaaccaggtggagtgggcgaagaagtccagcaccaccgagtccaccagcgccggcgccacgaccttcgaggccaagaccaaggaggtctccctcaaggggacctgcaacatccccgtgacgaccttcgaggccgcgtacaagagccggaagaccgtgatctgctacgacctggcctgcaaccagacctactgcctgcccacggtccacctcatcgccccggtgcagacctgcatgtccgtgcgcagctgcatgatcgggctgctgtccagccggatccaggtcatctacgagaagacctactgcgtgaccggccagctcgtggaggggctgtgcttcatccccacgcacaccatcgccctgacccagcccggccacacctacgacacgatgaccctccccatcacgtgcttcctggtcgcgaagaagctggggacccagctcaagatcgccgtggagctggagaagctgatcacggcctccggctgcaccgagaacagcttccagggctactacatctgcttcctcgggaagcactccgagccgctgagcgtgcccatgatggacgactaccgctccgccgagctgttcacccggatggtcctcaacccccgcggcgaggaccacgaccccgaccagaacgggcagggcctgatgcggatcgccggcccgatcaccgcgaaggtgcccagcacggagaccaccgagaccatgcaggggatcgccttcgccggcgcccccacctacagctccttcagcacgctggtgcgcaaggccgaccccgactacgtcttctccccggggatcatcgcggagagcaaccactccgtgtgcgacaagaaggccatccccctcacctggaccggcttcctggccgtcagcggggagatcgagaagatcaccggctgcacggtgttctgcaccctggtgggccccggggcctcctgcaaggcctacagcgagaccggcatcttcaacatctccagcccgacctgcctcgtcaacaaggtgcagaagttccgggggtccgagcagcgcatcaacttcatgtgccagcgggtggaccaggacgtcatcgtgtactgcaacggccagaagaaggtgatcctgacgaagaccctgatcatcgggcagtgcatctacaccttcaccagcctcttctccctgatccccggcgtcgcgcacagcctggccgtggagctctgcgtgcccggcctgcacgggtgggccacggccgccctgctcatcaccttctgcttcggctggctgctgatccccaccatcaccatgatcatcctcaagatcctgcgcctgctcacgttctcctgcagccactactccaccgagagcaagttcaaggcgatcctggagcgggtcaaggtggagtaccagaagaccatggggtccatggtgtgcgacgcctgccaccacgagtgcgagaccgccaaggagctggagacgcacaagaagtcctgccccgagggccagtgcccgtactgcatgaccatgaccgagagcaccgagagcgccctgctcgcgcacttcagcatctgcaagctgacgaaccgcttccaggagaacctgaagaagtccctcaagcggcccgaggtcaagcaggggcgctaccggaccctgggcgtgttccgctacaagagccggtgctacgtgggcctggtctggggcgtgctcctgaccaccgagctgatcgtgtgggccgcctccgccgacacgcccctcatggagagcggctggtccgacaccgcccacggggtcggcatcgtgcccatgaagaccgacctggagctggacttcgcgctcgccagctccagctcctacagctaccgccggaagctggtgaacccggccaacaaggaggagaccctgcccttccacttccagctcgacaagcaggtcgtgcacgccgagatccagaacctgggccactggatggacgggacgttcaacatcaagaccgccttccactgctacggcgagtgcaagaagtacgcgtacccctggcagaccgccaagtgcttcttcgagaaggactaccagtacgagacctcctgggggtgcaacccgcccgactgccccggcgtggggacgggctgcaccgcctgcggcgtctacctggacaagctccgcagcgggggcaaggcctacaagatcgtgtccctgaagttcacccgcaaggtgtgcatccagctggggaccgagcagacctgcaagcacatcgacgtcaacgactgcctcgtgacgcccagcgtgaaggtctgcctgatcggcaccatctccaagctgcagccgggggacaccctcctgttcctgggccccctcgagcagggcgggatcatcctgaagcagtggtgcaccacgagctgcgtgttcggcgaccccggggacatcatgagcaccaccaccggcatgaagtgccccgagcacacggggtccttccggaagatctgcggcttcgccaccaccccgacctgcgagtaccagggcaacacgatcagcgggttccagcgcatgatggcgacccgggactccttccagagcttcaacgtgaccgagccccacatcacctccaaccgcctggagtggatcgaccccgacagctccatcaaggaccacatcaacatggtcctcaaccgggacgtgagcttccaggacctgtccgacaacccctgcaaggtggacctgcacacgcagagcatcgacggcgcctgggggtccggcgtcgggttcaccctcgtgtgcaccgtgggcctgaccgagtgcgccaacttcatcacgagcatcaaggcctgcgactccgcgatgtgctacggcgccaccgtcaccaacctgctccgcgggagcaacaccgtgaaggtggtcggcaagggcgggcactccagctccctgttcaagtgctgccacgacacggactgcaccgaggagggcctggccgccagcccgccccacctcgaccgggtgaccgggtacaaccagatcgactccgacaaggtgtacgacgacggcgccccgccctgcaccatcaagtgctggttcaccaagagcggggagtggctgctgggcatcctcaacgggaactgggtcgtggtggcggtcctgatcgtgatcctgatcctcagcatcctgctgttctccttcttctgccccatccgcggccggaagaacaagagcaactga

SEQ ID NO: 11782 - RNA, 3423 nt, synthetic construct
  misc_feature 1..3423: note = derived and/or modified CDS sequence (opt1) from NYV(New York-1 (NY-1))__U36802.1__GP
  source 1..3423: mol_type = other RNA
atggtgggctgggtctgcatcagcctggtggtgctcgccaccaccacggccgggctgacccgcaacctgtacgagctcaagatcgagtgcccccacaccgtcggcctggggcagggctacgtgaccgggtccgtggagacgaccccgatcctgctcacccaggtcaccgacctgaagatcgagagctcctgcaacttcgacctgcacgtgcccagcacgtccatccagaagtacaaccaggtggagtgggcgaagaagtccagcaccaccgagagcacctccgccggcgccacgaccttcgaggccaagaccaaggaggtcagcctcaaggggacctgcaacatccccgtgacgaccttcgaggccgcgtacaagtcccggaagaccgtgatctgctacgacctggcctgcaaccagacccactgcctgcccacggtccacctcatcgccccggtgcagacctgcatgagcgtgcgctcctgcatgatcgggctgctgagctcccggatccaggtcatctacgagaagacctactgcgtgaccggccagctcgtggaggggctgtgcttcatccccacgcacaccatcgccctgacccagcccggccacacctacgacacgatgaccctccccatcacgtgcttcctggtcgcgaagaagctggggacccagctcaagatcgccgtggagctggagaagctgatcaccgccagcggctgcaccgagaactccttccagggctactacatctgcttcctcgggaagcacagcgagccgctgttcgtgcccatgatggacgactaccgctccgccgagctgttcacccggatggtcctcaacccccgcggcgaggaccacgaccccgaccagaacgggcagggcctgatgcggatcgccggcccgatcaccgcgaaggtgcccagcacggagaccaccgagaccatgcaggggatcgccttcgccggcgcccccatgtacagctccttcagcaccctggtgcgcaaggccgaccccgactacgtcttctccccggggatcatcgcggagagcaaccactccgtgtgcgacaagaagacgatccccctcacctggaccggcttcctggccgtcagcggggagatcgagaagatcaccggctgcacggtgttctgcaccctggtgggccccggggcctcctgcgaggcctacagcgagaccggcatcttcaacatctccagcccgacctgcctcgtcaacaaggtgcagaagttccgggggtccgagcagcgcatcaacttcatgtgccagcgggtggaccaggacgtcatcgtgtactgcaacggccagaagaaggtgatcctgacgaagaccctggtcatcgggcagtgcatctacaccttcaccagcctcttctccctgatccccggcgtggcccacagcctggcggtggagctctgcgtccccggcctgcacgggtgggccacgaccgccctgctcatcaccttctgcttcggctggctgctgatccccaccatcacgatgatcatcctcaagatcctgcgcctgctcaccttctcctgcagccactactccaccgagagcaagttcaaggccatcctggagcgggtgaaggtggagtaccagaagaccatggggtccatggtctgcgacgtgtgccaccacgagtgcgagacggccaaggagctggagacccacaagaagtcctgccccgagggccagtgcccgtactgcatgaccatgaccgagagcacggagagcgcgctgcaggcccacttcagcatctgcaagctcaccaaccgcttccaggagaacctgaagaagtccctgaagcggcccgaggtgaagcaggggtgctaccgcaccctcggcgtcttccggtacaagagccgctgctacgtgggcctggtgtggggcgtcctgctcaccacggagctgatcgtgtgggccgcctccgcggacacgcccctgatggagagcggctggtccgacaccgcccacggggtgggcatcgtccccatgaagaccgacctcgagctggacttcgccctggccagctccagctcctacagctaccggcgcaagctcgtgaacccggccaacaaggaggagaccctgcccttccacttccagctggacaagcaggtcgtgcacgcggagatccagaacctcggccactggatggacgggaccttcaacatcaagaccgccttccactgctacggcgagtgcaagaagtacgcctacccctggcagaccgccaagtgcttcttcgagaaggactaccagtacgagacgtcctgggggtgcaacccgcccgactgccccggcgtggggaccggctgcaccgcctgcggcgtgtacctggacaagctgcggagcgtcgggaaggcgtacaagatcgtgtccctcaagttcacccgcaaggtgtgcatccagctgggcaccgagcagacgtgcaagcacatcgacgtcaacgactgcctggtgacccccagcgtgaaggtctgcctcatcgggaccatctccaagctgcagccgggcgacaccctcctgttcctggggcccctggagcagggcggcatcatcctcaagcagtggtgcacgaccagctgcgtgttcggggaccccggcgacatcatgagcaccaccacggggatgaagtgccccgagcacaccggctccttccgcaagatctgcgggttcgccaccaccccgacgtgcgagtaccagggcaacaccatcagcggcttccagcggatgatggccacccgcgactccttccagagcttcaacgtgaccgagccccacatcacgtccaaccggctggagtggatcgaccccgacagctccatcaaggaccacatcaacatggtcctgaaccgcgacgtgagcttccaggacctctccgacaacccctgcaaggtggacctgcacacccagagcatcgacggggcctggggctccggggtcggcttcaccctggtgtgcaccgtggggctcacggagtgcgccaacttcatcaccagcatcaaggcgtgcgactccgccatgtgctacggcgccaccgtcaccaacctgctgcggggcagcaacacggtgaaggtggtcgggaagggcgggcactccggcagcctcttcaagtgctgccacgacaccgactgcaccgaggagggcctggccgcgtccccgccccacctggaccgcgtgaccgggtacaaccagatcgacagcgacaaggtgtacgacgacggcgccccgccctgcacgatcaagtgctggttcaccaagtccggggagtggctcctgggcatcctgaacgggaactgggtcgtggtcgccgtgctcatcgtgatcctgatcctgagcatcctcctgttcagcttcttctgccccatccggggccgcaagaacaagtccaactga

SEQ ID NO: 11783 - RNA, 3423 nt, synthetic construct
  misc_feature 1..3423: note = derived and/or modified CDS sequence (opt1) from NYV(New York-2 (NY-2))__U36803.1__GP
  source 1..3423: mol_type = other RNA
atggtgggcttcgtctgcatcttcctggtggtgctcgccaccaccacggccgggctgacccgcaacctgtacgagctcaagatcgagtgcccccacaccgtcggcctggggcagggctacgtgaccgggagcgtgggcacgaccccgatcctgctcacccaggtcaccgacctgaagatcgagtccagctgcaacttcgacctgcacgtgccctccacgagcatccagaagtacaaccaggtggagtgggcgaagaagtccagcaccaccgagtccaccagcgccggcgccacgaccttcgaggccaagaccaaggaggtctccctcaaggggacctgcaacatccccgtgacgaccttcgaggccgcgtacaagagccggaagaccgtgatctgctacgacctggcctgcaaccagacccactgcctgcccacggtccacctcatcgccccggtgcagacctgcatgtccgtgcgcagctgcatgatcggcctgctgtccagccggatccaggtcatctacgagaagacctactgcgtgaccgggcagctcgtggagggcctgtgcttcatccccacgcacaccatcgccctgacccagcccgggcacacctacgacacgatgaccctccccatcacgtgcttcctggtcgcgaagaagctgggcacccagctcaagatcgccgtggagctggagaagctgatcaccgccggcgggtgcaccgagaactccttccagggctactacatctgcttcctcgggaagcacagcgagccgctgttcgtgcccatgatggacgactaccgctccgccgagctgttcacccggatggtcctcaacccccgcggcgaggaccacgaccccgaccagaacggccaggggctgatgcggatcgccggcccgatcaccgcgaaggtgcccagcacggagaccaccgaggccatgcaggggatcgccttcgccggcgcccccatgtactccagcttcagcaccctggtgcgcaaggcggaccccgactacgtcttctccccggggatcatcgccgagagcaaccactccgtgtgcgacaagaagaccatccccctcacgtggaccggcttcctggccgtcagcggcgagatcgagaagatcaccgggtgcaccgtgttctgcacgctggtgggccccggggcctcctgcgaggcctacagcgagaccggcatcttcaacatctccagcccgacctgcctcgtcaacaaggtgcagaagttccgggggtccgagcagcgcatcaacttcatgtgccagcgggtggaccaggacgtcatcgtgtactgcaacggccagaagaaggtgatcctgaccaagacgctggtcatcggccagtgcatctacaccttcaccagcctcttctccctgatccccggggtggcgcacagcctggccgtggagctctgcgtccccggcctgcacgggtgggccaccacggccctgctcatcaccttctgcttcggctggctgctgatccccaccatcaccatgatcatcctcaagatcctgcgcctgctcacgttctcctgcagccactactccaccgagagcaagttcaaggccatcctggagcgggtgaaggtggagtaccagaagaccatggggtccatggtctgcgacgtgtgccaccacgagtgcgagaccgcgaaggagctggagacgcacaagaagtcctgccccgagggccagtgcccgtactgcatgaccatgaccgagagcaccgagagcgccctgcaggcccacttcagcatctgcaagctcacgaaccgcttccaggagaacctgaagaagtccctgaagcggcccgaggtgaagcagggctgctaccgcaccctcggggtcttccggtacaagagccgctgctacgtgggcctggtgtggggcgtcctgctcaccaccgagctgatcgtgtgggccgcgtccgccgacacgcccctgatggagagcgggtggtccgacaccgcccacggcgtggggatcgtccccatgaagaccgacctcgagctggacttcgccctggccagctccagctcctacagctaccggcgcaagctcgtggacccggcgaacaaggaggagaccctgcccttccacttccagctggacaagcaggtcgtgcacgccgagatccagaacctcggccactggatggacgggacgttcaacatcaagaccgccttccactgctacggcgagtgcaagaagtacgcctacccctggcagaccgccaagtgcttcttcgagaaggactaccagtacgagacctcctgggggtgcaacccgcccgactgccccggcgtgggcacggggtgcaccgcgtgcggcgtgtacctggacaagctgcggagcgtcgggaaggcctacaagatcgtgtccctcaagttcacccgcaaggtgtgcatccagctgggcaccgagcagacctgcaagcacatcgacgtcaacgactgcctggtgacgcccagcgtgaaggtctgcctcatcgggaccatctccaagctgcagccgggcgacaccctcctgttcctgggccccctggagcagggcgggatcatcctcaagcagtggtgcaccacgagctgcgtgttcggggaccccggcgacatcatgtccaccaccaccgggatgaagtgccccgagcacacgggcagcttccgcaagatctgcggcttcgccaccaccccgacctgcgagtaccaggggaacacgatcagcggcttccagcggatgatggccacccgcgactccttccagagcttcaacgtgaccgagccccacatcacctccaaccggctggagtggatcgaccccgacagctccatcaaggaccacatcaacatggtcctgaaccgcgacgtgagcttccaggacctctccgacaacccctgcaaggtggacctgcacacgcagagcatcgacggggcctggggctccggggtcggcttcaccctggtgtgcaccgtgggcctcaccgagtgcgcgaacttcatcacgagcatcaaggcctgcgactccgccatgtgctacggggccaccgtcaccaacctgctgcggggcagcaacaccgtgaaggtggtcgggaagggcggccactccgggagcctcttcaagtgctgccacgacacggactgcaccgaggagggcctggcggcctccccgccccacctggaccgcgtgaccgggtacaaccagatcgacagcgacaaggtgtacgacgacggcgccccgccctgcaccatcaagtgctggttcacgaagtccggggagtggctcctgggcatcctgaacggcaactgggtcgtggtcgccgtgctcatcgtgatcctgatcctgagcatcctcctgttctccttcttctgccccatccgggggcgcaagaacaagagcaactga

SEQ ID NO: 11784 - RNA, 3447 nt, synthetic construct
  misc_feature 1..3447: note = derived and/or modified CDS sequence (opt1) from PUUV(K27)__L08754.1__GP
  source 1..3447: mol_type = other RNA
atgggcgagctgagccccgtgtgcctctacctgctgctccaggggctgctgctctgcaacaccggcgccgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctga

SEQ ID NO: 11785 - RNA, 3447 nt, synthetic construct
  misc_feature 1..3447: note = derived and/or modified CDS sequence (opt1) from PUUV(13891)__U22418.1__GP
  source 1..3447: mol_type = other RNA
atgggcaagatcatccccgtgtgcctgtacctcctgttcctgtgcctcctgctgtggaaccgcggggacgcccggaacctcaacgagctgaagatggagtgcccgcacaccatcggcctggggcagggcctcgtcatcgggagcgtggagctgccgcccgtgcccctgacccaggtcgagtccctcaagctggagagctcctgcaacttcgacctgcacacgagcacctccagccagcagtccttcaccaagtggacctgggagatcaagaacgacctcgccgagaacacgcaggcgagctccaccagcttccagaccaagtccagcgagatcaacctgcgcggcctgtgcctcatcccgcccctggtgatcgagaccgccgcccggacgcgcaagaccatcgcctgcttcgacctgtcctgcaaccagaccgcctgccagcccaccgtgttcctcatcggccccatccagacgtgcatcaccaccaagagctgcctgctggggctcggcgaccagcggatccaggtcaactacgagaagacctactgcgtgtccgggcagctggtggagggcgtctgcttcaacccggtgcacacgatggcgctgagccagccctcccacacctacgacatcgtgaccgtcatggtgcgctgcttcctcatcgtgaagaaggtcagcaccggggactccatgaagctggagaagtccttcgagacgctggtgcagaagaccggctgcaccggcaacgggttccagggctactacgtgtgcctcgtcgggagcagcagcgagcccctgtacatccccaccctggacgactaccggtccgccgagatcctcagccgcatggccttcgccccgcacggcgaggaccacgacgtggagaagaacgcgatctccgccatgcggatcgtgggcaaggtcacggggaaggcccccagcaccgagtccagcgacaccatccagggcatcgccttctccgggaaccccctgtacaccagcacgggcgtgctgaccgccaaggacgaccccgtgtacatctgggcgccggggatcatcatggagggcaaccactccgtctgcgacaagaagaccctccccctgacctggacgggcttcatccccctgcccggggagatcgagaagaccacccagtgcaccgtgttctgcacgctcgccggcccgggggccgactgcgaggcctacagcgagaccggcatcttcaacatctccagcccgacctgcctgatcaaccgcgtccagcggttccgcggggccgagcagcagatcaagttcatctgccagcgggtggacatggacatcaccgtgtactgcaacggcctgaagaaggtcatcctcaccaagacgctggtgatcggccagtgcatctacaccttcacctccatcttcagcctgatccccggggtggcgcactccctcgccgtcgagctgtgcgtgcccggcctgcacgggtgggccaccatgctcctgctgctgacgttctgcttcggctggatcctcatccccttcttcagcatgatcctgctgaagatcctcatcgccttcgcctacctgtgctccaagtacaacaccgacagcaagttcaagatcctgatcgagaaggtgaagcgcgagtaccagaagaccatggggagcatggtctgcgaggtgtgccagtacgagtgcgagaccgcgaaggagctcgagtcccaccgcaagagctgccccatcggctcctgcccctactgcctgaaccccgccgaggccacgaccagcgccctgcaggcccacttcaaggtgtgcaagctcacctcccggttccaggacaacctgcgcaagagcctgggcgcgtacgagccgaagcaggggtgctaccggaccctctccctgttccggtaccgcagccggttcttcgtcggcttcaactggtgcctgctcctggtgctggagctcatcgtgtgggccgcctccgccgagacgcagagcctgaactccgggtggaccgacaccgcgcacggcagcggcatcatccccatgcgcaccgacctggagctcgacttctccctgcccagctccgccagctacacgtaccgccggcagctgcagaacccggccaacgagcaggagaagatccccttccacctccagatctccaagcaggtcatccacgccgagatccagcacctggggcactggatggacggcaccttcaacctgaagaccgccttccactgctacgggagctgcgagaagtacgcgtacccctggcagaccgccggctgcttcatcgagaaggactacgagtacgagagcgggtggggctgcaacccgcccgactgccccggcgtggggacgggctgcaccgcctgcggggtgtacctcgacaagctgaagtccgtcggcaaggccttcaagatcgtgagcctgcgctacacccggaaggcctgcatccagctcgggaccgagcagacgtgcaagtccgtggacagcaacgactgcctggtcaccacctccgtgaaggtgtgcctgatcggcaccgtcagcaagttccagccctccgacacgctcctgttcctgggccccctcgagcagggcgggctgatcttcaagcagtggtgcaccacgacctgccagttcggggaccccggcgacatcatgagcacccccgtggggatgaagtgccccgagctgtccggcagcttccgcaagaagtgcgcgttcgccaccacccccgtgtgccagttcgacggcaacaccctctccgggtacaagcggatgatcgccacgaaggacagcttccagtccttcaacgtcaccgagccgcacatcagcgcctccagcctggagtggatcgaccccgactccagcctgcgcgaccacatcaacgtgatcgtgggccgggacctctccttccaggacctgagcgagaccccctgccaggtcgacctggccaccaccagcatcgacggggcgtggggctccggggtgggcttcaacctcgtgtgcagcgtctccctgacggagtgcagcaccttcctgacctccatcaaggcctgcgacagcgccatgtgctacggctccaccacggccaacctcctgcgcgggcagaacaccgtgcacatcgtgggcaagggcgggcacagcggctccaagttcatgtgctgccacgacaccaagtgcagctccaccgggctggtcgcggccgcgccccacctcgaccgggtgacgggctacaaccaggccgacagcgacaagatcttcgacgacggggccccggagtgcggcatctcctgctggttcaccaagagcggggagtggatcctgggcgtgctgaacggcaactggatggtcgtggccgtgctcatcgccctgttcatcttctccatcttcctgttcaccctctgctgcccccgccggcccagctacgccaaggagcacaagccctga

SEQ ID NO: 11786 - RNA, 3447 nt, synthetic construct
  misc_feature 1..3447: note = derived and/or modified CDS sequence (opt1) from PUUV(CG17/Baskiria-2001)__AF442614.1__GP
  source 1..3447: mol_type = other RNA
atgggcgagctgagccccgtgtgcctctacctgctgctccaggggctgctgctctgcaacaccggcgccgcccgcaacctgaacgagctgaagatggagtgcccgcacaccatcgggctcggccaggggctggtcgtgggctccgtggagctgcccagcctccccatccagcaggtcgagacgctgaagctggagtccagctgcaacttcgacctccacacctccaccgccggccagcagagcttcaccaagtggacgtgggagatcaagggggacctggccgagaacacccaggcctccagcacctccttccagaccaagagctccgaggtgaacctgcggggcctctgcctgatccccacgctggtggtcgagaccgccgcccgcatgcggaagaccatcgcgtgctacgacctcagctgcaaccagaccgtgtgccagccgacggtgtacctgatggggcccatccagacctgcatcaccaccaagtcctgcctgctcagcctgggcgaccagcgcatccaggtcaactacgagaagacgtactgcgtgtccgggcagctggtggagggcatctgcttcaaccccatccacaccatggccctcagccagccctcccacacctacgacatcatgaccatgatggtccggtgcttcctggtgatcaagaaggtgacgagcggcgactccatgaagatcgagaagaacttcgagaccctggtccagaagaacgggtgcaccgccaacaacttccagggctactacatctgcctcatcgggagcagctccgagccgctgtacgtgcccgccctggacgactaccgcagcgcggaggtgctctcccggatggccttcgcgccccacggcgaggaccacgacatcgagaagaacgccgtcagcgccatgcgcatcgccggcaaggtgaccgggaaggccccctccacggagagctccgacaccgtgcagggcatcgccttcagcgggtccccgctgtacaccagcaccggcgtcctgacgtccaaggacgaccccgtgtacatctgggcccccgggatcatcatggagggcaaccacagcatctgcgagaagaagaccctccccctgacctggaccggcttcatctccctgccgggggagatcgagaagacgacccagtgcaccgtgttctgcaccctcgccggccccggggcggactgcgaggcctacagcgagacgggcatcttcaacatctccagcccgacctgcctgatcaaccgggtccagcgcttccgcggggccgagcagcagatcaagttcgtgtgccagcgggtcgacatggacatcaccgtgtactgcaacggcatgaagaaggtgatcctgaccaagaccctcgtcatcggccagtgcatctacacgttcacctccatcttcagcctgatccccggggtggcccactccctggccgtggagctctgcgtccccggcctgcacgggtgggcgaccatgctgctcctgctgaccttctgcttcggctgggtgctgatccccacgatcaccatgatcctcctgaagatcctgatcgccttcgcctacctctgcagcaagtacaacaccgacagcaagttccggatcctgatcgagaaggtgaagcgcgagtaccagaagaccatggggtccatggtctgcgaggtgtgccagtacgagtgcgagacggccaaggagctggagagccaccggaagtcctgcagcatcggctcctgcccctactgcctcaaccccagcgaggccaccacctccgcgctgcaggcccacttcaaggtgtgcaagctgaccagccgcttccaggagaacctccggaagtccctgacggtctacgagccgatgcagggctgctaccgcaccctgagcctcttccggtaccgctcccggttcttcgtggggctggtgtggtgcgtcctgctcgtgctggagctgatcgtgtgggccgccagcgcggagacccagaacctcaacgccggctggaccgacacggcccacgggtccggcatcatccccatgaagaccgacctggagctggacttcagcctcccctccagcgcctcctacacctaccgccgccagctgcagaaccccgccaacgagcaggagaagatcccgttccacctccagctcagcaagcaggtcatccacgcggagatccagcacctgggccactggatggacgccaccttcaacctgaagacggccttccactgctacgggagctgcgagaagtacgcctacccctggcagaccgccggctgcttcatcgagaaggactacgagtacgagaccgggtggggctgcaacccgcccgactgccccggggtgggcaccggctgcacggcgtgcggggtgtacctcgacaagctgaagtccgtcggcaaggtgttcaagatcgtgagcctgcggtacacccgcaaggtctgcatccagctcgggaccgagcagacctgcaagacggtggactccaacgactgcctgatcaccaccagcgtgaaggtctgcctgatcggcaccatctccaagttccagcccagcgacacgctcctgttcctggggcccctccagcagggcggcctgatcttcaagcagtggtgcaccacgacctgccagttcggggacccgggcgacatcatgtccacccccaccgggatgaagtgccccgagctgaacggcagcttccggaagaagtgcgccttcgccaccacccccgtgtgccagttcgacgggaacaccatctccggctacaagcgcatgatcgccacgaaggacagcttccagtccttcaacgtgaccgagccgcacatcagcacctccgccctcgagtggatcgaccccgacagctccctgcgggaccacatcaacgtcatcgtgagccgcgacctgtccttccaggacctcagcgagaccccctgccagatcgacctggcgacggcctccatcgacggcgcctgggggagcggcgtggggttcaacctggtctgcaccgtgagcctcaccgagtgctccgccttcctgaccagcatcaaggcgtgcgacgccgccatgtgctacggctccacgaccgccaacctggtgcgggggcagaacaccatccacatcgtcggcaagggcgggcacagcggctccaagttcatgtgctgccacgacaccaagtgcagctccacggggctcgtggccgcggcgccccacctggaccacgtgaccggctacaaccaggccgacagcgacaagatcttcgacgacggcgccccggagtgcgggatgtcctgctggttcaagaagtccggcgagtggatcctgggggtcctcaacggcaactggatggtggtggccgtcctggtggtgctgctcatcctgagcatcctgctgttcaccctgtgctgcccccgccggcccagctaccgcaaggagcacaagccctga

SEQ ID NO: 11787 - RNA, 3447 nt, synthetic construct
  misc_feature 1..3447: note = derived and/or modified CDS sequence (opt1) from PUUV(CG215/Omsk)__AF442615.1__GP
  source 1..3447: mol_type = other RNA
atgggcaagctgagccccgtgtgcctctacctgctgctccagtgcctgctgctcggggaccgcggcgacgcccggaacctgaacgagctgaagatggagtgcccgcacaccatcgggctcggccaggggctggtcgtgggctccgtggagctgccgcccgtccccatccagcaggtcgagagcctcaagctggagtccagctgcaacttcgacctgcacacctccacggccggccagcagagcttcaccaagtggacctgggagatcaagaacgacctcgcggagaacacccaggcctccagcacgtccttccagaccaagagctccgaggtgaacctgcgcgggctgtgcctcatccccaccctggtggtggagaccgccgcccggacgcgcaagaccatcgcctgctacgacctgacctgcaaccagaccgtgtgccagcccacggtctacctcatgggccccatccagacctgcgtgaccaccaagagctgcctgctggggctcggcgaccagcggatccaggtgaactacgagaagacgtactgcgtctccgggcagctggtggagggcgtgtgcttcaaccccatccacaccatggcgctgagccagccgtcccacacctacgacgtcatgaccctcatggtgcgctgcttcctgatcatcaagaaggtgacgagcggcgactccatgaagatcgagaagaacttcgagaccctggtccagaagaccgggtgcaccggcaacaacttccaggggtactacatctgcctcatcggcagctccagcgagcccctgtacgtgcccacgctggacgactaccggagcgccgaggtgctctcccgcatggccttcgcgccccacggcgaggaccacgacatcgagaagaacgccgtcagcaccatgcggatcgccgggaaggtgaccggccgcgccccgtccaccgaggccagcgacacggtgcaggggatcgccttctccggcagccccctgtacacctccaccggggtcctgaccgcgaaggacgaccccgtgtacatctgggcccccggcatcatcatggagggcaaccacagctcctgcgacaagaagacgctcccgctgacctggaccgggttcatcagcctgcccggcgagatcgagaagaccacgcagtgcaccgtcttctgcaccctcgccgggcccggcgccgactgcgaggcctactccgagaccgggatcttcaacatcagctccccgacctgcctgatcaaccgggtgcagcgcttccggggcgcggagcagcagatcaagttcgtgtgccagcgcgtcgacatggacatcatcgtgtactgcaacggcatcaagaaggtgatcctgacgaagaccctcgtcatcgggcagtgcatctacaccttcaccagcatcttctccctgatccccggcgtggcccacagcctggccgtggagctctgcgtccccgggctgcacggctggacgaccatgctgctcctgctgaccttctgcttcgggtgggtgctgatccccttcatcaccatgatcctcctgaagatcctgatcgccttcgcctacctctgctccaagtacaacacggacagcaagttccggatcctggtggagaaggtcaagaaggagtaccagaagaccatgggctccatggtgtgcgaggtgtgccagtacgagtgcgagaccgcgaaggagctggagagccaccgcaagagctgctccatcggcagctgcccctactgcctcaacccgtccgaggccaccacgagcgccctgcaggcccacttcaaggtctgcaagctgacctcccggttccaggagaacctccgcaagagcctgaccgtgtacgagcccatgcaggggtgctaccggaccctgtccctcttccgctaccggagcaagttcttcgtgggcctggtctggtgcctgctcctggtgatggagctgatcgtgtgggccgcgtccgccgagacgcagaacctcaacagcgggtggaccgacaccgcccacggctccggcatcatccccatgaagaccgacctggagctggacttcagcctcccctccagcgcctcctacacgtaccgccgccagctgcagaacccggcgaacgagcaggagaagatccccttccacctccagatcagcaagcaggtcatccacgccgagatccagcacctggggcactggatggacgccaccttcaacctgaagaccgccttccactgctacggctcctgcgagaagtacgcctacccctggcagaccgcggggtgcttcatcgagaaggactacgagtacgagacgggctgggggtgcaacccgcccgactgccccggcgtgggcaccgggtgcaccgcctgcggcgtgtacctggacaagctcaagagcgtcgggaaggtgttcaagatcgtgagcctgaagtacacccggaaggtctgcatccagctgggcacggagcagacctgcaagaccgtggactccaacgactgcctcatcaccacgagcgtgaaggtctgcatgatcgggaccatctccaagttccagcccagcgacaccctgctgttcctcggcccgctgcagcagggcgggctgatcttcaagcagtggtgcaccacgacctgccagttcggcgaccccggggacatcatgtccacccccaccggcatgaagtgccccgagctcaacgggagcttccgcaagaagtgcgccttcgccaccacgccggtgtgccagttcgacggcaacaccatctccggctacaagcggatgatcgccaccaaggacagcttccagtccttcaacgtgaccgagccccacatcagcgcgtccgccctggagtggatcgaccccgacagctccctgcgcgaccacatcaacgtcgtggtggggcgggacctcagcttccaggacctgtccgagacgccctgccaggtcgacctgatgaccagcaccatcgacggcgcctgggggtccggcgtggggttcaacctcgtgtgcaccgtcagcctgacggagtgctccccgttcctgaccagcatcaaggcctgcgacagcgccatgtgctacggctccaccaccgtgaacctcgtgcgcggccagaacacggtccacatcgtggggaagggcgggcacagcggctccaagttcatgtgctgccacgacaccaagtgcagctccaccggcctggtggcggccgcgccccacctggaccgggtcaccgggtacaaccaggccgacagcgacaagatcttcgacgacggcgcccccgagtgcgggatgtcctgctggttcaagaagtccggcgagtggatcctcggggtgctgaacggcaactggatggtggtcgccgtgctgatcgccctcctgatcctgagcatcctcatgttcacgctgtgctgcccccgccggccgagctaccgcaaggagcacaagccctga

SEQ ID NO: 11788 - RNA, 3447 nt, synthetic construct
  misc_feature 1..3447: note = derived and/or modified CDS sequence (opt1) from PUUV(CG222/Omsk)__AF442616.1__GP
  source 1..3447: mol_type = other RNA
atgggcaagctgagccccgtgtgcctctacctgctgctccagtgcctgctgctcggggaccgcggcgacgcccggaacctgaacgagctgaagatggagtgcccgcacaccatcgggctcggccaggggctggtcgtgggctccgtggagctgccgcccgtccccatccagcaggtcgagagcctcaagctggagtccagctgcaacttcgacctgcacacctccacggccggccagcagagcttcaccaagtggacctgggagatcaagaacgacctcgcggagaacacccaggcctccagcacgtccttccagaccaagagctccgaggtgaacctgcgcgggctgtgcctcatccccaccctggtggtggagaccgccgcccggacgcgcaagaccatcgcctgctacgacctgacctgcaaccagaccgtgtgccagcccacggtctacctcatgggccccatccagacctgcgtgaccaccaagagctgcctgctggggctcggcgaccagcggatccaggtgaactacgagaagacgtactgcgtctccgggcagctggtggagggcgtgtgcttcaaccccatccacaccatggcgctgagccagccgtcccacacctacgacgtcatgaccctcatggtgcgctgcttcctgatcatcaagaaggtgacgagcggcgactccatgaagatcgagaagaacttcgagaccctggtccagaagaccgggtgcaccggcaacaacttccaggggtactacatctgcctcatcggcagctccagcgagcccctgtacgtgcccacgctggacgactaccggagcgccgaggtgctctcccgcatggccttcgcgccccacggcgaggaccacgacatcgagaagaacgccgtcagcaccatgcggatcgccgggaaggtgaccggccgcgccccgtccaccgaggccagcgacacggtgcaggggatcgccttctccggcagccccctgtacacctccaccggggtcctgaccgcgaaggacgaccccgtgtacatctgggcccccggcatcatcatggagggcaaccacagctcctgcgacaagaagacgctcccgctgacctggaccgggttcatcagcctgcccggcgagatcgagaagaccacgcagtgcaccgtcttctgcaccctcgccgggccccgggccgactgcgaggcctactccgagaccggcatcttcaacatcagctccccgacctgcctgatcaaccgcgtgcagcggttccgcggggcggagcagcagatcaagttcgtgtgccagcgggtcgacatggacatcatcgtgtactgcaacggcatcaagaaggtgatcctgacgaagaccctcgtcatcggccagtgcatctacaccttcaccagcatcttctccctgatccccggggtggcccacagcctggccgtggagctctgcgtccccggcctgcacgggtggacgaccatgctgctcctgctgaccttctgcttcggctgggtgctgatccccttcatcaccatgatcctcctgaagatcctgatcgccttcgcctacctctgctccaagtacaacacggacagcaagttccgcatcctggtggagaaggtcaagaaggagtaccagaagaccatggggtccatggtgtgcgaggtgtgccagtacgagtgcgagaccgcgaaggagctggagagccaccgcaagagctgctccatcggcagctgcccctactgcctcaacccgtccgaggccaccacgagcgccctgcaggcccacttcaaggtctgcaagctgacctcccggttccaggagaacctccgcaagagcctgaccgtgtacgagcccatgcagggctgctaccggaccctgtccctcttccggtaccgcagcaagttcttcgtggggctggtctggtgcctgctcctggtgatggagctgatcgtgtgggccgcgtccgccgagacgcagaacctcaacagcggctggaccgacaccgcccacgggtccggcatcatccccatgaagaccgacctggagctggacttcagcctcccctccagcgcctcctacacgtaccgccggcagctgcagaacccggcgaacgagcaggagaagatccccttccacctccagatcagcaagcaggtcatccacgccgagatccagcacctgggccactggatggacgccaccttcaacctgaagaccgccttccactgctacgggtcctgcgagaagtacgcctacccctggcagaccgcgggctgcttcatcgagaaggactacgagtacgagacggggtggggctgcaacccgcccgactgccccggggtgggcaccggctgcaccgcctgcggggtgtacctggacaagctcaagagcgtcggcaaggtgttcaagatcgtgagcctgaagtacacccgcaaggtctgcatccagctggggacggagcagacctgcaagaccgtggactccaacgactgcctcatcaccacgagcgtgaaggtctgcatgatcggcaccatctccaagttccagcccagcgacaccctgctgttcctcgggccgctgcagcagggcggcctgatcttcaagcagtggtgcaccacgacctgccagttcggggaccccggcgacatcatgtccacccccaccgggatgaagtgccccgagctcaacggcagcttccggaagaagtgcgccttcgccaccacgccggtgtgccagttcgacgggaacaccatctccggctacaagcgcatgatcgccaccaaggacagcttccagtccttcaacgtgaccgagccccacatcagcgcgtccgccctggagtggatcgaccccgacagctccctgcgggaccacatcaacgtcgtggtgggccgcgacctcagcttccaggacctgtccgagacgccctgccaggtcgacctgatgaccagcaccatcgacggggcctggggctccggggtgggcttcaacctcgtgtgcaccgtcagcctgacggagtgctccgccttcctgaccagcatcaaggcctgcgacagcgcgatgtgctacgggtccaccaccgtgaacctcgtgcggggccagaacacggtccacatcgtgggcaagggcgggcacagcgggtccaagttcatgtgctgccacgacaccaagtgcagctccaccggcctggtggccgccgccccgcccctggaccgcgtcaccggctacaaccaggcggacagcgacaagatcttcgacgacggggcccccgagtgcggcatgtcctgctggttcaagaagtccggggagtggatcctcggcgtgctgaacgggaactggatggtggtcgccgtgctgatcgccctcctgatcctgagcatcctcatgttcacgctgtgctgcccccggcgcccgagctaccggaaggagcacaagccctga

SEQ ID NO: 11789 - RNA, 3447 nt, synthetic construct
  misc_feature 1..3447: note = derived and/or modified CDS sequence (opt1) from PUUV(CRF161)__AF367061.1__GP
  source 1..3447: mol_type = other RNA
atgggcaagctgagccccgtgtgcctctacctgctgctccagtgcctgctgctcggggaccgcggcgacgcccggaacctgaacgagctgaagatggagtgcccgcacaccatcgggctcggccaggggctggtcgtgggctccgtggagctgccgcccgtccccatccagcaggtcgagagcctcaagctggagtccagctgcaacttcgacctgcacacctccacggccggccagcagagcttcaccaagtggacctgggagatcaagaacgacctcgtggagaacacccaggcgtccagcacgtccttccagaccaagagctccgaggtgaacctgcgcgggctgtgcctcatccccaccctggtggtggagaccgccgcccggacgcgcaagaccatcgcctgctacgacctgacctgcaaccagaccgtctgccagcccacggtgtacctcatgggccccatccagacctgcatcaccaccaagagctgcctgctggggctcggcgaccagcggatccaggtgaactacgagaagacgtactgcgtctccgggcagctggtggagggcgtgtgcttcaaccccatccacaccatggccctgagccagccgtcccacacctacgacgtcatgaccctcatggtgcgctgcttcctgatcatcaagaaggtgacgagcggcgactccatgaagatcgagaagaacttcgagaccctggtccagaagaccgggtgcaccggcaacaacttccaggggtactacatctgcctcatcggcagctccagcgagcccctgtacgtgcccacgctggacgactaccggagcgcggaggtgctctcccgcatggccttcgcgccccacggcgaggaccacgacatcgagaagaacgccgtcagcaccatgcggatcgccgggaaggtggccggccgcgccccgtccaccgaggccagcgacaccgtgcaggggatcgccttctccggcagccccctgtacacgtccaccggggtcctgaccgcgaaggacgaccccgtgtacatctgggcccccggcatcatcatggagggcaaccacagctcctgcgacaagaagaccctcccgctgacgtggaccgggttcatcagcctgcccggcgagatccagaagaccacccagtgcacggtcttctgcaccctcgccgggccccgggccgactgccaggcctactccgagaccggcatcttcaacatcagctccccgacctgcctgatcaaccgcgtgcagcggttccgcggggcggagcagcagatcaagttcgtgtgccagcgggtcgacatggacatcatcgtgtactgcaacggcatcaagaaggtgatcctgaccaagacgctcgtcatcggccagtgcatctacaccttcaccagcatcttctccctgatccccggggtggcccacagcctggccgtggagctctgcgtccccggcctgcacgggtggaccacgatgctgctcctgctgaccttctgcttcggctgggtgctgatccccttcatcaccatgatcctcctgaagatcctgatcgccttcgcctacctctgctccaagtacaacaccgacagcaagttccgcatcctggtggagaaggtcaagaaggagtaccagaagacgatggggtccatggtgtgcgaggtgtgccagtacgagtgcgagaccgcgaaggagctggagagccaccgcaagagctgctccatcggcagctgcccctactgcctcaacccgtccgaggccaccaccagcgccctgcaggcccacttcaaggtctgcaagctgacgtcccggttccaggagaacctccgcaagagcctgaccgtgtacgagcccatgcagggctgctaccggaccctgtccctcttccggtaccgcagcaagttcttcgtggggctggtctggtgcctgctcctggtgatggagctgatcgtgtgggccgcgtccgccgagacccagaacctcaacagcggctggacggacaccgcccacgggtccggcatcatccccatgaagaccgacctggagctggacttcagcctcccctccagcgcctcctacacctaccgccggcagctgcagaacccggcgaacgagcaggagaagatccccttccacctccagatcagcaagcaggtcatccacgccgagatccagcacctgggccactggatggacgccacgttcaacctgaagaccgccttccactgctacgggtcctgcgagaagtacgcctacccctggcagaccgcgggctgcttcatcgagaaggactacgagtacgagaccgggtggggctgcaacccgcccgactgccccggggtgggcacgggctgcaccgcctgcggggtgtacctggacaagctcaagagcgtcggcaaggtgttcaagatcgtgagcctgaagtacacccgcaaggtctgcatccagctggggaccgagcagacgtgcaagaccgtggactccaacgactgcctcatcaccaccagcgtgaaggtctgcatgatcggcacgatctccaagttccagcccagcgacaccctgctgatcctcgggccgctgcagcagggcggcctgatcttcaagcagtggtgcaccaccacgtgccagttcggggaccccggcgacatcatgtccacccccaccgggatgaagtgccccgagctcaacggcagcttccggaagaagtgcgccttcgccaccaccccggtgtgccagttcgacgggaacacgatctccggctacaagcgcatgatcgccaccaaggacagcttccagtccttcaacgtgaccgagccccacatcagcgcgtccgccctggagtggatcgaccccgacagctccctgcgggaccacatcaacgtcgtggtgggccgcgacctcagcttccaggacctgtccgagaccccctgccaggtcgacctgatgacgagcaccatcgacggggcctggggctccggggtgggcttcaacctcgtgtgcaccgtcagcctgaccgagtgctccgccttcctgacgagcatcaaggcctgcgacagcgcgatgtgctacgggtccaccaccgccaacctcgtgaagggccagaacaccgtgcacatggtcggcaagggcgggcacagcgggtccaagttcatgtgctgccacgacacgaagtgcagctccaccggcctggtggccgccgcgccgcacctggaccgggtgaccggctacaaccaggccgacagcgacaagatcttcgacgacggggcccccgagtgcggcatgtcctgctggttcaagaagtccggggagtggatcctcggcgtcctgaacgggaactggatggtggtggccgtcctgatcgccctcctgatcctgagcatcctcatgttcaccctgtgctgcccccgccggcccagctaccgcaaggagcacaagccgtga

SEQ ID NO: 11790 - RNA, 3447 nt, synthetic construct
  misc_feature 1..3447: note = derived and/or modified CDS sequence (opt1) from PUUV(CRF308/Omsk)__AF442617.1__GP
  source 1..3447: mol_type = other RNA
atgggcaagctgagccccgtgtgcctctacctgctgctccagtgcctgctgctcggggaccgcggcgacgcccggaacctgaacgagctgaagatggagtgcccgcacaccatcgggctcggccaggggctggtcgtgggctccgtggagctgccgcccgtccccatccagcaggtcgagagcctcaagctggagtccagctgcaacttcgacctgcacacctccacggccggccagcagagcttcaccaagtggacctgggagatcaagaacgacctcgcggagaacacccaggcctccagcacgtccttccagaccaagagctccgaggtgaacctgcgcgggctgtgcctcatccccaccctggtggtggagaccgccgcccggacgcgcaagaccatcgcctgctacgacctgacctgcaaccagaccgtgtgccagcccacggtctacctcatgggccccatccagacctgcatcaccaccaagagctgcctgctggggctcggcgaccagcggatccaggtgaactacgagaagacgtactgcgtgtccgggcagctggtcgagggcgtgtgcttcaaccccatccacaccatggcgctgagccagccgtcccacacctacgacgtgatgaccctcatggtccgctgcttcctgatcatcaagaaggtgacgagcggcgactccatgaagatcgagaagaacttcgagaccctggtgcagaagaccgggtgcaccggcaacaacttccaggggtactacatctgcctcatcggcagctccagcgagcccctgtacgtccccacgctggacgactaccggagcgccgaggtgctctcccgcatggccttcgcgccccacggcgaggaccacgacatcgagaagaacgccgtgagcaccatgcggatcgccgggaaggtcgccggccgcgccccgtccaccgaggccagcgacaccgtgcaggggatcgcgttctccggcagccccctgtacacgtccaccggggtgctgaccgccaaggacgaccccgtctacatctgggcccccggcatcatcatggagggcaaccacagctcctgcgacaagaagaccctcccgctgacgtggaccgggttcatcagcctgcccggcgagatcgagaagaccacccagtgcacggtgttctgcaccctcgccgggcccggcgccgactgcgaggcgtactccgagaccgggatcttcaacatcagctccccgacctgcctgatcaaccgggtccagcgcttccggggcgccgagcagcagatcaagttcgtgtgccagcgcgtggacatggacatcatcgtctactgcaacggcatcaagaaggtgatcctgaccaagacgctcgtgatcgggcagtgcatctacaccttcaccagcatcttctccctgatccccggcatcgcccacagcctggccgtcgagctctgcgtgcccgggctgcacggctggaccacgatgctgctcctgctgaccttctgcttcgggtgggtgctgatccccttcatcaccatgatcctcctgaagatcctgatcgccttcgcgtacctctgctccaagtacaacaccgacagcaagttccggatcctggtcgagaaggtgaagaaggagtaccagaagacgatgggctccatggtgtgcgaggtctgccagtacgagtgcgagaccgccaaggagctggagagccaccgcaagagctgctccatcggcagctgcccctactgcctcaacccgtccgaggccaccaccagcgccctgcaggcccacttcaaggtgtgcaagctgacgtcccggttccaggagaacctccgcaagagcctgaccgtgtacgagcccatgcaggggtgctaccggaccctgtccctcttccgctaccggagcaagttcttcgtcggcctggtgtggtgcctgctcctggtgatggagctgatcgtctgggcggcctccgccgagacccagaacctcaacagcgggtggacggacaccgcccacggctccggcatcatccccatgaagaccgacctggagctggacttcagcctcccctccagcgcgtcctacacctaccgccgccagctgcagaacccggccaacgagcaggagaagatccccttccacctccagatcagcaagcaggtcatccacgccgagatccagcacctggggcactggatggacgccacgttcaacctgaagaccgccttccactgctacggctcctgcgagaagtacgcgtacccctggcagaccgccgggtgcttcatcgagaaggactacgagtacgagaccggctgggggtgcaacccgcccgactgccccggcgtgggcacggggtgcaccgcctgcggcgtgtacctggacaagctcaagagcgtggggaaggtgttcaagatcgtcagcctgaagtacacccggaaggtgtgcatccagctgggcaccgagcagacgtgcaagaccgtggactccaacgactgcctcatcaccaccagcgtcaaggtgtgcatgatcgggacgatctccaagttccagcccagcgacaccctgctgttcctcggcccgctgcagcagggcgggctgatcttcaagcagtggtgcaccaccacgtgccagttcggcgaccccggggacatcatgtccacccccaccggcatgaagtgccccgagctcaacgggagcttccgcaagaagtgcgccttcgccaccaccccggtgtgccagttcgacggcaacacgatctccggctacaagcggatgatcgcgaccaaggacagcttccagtccttcaacgtcaccgagccccacatcagcgcctccgccctggagtggatcgaccccgacagctccctgcgcgaccacatcaacgtggtggtcgggcgggacctcagcttccaggacctgtccgagaccccctgccaggtggacctgatgacgagcaccatcgacggcgcctgggggtccggcgtggggttcaacctcgtctgcaccgtgagcctgaccgagtgctccgccttcctgacgagcatcaaggcgtgcgacagcgccatgtgctacggctccaccaccgccaacctcgtgcgcggccagaacaccgtccacatcgtggggaagggcgggcacagcggctccaagttcatgtgctgccacgacacgaagtgcagctccaccggcctggtggccgcggccccgcacctggaccgggtcaccgggtacaaccaggccgacagcgacaagatcttcgacgacggcgcccccgagtgcgggatgtcctgctggttcaagaagtccggcgagtggatcctcggggtgctgaacggcaactggatggtggtcgccgtgctgatcgcgctcctgatcctgagcatcctcatgttcaccctgtgctgcccccgccggcccagctaccgcaaggagcacaagccgtga

SEQ ID NO: 11791 - RNA, 3447 nt, synthetic construct
  misc_feature 1..3447: note = derived and/or modified CDS sequence (opt1) from PUUV(Mu/07/1219)__KJ994777.1__GP
  source 1..3447: mol_type = other RNA
atggagaagatcatccccgtgtgcctgtacctcccgttcctgtgcctgctcctgtggagccgcggcgacacccggaacctgaacgagctcaagatggagtgcccccacaccatcgggctgggccaggggctggtcatcggctccatcgagctcccgcccgtgcccctgatccaggtggagagcctgaagctcgagtccagctgcaacttcgacctgcacacgtccaccagctcccagcaggccttcaccaagtggacctgggaggtcaagagcgacctggccgagaacacgcaggcgtccagcacctccttccagaccaagagctccgaggtgaacctccgcgggctgtgcctggtgccgcccctcgtcatcgagaccgccgcccggacgcgcaagaccatcgcctgcttcgacctgagctgcaaccagacgacctgccagcccaccgtgttcctgatgggccccatccagacctgcatcaccaccaagtcctgcctcctgggcctgggggaccagcggatccaggtgaactacgagaagacgtactgcgtcagcggccagctcatcgaggggatctgcttcaaccccgtgcacaccatggccctgtcccagcccagccacacctacgacatcgtgaccgtcatggtgcgctgcttcctgatcgtgaagaaggtcacgaccggcgactccatgaagatcgagaagtccttcgagaccctcgtgcagaagaccgggtgcacggacaacggcttccagggctactacgtgtgcctgatcgggagcagcagcgagcccctgtacatcccgaccctcgacgactaccggtccgcggaggtcctgagccgcatggccttcgcgccccacggcgaggaccacgacatcgagaagaacgccatctccgccatgcggatcgtggggaaggtgaccggcaaggcccccagcaccgagtccagcgacacggtccagggcatcgccttctccgggaaccccctgtacaccagcaccggcgtgctcaccgccaaggacgacccggtgtacgtctgggcccccgggatcatgatggagggcaaccactccgtgtgcgagaagaagacgctgcccctgacctggaccgggttcatccccctcccgggcgagatcgagaagaccacgcagtgcaccgtcttctgcaccctggcgggccccggggccgactgcgaggcctacagcgagaccggcatcttcaacatctccagcccgacctgcctgatcaaccgcgtgcagcggttccgcggggccgagcagcagatcaagttcatctgccagcgggtggacatggacatcacggtctactgcaacggcctcaagaaggtgatcctgaccaagaccctggtgatcgggcagtgcatctacaccttcacgtccatcttcagcctcatccccggcgtcgcccactccctggcggtggagctgtgcgtgcccggcctccacgggtgggccaccatgctgctgctcctgaccttctgcttcggctggatcctgatccccttcttcgccatgatcctgctcaaggtcctgatcgccctggcctacctctgcagcaagtacaacaccgactccaagttcaaggtgctgatcgagaaggtgaagaaggagtaccagaagacgatggggagcatggtctgcgaggtgtgccagtacgagtgcgagaccgcgaaggagctggagagccaccgcaagtcctgccccatgggcagctgcccctactgcctcaacccggccgaggccaccacctccgccctgcaggcccacttcaaggtgtgcaagctgacgagccggttccaggacaacctccgcaagtccctgggggcgtacgagcccaagcagggctgctaccggaccctgagcctcttccgctaccggtcccgcttcttcgtcggcttcatctggtgcctgctgctcgtgctggagctgatcgtgtgggccgccagcgccgagacccagaacctcaactccgggtggaccgacacggcgcacggcagcggggtcatccccatgcggaccgacctggagctggacttctccctcccgagctccgccagctacacctaccgccgccagctgcagaaccccgccaacgagcaggagaagatccccttccacctccagatctccaagcaggtcatccacgccgagatccagcacctcggccactggatggacggcaccttcaacctgaagacggccttccactgctacgggagctgcgagaagtacgcgtacccctggcagaccgccggctgcttcgtggagaaggactacgagtacgagtccgggtggggctgcaacccggccgactgccccggggtgggcaccggctgcaccgcctgcggggtgtacctggacaagctcaagagcgtgggcaaggccttcaagatcgtcagcctgcggtacacgcgcaaggcgtgcatccagctggggaccgagcagacctgcaagaacgtggactccaacgactgcctcgtgaccacgagcgtcaaggtgtgcctgatcggcaccgtgtccaagttccagcccagcgacaccctgctgttcctggggcccctggagcagggcggcctcatcttcaagcagtggtgcaccacgacctgccagttcggggacccgggcgacatcatgtccacccccgtcgggatgaagtgccccgagctgagcggctccttccggaagaagtgcgccttcgccaccacgcccgtgtgccagttcgacgggaacaccatcagcggctacaagcgcatgatcgccaccaaggactccttccagagcttcaacgtgaccgagccgcacatctccgccagctccctggagtggatcgaccccgacagctccctccgggaccacatcaacgtcatcgtgggccgcgacctgagcttccaggacctgtccgagaccccctgccaggtggacctcacgaccaccagcatcgacggggcgtggggctccggggtcggcttcaacctgatctgcagcgtgagcctgaccgagtgctccacgttcctcaccagcatcaaggcctgcgactccgccatgtgctacgggagcaccaccgccaacctggtgcggggccagaacacggtccacatcgtgggcaagggcgggcactccgggagcaagttcatgtgctgccacgacaccaagtgctccagcaccggcctggtggcggccgcgccccacctcgaccgcgtcaccggctacaaccaggccgactccgacaagatcttcgacgacggggccccggagtgcggcatcagctgctggttcacgaagtccggggagtggatcctgggcgtgctgaacgggaactggatggtggtcgccgtgctcgtggccctgttcatcctgagcatcttcctcttcaccctgtgctgcccccggcgcccctcctacgccaaggagcacaagccctga

SEQ ID NO: 11792 - RNA, 3447 nt, synthetic construct
  misc_feature 1..3447: note = derived and/or modified CDS sequence (opt1) from PUUV(Puu/Kazan)__Z84205.1__GP
  source 1..3447: mol_type = other RNA
atgggcaagctgagccccgtgtgcctctacctgctgctccaggggctgctgctgttcaacaccggcaccgcccgcaacctgaacgagctgaagatggagtgcccgcacacgatcgggctcggccaggggctggtcgtgggctccgtggagctgccgcccgtccccatccagcaggtcgagaccctcaagctggagagctcctgcaacttcgacctgcacaccagcaccgccggccagcaggcgttcacgaagtggacctgggagatcaagggggacctcgccgagaacacccaggcctccagcacctccttccagacgaagtcctccgaggtgaacctgcggggcctgtgcctcatccccaccctggtgatcgagaccgccgcccgcatgcggaagaccatcgcgtgctacgacctgagctgcaaccagacggtgtgccagcccaccgtgtacctcatggggcccatccagacctgcatcaccacgaagtcctgcctgctgggcctcggggaccagcgcatccaggtcaactacgagaagacctactgcgtgagcggccagctggtggagggcgtctgcttcaaccccatccacaccatggccctgtcccagccgagccacacctacgacatcgtgacgatgatggtgcggtgcttcctcgtcatcaagaaggtgacctccggggacagcatgaagatcgagaagaacttcgagaccctggtgcagaagaacggctgcaccgccaactccttccaggggtactacatctgcctgatcggcagctccagcgagcccctctacgtccccacgctggacgactaccgcagcgccgaggtgctgtcccggatggcgttcgcgccccacggcgaggaccacgacgtggagaagaacgccatcagcgccctccgcatcgccgggaaggtcaccggcaaggccccgtccaccgagagctccgacaccgtgcagggggtggccttcagcggcagccccctgtacacgagcaccggggtcctgaccgccaaggacgaccccgtgtacatctgggcccccggcatcatcatggagggcaaccactccgtctgcgagaagaagaccctcccgctgacgtggaccgggttcatcagcctgcccggcgagatcgagaagaccacccagtgcacggtgttctgcaccctcgccgggcccggcgcggactgcgaggcctactccgagaccgggatcttcaacatcagctccccgacctgcctgatcaaccgggtgcagcgcttccggggcgccgagcagcagatcaagttcgtctgccagcgcgtggacatggacatcaccgtgtactgcaacggcgtcaagaaggtgatcctgacgaagaccctcgtgatcgggcagtgcatctacaccttcaccagcatcttctccctgatccccggcgtcgcccacagcctggccgtggagctctgcgtgcccgggctgcacggctgggcgacgatgctgctcctgctgaccttctgcttcgggtgggtcctgatccccaccatcaccatgatcctcctgaagatcctgatcgccttcgcctacctctgctccaagtacaacacggacagcaagttccggatcctgatcgagaaggtgaagaaggagtaccagaagaccatgggctccatggtgtgcgaggtctgccagtacgagtgcgagaccgccaaggagctggagagccaccgcaagagctgctccatcggcagctgcccctactgcctcaacccgtccgaggccaccacgagcgcgctgcaggcccacttcaaggtgtgcaagctgacctcccggatccaggagaacctccgcaagagcctgaccgtgtacgagcccatgcaggggtgctaccggaccctgtccctcttccgctaccggagccgcttcttcgtcggcctggtgtggtgcgtgctgctcgtcctggagctgatcgtgtgggccgcctccgcggagacgcagaacctcaacgccgggtggaccgacaccgcccacggcagcggcatcatccccatgaagaccgacctggagctggacttctccctccccagctccgccagctacacgtaccggcgccagctgcagaacccggccaacgagcaggagaacatccccttccacctccagatctccaagcaggtcatccacgcggagatccagcacctcgggcactggatggacgccaccttcaacctgaagaccgccttccactgctacggcagctgcgagaagtacgcctacccctggcagaccgccgggtgcttcgtggagaaggactacgagtacgagacgggctgggggtgcaacccgcccgactgccccggcgtgggcaccgggtgcaccgcgtgcggcgcctacctggacaagctcaagtccgtggggaaggtcttcaagatcgtgagcctgcgctacacccggaaggtgtgcatccagctgggcacggagcagacctgcaagaccgtcgacagcaacgactgcctcatcaccacgtccgtgaaggtgtgcctgatcgggaccatcagcaagttccagccctccgacaccctcctgttcctgggcccgctgcagcagggcgggctcatcttcaagcagtggtgcaccacgacctgccagttcggcgaccccggggacatcatgagcacccccaccggcatgaagtgccccgacctgaacgggtccttccgcaagaagtgcgccttcgccaccacgccggtctgccagttcgacggcaacaccatcagcggctacaagcggatgatcgccaccaaggactccttccagagcttcaacgtgaccgagccccacatctccgcgagcgccctggagtggatcgaccccgactccagcctccgcgaccacatcaacgtgatcgtctcccgggacctgagcttccaggacctgtccgagacgccctgccagatcgacctcagcaccgcctccatcgacggggcctggggcagcggggtgggcttcaacctggtgtgcaccgtctccctgaccgagtgcagcgcgttcctcacgagcatcaaggcctgcgacgccgccatgtgctacgggtccaccaccgccaacctggtgcgcggccagaacaccatccacatcgtgggcaagggcgggcacagcgggtccaagttcatgtgctgccacgacacgaagtgcagcaccaccggcctggtcgcggccgccccgcacctcgaccgggtgaccggctacaaccaggccgactccgacaagatcttcgacgacggggcccccgagtgcggcatgagctgctggttcaagaagtccggggagtggatcctgggcgtgctgaacgggaactggatggtcgtggcggtgctcatcgccctgctgatcctcagcatcctgctgttcacgctctgctgcccccgccggccctcctaccgcaaggagcacaagccgtga

SEQ ID NO: 11793 - RNA, 3447 nt, synthetic construct
  misc_feature 1..3447: note = derived and/or modified CDS sequence (opt1) from PUUV(PUUV/Ardennes/Mg156/2011)__KT247603.1__GP
  source 1..3447: mol_type = other RNA
atgggcaagatcatccccgtgtgcctgtacctcctgttcctgtgcctcctgctgtgggaccgcggggacacccggaacctcaacgagctgaagatggagtgcccgcacaccatcggcctggggcagggcctcgtcatcgggagcgtggagctgccgcccgtgcccctgacgcaggtcgagtccctcaagctggagagctcctgcaacttcgacctgcacaccagcacctccagccagcagtccttcaccaagtggacgtgggagatgaaggtggacctcgccgagaacacccaggccagctccaccagcttccagaccaagtccagcgagatcaacctgcgcggcctgtgcctcgtgccgcccctggtcatcgagacggcggcccggacccgcaagaccatcgcctgcttcgacctgtcctgcaaccagaccgcctgccagcccacggtgttcctcatcggccccatccagacctgcatcaccaccaagagctgcctgctggggctcggcgaccagcggatccaggtgaactacgagaagacgtactgcgtctccgggcagctggtggagggcatctgcttcaaccccgtgcacaccatggccctgagccagccctcccacacctacgacatcgtcaccgtgatggtgcgctgcttcctcatcgtcaagaaggtgagcacgggggactccatgaagctggagaagtccttcgagaccctggtgcagaagaccggctgcaccggcaacgggttccagggctactacgtctgcctcatcgggagcagcagcgagcccctgtacatccccacgctggacgactaccggtccgcggaggtgctcagccgcatggccttcgccccgcacggcgaggaccacgacatcgagaagaacgccatctccgcgatgcggatcgtgggcaaggtcaccgggaaggcccccagcaccgagtccagcgacaccgtgcagggcatcgccttctccgggaaccccctgtacacgagcaccggcgtgctgaccgccaaggacgaccccatctacatctgggccccggggatcatcatggagggcaaccactccgtctgcgacaagaagaccctccccctgacgtggaccggcttcatccccctgcccggggagatcgagaagaccacccagtgcacggtgttctgcaccctcgcgggcccgggggccgactgcgaggcctacagcgagaccggcatcttcaacatctccagcccgacctgcctgatcaaccgcgtccagcggttccgcggggccgagcagcagatcaagttcatctgccagcgggtggacatggacatcaccgtgtactgcaacggcctgaagaaggtcatcctcacgaagaccctggtgatcggccagtgcatctacaccttcacctccatcttcagcctgatccccggggtggcccactccctcgcggtcgagctgtgcgtgcccggcctgcacgggtgggccacgatgctcctgctgctgaccttctgcttcggctggatcctcatccccttcttcagcatgatcctgctgaagatcctcatcgccttcgcctacctgtgctccaagtacaacaccgacagcaagttcaagatcctgatcgagaaggtgaagaaggagtaccagaagaccatggggagcatggtctgcgaggtgtgccagtacgagtgcgagacggccaaggagctcgagtcccaccgcaagagctgccccatgggctcctgcccctactgcctgaaccccgcggaggccaccaccagcgccctgcaggcccacttcaaggtgtgcaagctcacctcccggttccaggacaacctgcgcaagagcctgggcgcctacgagccgaagcaggggtgctaccggacgctctccctgttccgctaccggagccgcttcttcgtcggcttcatctggtgcttcctgctcgtgctggagctgatcgtgtgggcggcctccgccgagacccagaacctcaacagcgggtggaccgacaccgcccacggctccggcatcatccccatgcggacggacctggagctggacttcagcctcccctccagcgcgtcctacacctaccgccgccagctgcagaacccggccaacgagcaggagaagatccccttccacctccagatcagcaagcaggtcatccacgccgagatccagcacctggggcactggatggacggcaccttcaacctgaagaccgccttccactgctacgggtcctgcgagaagtacgcctacccctggcagacggcgggctgcttcgtggagaaggactacgagtacgagagcgggtggggctgcaacccgcccgactgccccggcgtggggaccggctgcaccgcctgcggggtctacctggacaagctcaagagcgtgggcaaggccttcaagatcgtgtccctgcggtacacccgcaaggcctgcatccagctggggacggagcagacctgcaagagcgtcgactccaacgactgcctcgtgaccaccagcgtgaaggtctgcctgatcggcacggtgtccaagttccagcccagcgacaccctcctgttcctgggccccctggagcagggcgggctcatcttcaagcagtggtgcaccaccacgtgccagttcggggacccgggcgacatcatgtccacccccgtggggatgaagtgccccgagctgagcggctccttccggaagaagtgcgccttcgcgaccacccccgtctgccagttcgacggcaacacgctgagcgggtacaagcgcatgatcgccaccaaggactccttccagagcttcaacgtgaccgagccgcacatctccgccagctccctcgagtggatcgaccccgacagctccctgcgggaccacatcaacgtgatcgtcggccgcgacctgagcttccaggacctctccgagaccccctgccaggtggacctggccaccagcagcatcgacggggcctggggctccggggtgggcttcaacctggtctgcagcgtgtccctcacggagtgcagcaccttcctgacctccatcaaggcgtgcgacagcgccatgtgctacggctccaccacggccaacctgctccgggggcagaacaccgtgcacatcgtcggcaagggcgggcacagcggctccaagttcatgtgctgccacgacaccaagtgcagctccaccgggctggtggccgcggcgccccacctggaccgcgtgacgggctacaaccaggccgacagcgacaagatcttcgacgacggggccccggagtgcggcatctcctgctggttcaccaagagcggggagtggatcctcggcgtcctgaacggcaactggatggtggtggccgtcctggtggccctcttcatcctgtccatcttcctgttcaccctctgctgcccccggcgccccagctacgccaaggagcacaagccctga

SEQ ID NO: 11794 - RNA, 3447 nt, synthetic construct
  misc_feature 1..3447: note = derived and/or modified CDS sequence (opt1) from PUUV(PUUV/Ardennes/Mg75/2011)__KT247602.1__GP
  source 1..3447: mol_type = other RNA
atgggcaagatcatccccgtgtgcctgtacctcctgttcctgtgcctcctgctgtgggaccgcggggacacccggaacctcaacgagctgaagatggagtgcccgcacaccatcggcctggggcagggcctcgtcatcgggagcgtggagctgccgcccgtgcccctgacgcaggtcgagtccctcaagctggagagctcctgcaacttcgacctgcacaccagcacctccagccagcagtccttcaccaagtggacgtgggagatgaaggtggacctcgccgagaacacccaggccagctccaccagcttccagaccaagtccagcgagatcaacctgcgcggcctgtgcctcgtgccgcccctggtcatcgagacggcggcccggacccgcaagaccatcgcctgcttcgacctgtcctgcaaccagaccgcctgccagcccacggtgttcctcatcggccccatccagacctgcatcaccaccaagagctgcctgctggggctcggcgaccagcggatccaggtgaactacgagaagacgtactgcgtctccgggcagctggtggagggcatctgcttcaaccccgtgcacaccatggccctgagccagccctcccacacctacgacatcgtcaccgtgatggtgcgctgcttcctcatcgtcaagaaggtgagcacgggggactccatgaagctggagaagtccttcgagaccctggtgcagaagaccggctgcaccggcaacgggttccagggctactacgtctgcctcatcgggagcagcagcgagcccctgtacatccccacgctggacgactaccggtccgcggaggtgctcagccgcatggccttcgccccgcacggcgaggaccacgacatcgagaagaacgccatctccgcgatgcggatcgtgggcaaggtcaccgggaaggcccccagcaccgagtccagcgacaccgtgcagggcatcgccttctccgggaaccccctgtacacgagcaccggcgtgctgaccgccaaggacgaccccatctacatctgggccccggggatcatcatggagggcaaccactccgtctgcgacaagaagaccctccccctgacgtggaccggcttcatccccctgcccggggagatcgagaagaccacccagtgcacggtgttctgcaccctcgcgggcccgggggccgactgcgaggcctacagcgagaccggcatcttcaacatctccagcccgacctgcctgatcaaccgcgtccagcggttccgcggggccgagcagcagatcaagttcatctgccagcgggtggacatggacatcaccgtgtactgcaacggcctgaagaaggtcatcctcacgaagaccctggtgatcggccagtgcatctacaccttcacctccatcttcagcctgatccccggggtggcccactccctcgcggtcgagctgtgcgtgcccggcctgcacgggtgggccacgatgctcctgctgctgaccttctgcttcggctggatcctcatccccttcttcagcatgatcctgctgaagatcctcatcgccttcgcctacctgtgctccaagtacaacaccgacagcaagttcaagatcctgatcgagaaggtgaagaaggagtaccagaagaccatggggagcatggtctgcgaggtgtgccagtacgagtgcgagacggccaaggagctcgagtcccaccgcaagagctgccccatgggctcctgcccctactgcctgaaccccgcggaggccaccaccagcgccctgcaggcccacttcaaggtgtgcaagctcacctcccggttccaggacaacctgcgcaagagcctgggcgcctacgagccgaagcaggggtgctaccggacgctctccctgttccgctaccggagccgcttcttcgtcggcttcatctggtgcttcctgctcgtgctggagctgatcgtgtgggcggcctccgccgagacccagaacctcaacagcgggtggaccgacaccgcccacggctccggcatcatccccatgcggacggacctggagctggacttcagcctcccctccagcgcgtcctacacctaccgccgccagctgcagaacccggccaacgagcaggagaagatccccttccacctccagatcagcaagcaggtcatccacgccgagatccagcacctggggcactggatggacggcaccttcaacctgaagaccgccttccactgctacgggtcctgcgagaagtacgcctacccctggcagacggcgggctgcttcgtggagaaggactacgagtacgagagcgggtggggctgcaacccgcccgactgccccggcgtggggaccggctgcaccgcctgcggggtctacctggacaagctcaagagcgtgggcaaggccttcaagatcgtgtccctgcggtacacccgcaaggcctgcatccagctggggacggagcagacctgcaagagcgtcgactccaacgactgcctcgtgaccaccagcgtgaaggtctgcctgatcggcacggtgtccaagttccagcccagcgacaccctcctgttcctgggccccctggagcagggcgggctcatcttcaagcagtggtgcaccaccacgtgccacttcggggacccgggcgacatcatgtccacccccgtgagcatgaagtgccccgagctgtccgggagcttccggaagaagtgcgccttcgcgaccacccccgtctgccagttcgacggcaacacgctgtccggctacaagcgcatgatcgccaccaaggacagcttccagtccttcaacgtgaccgagccgcacatcagcgcctccagcctcgagtggatcgaccccgactccagcctgcgggaccacatcaacgtgatcgtcgggcgcgacctgtccttccaggacctcagcgagaccccctgccaggtggacctggccaccagctccatcgacggcgcctgggggagcggcgtggggttcaacctggtctgctccgtgagcctcacggagtgctccaccttcctgaccagcatcaaggcgtgcgactccgccatgtgctacggcagcaccacggccaacctgctccggggccagaacaccgtgcacatcgtcgggaagggcgggcactccggcagcaagttcatgtgctgccacgacaccaagtgctccagcaccggcctggtggccgcggcgccccacctggaccgcgtgacggggtacaaccaggccgactccgacaagatcttcgacgacggcgccccggagtgcgggatcagctgctggttcaccaagtccggcgagtggatcctcggggtcctgaacggcaactggatggtggtggccgtcctggtggccctcttcatcctgagcatcttcctgttcaccctctgctgcccccggcgcccctcctacgccaaggagcacaagccctga

SEQ ID NO: 11795 - RNA, 3447 nt, synthetic construct
  misc_feature 1..3447: note = derived and/or modified CDS sequence (opt1) from PUUV(PUUV/Jura/Mg2/2010)__KT247598.1__GP
  source 1..3447: mol_type = other RNA
atgggcaagatcatccccgtgtgcctgtacctcctgttcctgtgcctcctgctgtggaaccgcggggacacccggaacctcaacgagctgaagatggagtgcccgcacaccatcggcctggggcagggcctcgtcatcgggagcgtggagctgccgcccgtgcccctgacgcaggtcgagtccctcaagctggagagctcctgcaacttcgacctgcacaccagcacctccagccagcagtccttcaccaagtggacgtgggagatgaagtccgacctcgccgagaacacccaggccagcagcacctccttccagaccaagagctccgagatcaacctgcgcggcctgtgcctcgtgccgcccctggtgatcgagacggcggcccggacccgcaagaccatcgcctgcttcgacctgagctgcaaccagaccgcctgccagcccacggtcttcctcatcggccccatccagacctgcctgaccaccaagtcctgcctgctcgggctgggcgaccagcggatccaggtgaactacgagaagacgtactgcgtgagcgggcagctggtcgagggcgtgtgcttcaaccccatccacaccatggccctctcccagcccagccacacctacgacatcgtgaccgtcatggtgcgctgcttcctgatcgtgaagaaggtctccacgggggacagcatgaagatcgagaagtccttcgagaccctggtgcagaagaccggctgcaccggcaacgggttccagggctactacgtgtgcctcatcgggagcagctccgagcccctgtacatccccacgctggacgactaccggagcgcggaggtcctctcccgcatggccttcgccccgcacggcgaggaccacgacatcgagaagaacgccatcagcgcgatgcggatcgtgggcaaggtgaccgggaaggccccctccaccgagagctccgacaccgtccagggcatcgccttcagcgggaaccccctgtacacgtccaccggcgtgctgaccgccaaggacgaccccatctacatctgggccccggggatcatcatggagggcaaccacagcgtgtgcgagaagaagaccctccccctgacgtggaccggcttcatccccctgcccggggagatcgagaagaccacccagtgcacggtcttctgcaccctcgcgggcccgggggccgactgcgaggcctactccgagaccggcatcttcaacatcagctccccgacctgcctgatcaaccgcgtgcagcggttccgcggggccgagcagcagatcaagttcatctgccagcgggtcgacatggacatcaccgtgtactgcaacggcctgaagaaggtgatcctcacgaagaccctggtcatcggccagtgcatctacaccttcaccagcatcttctccctgatccccggggtggcccacagcctcgcggtggagctgtgcgtccccggcctgcacgggtgggccacgatgctcctgctgctgaccttctgcttcggctggatcctcatccccttcaccgccatgctgctgctcaagatcctgatcgccttcgcctacctgtgctccaagtacaacaccgacagcaagttcaagatcctcatcgagaaggtgaagaaggagtaccagaagacgatggggagcatggtgtgcgaggtctgccagtacgagtgcgagaccgcgaaggagctggagtcccaccgcaagagctgccccatgggctcctgcccctactgcctgaaccccgccgaggccaccaccagcgccctccaggcccacttcaaggtgtgcaagctgacgtcccggttccaggacaacctgcgcaagagcctcggcgcgtacgagccgaagcaggggtgctaccggaccctgtccctgttccgctaccggagccgcttcttcgtgggcctcgtctggtgcttcctgctggtgctcgagctgatcatctgggccgcctccgccgagacccagaacctgaacagcgggtggaccgacacggcgcacggctccggcgtgatccccatgcggaccgacctcgagctggacttcagcctgccctccagcgcctcctacacctaccgccgccagctccagaacccggccaacgagcaggagaagatccccttccacctccagatcagcaagcaggtcatccacgccgagatccagcacctggggcactggatggacggcaccttcaacctgaagacggccttccactgctacgggtcctgcgagaagtacgcgtacccctggcagaccgccggctgcttcgtggagaaggactacgagtacgagagcgggtggggctgcaacccgcccgactgccccggcgtggggaccggctgcaccgcctgcggggtctacctggacaagctcaagagcgtgggcaaggccttccggatcgtgtccctgaagtacacgcgcaaggcctgcatccagctggggaccgagcagacctgcaagagcgtcgactccaacgactgcctggtgaccacgagcgtgaaggtctgcctcatcggcaccgtgtccaagttccagcccagcgacaccctgctgttcctcggccccctggagcagggcgggctgatcttcaagcagtggtgcaccacgacctgccagttcggggacccgcgggacatcatgtccacccccgtgggcatgcgctgccccgagctcagcgggtccttccggaagaagtgcgcgttcgccaccacgcccgtctgccagttcgacggcaacaccatcagcggctacaagcgcatgatcgccaccaaggactccttccagagcttcaacgtgaccgagccgcacatctccgccagctccctggagtggatcgaccccgacagctccctgcgggaccacatcaacgtgatcgtcgggcgcgacctcagcttccaggacctgtccgagaccccctgccaggtggacctgacgaccaccagcatcgacggcgcctgggggagcggcgtggggttcaacctcatctgctccgtcagcctgaccgagtgctccacgttcctgaccagcatcaaggcgtgcgactccgccatgtgctacggcagcaccaccgccaacctcatgcggggccagaacacgatccacatcgtggggaagggcgggcactccggcagcaagttcatgtgctgccacgacaccaagtgctccagcaccggcctggtggccgcggcgccccacctggaccgcgtcaccgggtacaaccaggccgactccgacaagatcttcgacgacggcgccccggagtgcgggatcagctgctggttcacgaagtccggcgagtggatcctcggggtgctgaacggcaactggatggtggtcgccgtgctggtggtcctcttcatcctgagcatcttcctgttcaccctctgctgcccccggcgcccctcctacgccaaggagcacaagccctga

SEQ ID NO: 11796 - RNA, 3447 nt, synthetic construct
  misc_feature 1..3447: note = derived and/or modified CDS sequence (opt1) from PUUV(PUUV/Jura/Mg214/2010)__KT247599.1__GP
  source 1..3447: mol_type = other RNA
atgggcaagatcatccccgtgtgcctgtacctcctgttcctgtgcctcctgctgtggaaccgcggggacacccggaacctcaacgagctgaagatggagtgcccgcacaccatcggcctggggcagggcctcgtcatcgggagcgtggagctgccgcccgtgcccctgacgcaggtcgagtccctcaagctggagagctcctgcaacttcgacctgcacaccagcacctccagccagcagtccttcaccaagtggacgtgggagatgaagtccgacctcgccgagaacacccaggccagcagcacctccttccagaccaagagctccgagatcaacctgcgcggcctgtgcctcgtgccgcccctggtgatcgagacggcggcccggacccgcaagaccatcgcctgcttcgacctgagctgcaaccagaccgcctgccagcccacggtcttcctcatcggccccatccagacctgcctgaccaccaagtcctgcctgctcgggctgggcgaccagcggatccaggtgaactacgagaagacgtactgcgtgagcgggcagctggtcgagggcgtgtgcttcaaccccatccacaccatggccctctcccagcccagccacacctacgacatcgtgaccgtcatggtgcgctgcttcctgatcgtgaagaaggtctccacgggggacagcatgaagatcgagaagtccttcgagaccctggtgcagaagaccggctgcaccggcaacgggttccagggctactacgtgtgcctcatcgggagcagctccgagcccctgtacatccccacgctggacgactaccggagcgcggaggtcctctcccgcatggccctggccccgcacggcgaggaccacgacatcgagaagaacgccatcagcgcgatgcggatcgtgggcaaggtgaccgggaaggccccctccaccgagagctccgacaccgtccagggcatcgccttcagcgggaaccccctgtacacgtccaccggcgtgctcaccgccaaggacgaccccatctacatctgggccccggggatcatcatggagggcaaccacagcgtgtgcgagaagaagaccctgcccctgacgtggaccggcttcatccccctccccggggagatcgagaagaccacccagtgcacggtcttctgcaccctggcgggcccgggggccgactgcgaggcctactccgagaccggcatcttcaacatcagctccccgacctgcctgatcaaccgcgtgcagcggttccgcggggccgagcagcagatcaagttcatctgccagcgggtcgacatggacatcaccgtgtactgcaacggcctcaagaaggtgatcctgacgaagaccctggtcatcggccagtgcatctacaccttcaccagcatcttctccctcatccccggggtggcccacagcctggcggtggagctgtgcgtccccggcctccacgggtgggccacgatgctgctgctgctcaccttctgcttcggctggatcctgatccccttcaccgccatgctgctcctgaagatcctgatcgccttcgcctacctctgctccaagtacaacaccgacagcaagttcaagatcctgatcgagaaggtgaagaaggagtaccacaagagcatggggtccatggtgtgcgaggtctgccagtacgagtgcgagacggcgaaggagctggagagccaccgcaagtcctgccccatgggcagctgcccctactgcctcaaccccgccgaggccaccacctccgccctgcaggcccacttcaaggtgtgcaagctgaccagccggttccaggacaacctccgcaagtccctgggcgcgtacgagccgaagcaggggtgctaccggacgctgagcctcttccgctaccggtcccgcttcttcgtgggcctggtctggtgcttcctgctcgtgctggagctgatcatctgggccgccagcgccgagacccagaacctcaactccgggtggaccgacaccgcgcacggcagcggcgtgatccccatgcggacggacctggagctggacttctccctccccagctccgccagctacacctaccgccgccagctgcagaacccggccaacgagcaggagaagatccccttccacctccagatctccaagcaggtcatccacgccgagatccagcacctggggcactggatggacggcaccttcaacctgaagaccgccttccactgctacgggagctgcgagaagtacgcgtacccctggcagacggccggctgcttcgtggagaaggactacgagtacgagagcgggtggggctgcaacccgcccgactgccccggcgtggggaccggctgcaccgcctgcggggtctacctggacaagctcaagtccgtgggcaaggccttccggatcgtgagcctgaagtacacccgcaaggcctgcatccagctggggacggagcagacctgcaagtccgtcgacagcaacgactgcctcgtgaccacctccgtgaaggtctgcctgatcggcacggtgagcaagttccagccctccgacaccctcctgttcctgggccccctggagcagggcgggctcatcttcaagcagtggtgcaccaccacgtgccagttcggggacccgggcgacatcatgagcacccccgtggggatgcggtgccccgagctgtccggcagcttccgcaagaagtgcgcgttcgccaccacccccgtctgccagttcgacggcaacacgatctccgggtacaagcggatgatcgccaccaaggacagcttccagtccttcaacgtgaccgagccgcacatcagcgcctccagcctggagtggatcgaccccgactccagcctccgcgaccacatcaacgtgatcgtcggccgggacctgtccttccaggacctgagcgagaccccctgccaggtggacctcaccacgaccagcatcgacggggcctggggctccggggtgggcttcaacctgatctgcagcgtctccctgaccgagtgcagcaccttcctcacgtccatcaaggcgtgcgacagcgccatgtgctacggctccaccaccgccaacctgatgcgcgggcagaacaccatccacatcgtgggcaagggcgggcacagcggctccaagttcatgtgctgccacgacacgaagtgcagctccaccgggctggtggccgcggcgccccacctcgaccgggtcaccggctacaaccaggccgacagcgacaagatcttcgacgacggggccccggagtgcggcatctcctgctggttcaccaagagcggggagtggatcctgggcgtgctgaacggcaactggatggtggtcgccgtgctcgtggtcctgttcatcctgtccatcttcctcttcacgctgtgctgcccccgccggcccagctacgccaaggagcacaagccctga

SEQ ID NO: 11797 - RNA, 3447 nt, synthetic construct
  misc_feature 1..3447: note = derived and/or modified CDS sequence (opt1) from PUUV(PUUV/Orleans/Mg23/2010)__KT247600.1__GP
  source 1..3447: mol_type = other RNA
atgggcaagatcatccccgtgtgcctgtacctcctgttccgctgcctgctcctgtgggaccgggggaacgcccgcaacctgaacgagctcaagatggagtgcccgcacaccatcggcctggggcagggcctggtcatcgggagcgtggagctcccgcccgtgcccctgacccagatcgagtccctgaagctcgagagctcctgcaacttcgacctgcacacgagcacctccagccagcagtccttcaccaagtggacctgggagatcaagagcgacctggccgagaacacgcaggcgtccagcacctccttccagaccaagagctccgaggtcaacctccggggcctgtgcctggtgccgcccctcgtgatcgagaccgccgcccgcacgcggaagaccatcgcctgcttcgacctgagctgcaaccagaccgcctgccagcccaccgtcttcctgatcggccccatccagacgtgcatcaccaccaagtcctgcctcctggggctgggcgaccagcgcatccaggtgaactacgagaagacctactgcgtgagcgggcagctcatcgagggcatctgcttcaaccccgtccacacgatggcgctgtcccagcccagccacacctacgacgtggtgaccgtcatggtgcggtgcttcctgatcgtgaagaaggtctccaccggggacagcatgaagatcgagaagtccttcgagacgctcgtgcagaagaccggctgcaccggcaacgggttccagggctactacgtgtgcctgatcgggtccagctccgagcccctgtacatccccaccctcgacgactaccgcagcgccgaggtcctgtcccggatggccttcgccccgcacggcgaggaccacgacatcgagaagaacgcgatcagcgccatgcgcatcgtgggcaaggtgacggggaaggccccctccaccgaggccagcgacaccgtccagggcatcgccttctccgggaaccccctgtacaccagcacgggcgtgctcaccgcgaaggacgaccccatctacatctgggccccggggatcatcatggagggcaaccactccgtgtgcgagaagaagaccctgcccctgacctggacgggcttcatccccctccccggggagatcgagaagaccacccagtgcaccgtcttctgcacgctggccggcccgggggccgactgcgaggcctacagcgagaccggcatcttcaacatcagcagcccgacctgcctgatcaaccgggtgcagcgcttccgcggggcggagcagcagatcaagttcatctgccagcgggtcgacatggacatcaccgtgtactgcaacggcctcaagaaggtgatcctgaccaagacgttcatcatcggccagtgcatctacaccttcacctccatcttcagcctgatccccggggtcgcccactccctcgccgtggagctgtgcgtgcccggcctgcacgggtgggccaccatgctcctgctgctcacgttctgcttcggctgggtcctgatccccttcttcagcatgatcctgctgaagatcctcatcgccttcgcgtacctgtgctccaagtacaacaccgacagcaagttccggatcctgatcgagaaggtgaagcgcgagtaccagaagaccatggggagcatggtgtgcgaggtctgccagtacgagtgcgagaccgccaaggagctcgagtcccaccgcaagagctgccccatgggctcctgcccctactgcctgaaccccgccgaggccacgaccagcgccctgcaggcgcacttcaaggtgtgcaagctcacctcccggttccaggacaacctgcgcaagagcctgggcgcctacgagccgaagcaggggtgctaccggaccctctccctgttccggtaccgcagccgcttcttcgtgggcttcatctggtgcttcctgctcgtcctggagctgatcatctgggccgcctccgcggagacgcagaacctcaacagcgggtggaccgacaccgcccacggctccggcgtgatccccatgcggaccgacctggagctggacttcagcctcccctccagcgcctcctacacgtaccgccggcagctgcagaacccggccaacgagcaggagaagatccccttccacctccagatcagcaagcaggtcatccacgccgagatccagcacctggggcactggatggacggcaccttcaacctgaagaccgcgttccactgctacgggtcctgcgagaagtacgcctacccctggcagaccgccggctgcttcatcgagaaggactacgagtacgagagcgggtggggctgcaacccgcccgactgccccggcgtggggacgggctgcaccgcctgcggggtgtacctggacaagctcaagagcgtgggcaaggccttcaagatcgtctccctgcgctacacccggaaggcgtgcatccagctggggaccgagcagacgtgcaagagcgtggactccaacgactgcctcgtgaccaccagcgtcaaggtgtgcctgatcggcaccgtgtccaagttccagcccagcgacacgctcctgttcctgggccccctggagcagggcgggctcatcttcaagcagtggtgcaccacgacctgccacttcggggacccgggcgacatcatgtccacccccgccgggatgaagtgccccgagctgagcggctccttcaccaagaagtgcgccttcgcccccaccccggtctgccagttcgacggcgacaccacgagcgggtacaagaagatgatcgccaccaaggactccttccagagcttcaacgtgaccgagccccacatctccgcgagctccctggagtggatcgaccccgaccgcagcctccgggaccacatcaacgtgatcgtcggccgcgacctgtccttccaggacctgagcgagaccccctgccaggtggacctcaccacgacctccatcgacggggcctggggcagcggggtgggcttcaacctgatctgcagcgtctccctgaccgagtgcagcaccttcctcacgtccatcaaggcctgcgacagcgccatgtgctacggctccaccaccgcgaacctgctgcgggggcagaacaccgtgcacatcgtgggcaagggcgggcacagcggctccaagttcatgtgctgccacgacacgaagtgcagctccaccgggctcgtcgccgccgccccgcacctggaccgcgtgaccggctacaaccaggccgacagcgacaagatcttcgacgacggggcgcccgagtgcggcatctcctgctggctgaccaagagcggggagtggatcctcggcgtgctgaacggcaactggatggtcgtggccgtgctggtcgccctcttcatcttctccatcttcctgttcacgctgtgctgcccccggcgccccagctacgccaaggagcacaagccgtga

SEQ ID NO: 11798 - RNA, 3447 nt, synthetic construct
  misc_feature 1..3447: note = derived and/or modified CDS sequence (opt1) from PUUV(PUUV/Orleans/Mg29/2010)__KT247601.1__GP
  source 1..3447: mol_type = other RNA
atgggcaagatcatccccgtgtgcctgtacctcctgttccgctgcctgctcctgtgggaccgggggaacgcccgcaacctgaacgagctcaagatggagtgcccgcacaccatcggcctggggcagggcctggtcatcgggagcgtggagctcccgcccgtgcccctgacccagatcgagtccctgaagctcgagagctcctgcaacttcgacctgcacacgagcacctccagccagcagtccttcaccaagtggacctgggagatcaagagcgacctggccgagaacacgcaggcgtccagcacctccttccagaccaagagctccgaggtcaacctccggggcctgtgcctggtgccgcccctcgtgatcgagaccgccgcccgcacgcggaagaccatcgcctgcttcgacctgagctgcaaccagaccgcctgccagcccaccgtcttcctgatcggccccatccagacgtgcatcaccaccaagtcctgcctcctggggctgggcgaccagcgcatccaggtgaactacgagaagacctactgcgtgagcgggcagctcgtcgagggcgtgtgcttcaaccccatccacacgatggcgctgtcccagcccagccacacctacgacatcgtgaccgtcatggtgcggtgcttcctgatcgtgaagaaggtctccaccggggacagcatgaagatcgagaagtccttcgagacgctcgtgcagaagaccggctgcaccggcaacgggttccagggctactacgtgtgcctgatcgggtccagctccgagcccctgtacatccccaccctcgacgactaccgcagcgccgaggtcctgtcccggatggccttcgccccgcacggcgaggaccacgacatcgagaagaacgcgatcagcgccatgcgcatcgtgggcaaggtgacggggaaggccccctccaccgaggccagcgacaccgtccagggcatcgccttctccgggaaccccctgtacaccagcacgggcgtgctcaccgcgaaggacgaccccatctacatctgggccccggggatcatcatggagggcaaccactccgtgtgcgagaagaagaccctgcccctgacctggacgggcttcatccccctccccggggagatcgagaagaccacccagtgcaccgtcttctgcacgctggccggcccgggggccgactgcgaggcctacagcgagaccggcatcttcaacatcagcagcccgacctgcctgatcaaccgggtgcagcgcttccgcggggcggagcagcagatcaagttcatctgccagcgggtcgacatggacatcaccgtgtactgcaacggcctcaagaaggtgatcctgaccaagacgttcatcatcggccagtgcatctacaccttcacctccatcttcagcctgatccccggggtcgcccactccctcgccgtggagctgtgcgtgcccggcctgcacgggtgggccaccatgctcctgctgctcacgttctgcttcggctgggtcctgatccccttcttcagcatgatcctgctgaagatcctcatcgccttcgcgtacctgtgctccaagtacaacaccgacagcaagttccggatcctgatcgagaaggtgaagcgcgagtaccagaagaccatggggagcatggtgtgcgaggtctgccagtacgagtgcgagaccgccaaggagctcgagtcccaccgcaagagctgccccatgggctcctgcccctactgcctgaaccccgccgaggccacgaccagcgccctgcaggcgcacttcaaggtgtgcaagctcacctcccggttccaggacaacctgcgcaagagcctgggcgcctacgagccgaagcaggggtgctaccggaccctctccctgttccggtaccgcagccgcttcttcgtgggcttcatctggtgcttcctgctcgtcctggagctgatcatctgggccgcctccgcggagacgcagaacctcaacagcgggtggaccgacaccgcccacggctccggcgtgatccccatgcggaccgacctggagctggacttcagcctcccctccagcgcctcctacacgtaccgccggcagctgcagaacccggccaacgagcaggagaagatccccttccacctccagatcagcaagcaggtcatccacgccgagatccagcacctggggcactggatggacggcaccttcaacctgaagaccgcgttccactgctacgggtcctgcgagaagtacgcctacccctggcagaccgccggctgcttcatcgagaaggactacgagtacgagagcgggtggggctgcaacccgcccgactgccccggcgtggggacgggctgcaccgcctgcggggtgtacctggacaagctcaagagcgtgggcaaggccttcaagatcgtctccctgcgctacacccggaaggcgtgcatccagctggggaccgagcagacgtgcaagagcgtggactccaacgactgcctcgtgaccaccagcgtcaaggtgtgcctgatcggcaccgtgtccaagttccagcccagcgacacgctcctgttcctgggccccctggagcagggcgggctcatcttcaagcagtggtgcaccacgacctgccacttcggggacccgggcgacatcatgtccacccccgccgggatgaagtgccccgagctgagcggctccttccgcaagaagtgcgccttcgcccccaccccggtctgccacttcgacggcaagaccatcagcgggtacaagcggatgatcgccaccaaggactccttccagagcttcaacgtgacggagccccacatctccgcgagctccctggagtggatcgaccccgacagctccctccgcgaccacatcaacgtgatcgtcggccgggacctgagcttccaggacctgtccgagaccccctgccaggtggacctcaccaccaccagcatcgacggggcctggggcagcggggtgggcttcaacctgatctgctccgtcagcctgacggagtgctccaccttcctcaccagcatcaaggcctgcgactccgccatgtgctacggcagcaccacggcgaacctgctgcgcgggcagaacaccgtgcacatcgtgggcaagggcgggcactccggcagcaagttcatgtgctgccacgacaccaagtgctccagcaccgggctcgtcgccgccgccccgcacctggaccgggtgacgggctacaaccaggccgactccgacaagatcttcgacgacggggcgcccgagtgcggcatcagctgctggctgaccaagtccggggagtggatcctcggcgtgctgaacggcaactggatggtcgtggccgtgctggtcgccctcttcatcttcagcatcttcctgttcaccctgtgctgcccccgccggccctcctacgccaaggagcacaagccgtga

SEQ ID NO: 11799 - RNA, 3447 nt, synthetic construct
  misc_feature 1..3447: note = derived and/or modified CDS sequence (opt1) from PUUV(Vranica)__U14136.1__GP
  source 1..3447: mol_type = other RNA
atgggcaagctgagccccgtgtgcctctacctgttcctgcagtgcctcctgctgtggaaccgcgggtccgcccggaacctcaacgagctgaagatggagtgcccgcacaccatcggcctggggcagggcctcgtcatcgggagcgtggagctgccgcccgtgcccatccagcaggtcgagtccctgaagctcgagagctcctgcaacttcgacctgcacaccagcacggccacccagcagtccttcaccaagtggacctgggagatgaaggacgacctggcggagaacacgcaggccagctccaccagcttccagaccaagtccagcgaggtgaacctccgcggcctgtgcctgatcccgcccctcgtggtcgagaccgcctcccggacgcgcaagaccatcgcctgcttcgacatcagctgcaaccagaccgtgtgccagcccaccgtgtacctggtcggccccatccagacgtgcatcaccaccaagtcctgcctgctcgggctgggcgaccagcggatccaggtgaactacgagaagacctactgcgtgagcgggcagctgatcgagggcgtctgcttcaaccccgtgcacacgcgcgccctctcccagcccagccacacctacgacatcgtgaccatgatggtccggtgcttcctggtggtgaagaaggtcacctccggggacagcatgaagatcgagaagaacttcgagacgctggtgcagaagaccgactgcaacgcgaacggcttccagggctactacatctgcctcgtggggagctccagcgagcccctgtacgtccccaccctggacgactaccgctccgccgaggtgctcagccggatggccttcgccccgcacggcgaggaccacgacgtggagcgcaacgcggtctccgccctgcggatcgtggggaaggtcaccggcaaggcccccagcacggaggcctccgacaccgtgcagggcatcgccttcagcgggagccccctgtacacctccaccggcgtgctcacggcgaaggacaaccccgtctacatctggtccccggggatcatcatggagggcaaccacagcgtgtgcgagaagaagaccctgcccctgacctggaccgggttcatccccctccccggcgagatcgagaagacgccgcagtgcaccgtgttctgcaccctggccggccccggggccgactgcgaggcctactccgagaccggcatcttcaacatcagctcccccacgtgcctgctcaaccgcgtccagcggttccgcggggccgagcagcagatcaagttcgtgtgccagcgggtggacatggacatcaccgtctactgcaacggcatgaagaaggtgatcctgaccaagaccctggtgatcgggcagtgcatctacaccttcacgagcatcttctccctcatccccggcatcgcgcacagcctggccgtcgagctgtgcgtgccgggcctccacgggtgggccaccgtgctgctgctcctgaccttctgcttcggctggatcctgatccccttcatcgccatgatcctgctcaagatcctgatcgccttcgcgtacctgtgctccaagtacaacaccgacagcaagttcaagatcctcatcgagaaggtcaagaaggagtaccagaagacgatggggagcatggtgtgcgaggtgtgccagtacgagtgcgagaccgccaaggagctggagtcccaccgcaagagctgccccatcggctcctgcccctactgcctgaacccgagcgaggccaccacctccgccctccaggcccacttcaaggtctgcaagctgacgagccggttccaggacaacctgcgcaagtccctcgcggcctacgagcccaagcaggggtgctaccggaccctgagcctgttccgctaccggtcccgcttcttcgtgggcttcatctggtgcatcctcctggtgctggagctcgtcatctgggccgccagcgcggagacccagaacctgaactccggctggaccgacacggcccacgggagcggcgtggtgcccatgcgcaccgacctggagctcgacttctccctgccgagctccgccagctacacctaccggcgccagctgcagaaccccgccaacgagcacgagaagatccccttccacctccagatctccaagcaggtcatccacgccgagatccagcacctggggcactggatggacgcgaccttcaacctgaagacggccttccactgctacggcctctgcgagaagtacgcctacccctggcagaccgccggctgcttcttcgagaaggactacgagttcgagagcgggtggggctgcaacccgcccgactgccccgggatcggcaccgggtgcaccgcctgcggcgtgtacctggacaagctcaagagcgtgggcaaggtcttcaagatcatctccctgcggtacacgcgcaaggcgtgcatccagctggggaccgagcagacctgcaagagcgtggactccaacgactgcctggtgaccacgagcatcaaggtctgcctcatcggcaccgtgtccaagttccagcccagcgacaccctgctgttcctcgggccgctggagcagggcgggctgatcttcaagcagtggtgcaccacgacctgccagttcggcgaccccggcgacatcatgtccaccctcaccgggatgaagtgccccgagctgaacggcagcttccggaagaagtgcgccttcgccacgacccccgtgtgccagttcgacgggaacaccatctccggctacaagcgcatgatggccaccaaggacagcttccagtccttcaacgtcacggagccgcacatcagcacctccgccctggagtggatcgaccccgacagctccctccgggaccacatcaacgtggtggtcagccgcgacctgtccttccaggacctgagcgagaccccctgccaggtggacctcaccacctccagcatcgacggggcgtggggcagcggcgtggggttcaacctggtctgcacggtgtccctgaccgagtgccccaccttcctcaccagcatcaaggcctgcgactccgccatgtgctacggcagcacgaccaccaacctggtgcgggggcagaacaccgtccacatcgtgggcaagggcgggcactccggcagcaagttcatgtgctgccacgacacgaagtgctccagcaccgggctgatcgccgcggccccgcacctcgaccgcgtgaccggcttcaaccaggccgactccgacaagatcttcgacgacggggcccccggctgcggcatgagctgctggttcaagaagtccggggagtggatcctgggcgtcctgaacgggaactggctcgtggtggccgtcctgatcgcgctgttcatcctcagcatcttcctgttcaccctgtgctgcccccggcgccccacgtacaccaaggagcacaagccgtga

SEQ ID NO: 11800 - RNA, 3447 nt, synthetic construct
  misc_feature 1..3447: note = derived and/or modified CDS sequence (opt1) from PUUV(CG1820/POR)__KT885051.1__GP
  source 1..3447: mol_type = other RNA
atgggcgagctgagccccgtgtgcctctacctgctgctccaggggctgctgctctgcaacaccggcgccgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgcctgatcaaccgcgtccagcggttccgcggctccgagcagcagatcaagttcgtgtgccagcgggtcgacatggacatcaccgtgtactgcaacgggatgaagaaggtgatcctgaccaagaccctcgtcatcggccagtgcatctacacgttcaccagcatcttctccctgatccccggcgtggcccacagcctggccgtggagctctgcgtccccgggctgcacggctgggccaccatgctgctcctgctgaccttctgcttcgggtgggtgctgatccccacgatcaccatgatcctcctgaagatcctgatcgcgttcgcctacctctgcagcaagtacaacaccgactccaagttccgcatcctgatcgagaaggtgaagcgggagtaccagaagaccatgggcagcatggtctgcgaggtgtgccagtacgagtgcgagacggccaaggagctggagtcccaccgcaagagctgctccatcgggagctgcccctactgcctcaacccctccgaggccaccaccagcgccctgcaggcgcacttcaaggtgtgcaagctgacctcccggttccaggagaacctccgcaagagcctgacggtctacgagccgatgcagggctgctaccggaccctgtccctcttccgctaccggagccgcttcttcgtgggcctggtgtggtgcgtcctgctcgtgctggagctgatcgtgtgggccgcctccgccgagacccagaacctcaacgcggggtggaccgacacggcccacggcagcgggatcatccccatgaagaccgacctggagctggacttctccctccccagctccgccagctacacctaccgccggcagctgcagaaccccgccaacgagcaggagaagatcccgttccacctccagctcagcaagcaggtcatccacgccgagatccagcacctgggccactggatggacgcgaccttcaacctgaagacggccttccactgctacggctcctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctcaagagcgtcgggaaggtgttcaagatcgtgtccctgcgctacacccggaaggtctgcatccagctgggcaccgagcagacctgcaagacggtggacagcaacgactgcctgatcaccacctccgtgaaggtctgcctgatcgggaccatcagcaagttccagccctccgacacgctcctgttcctgggccccctccagcagggcgggctgatcttcaagcagtggtgcaccacgacctgccagttcggcgacccgggggacatcatgagcacccccaccggcatgaagtgccccgagctgaacgggtccttccgcaagaagtgcgcgttcgccaccacccccgtgtgccagttcgacggcaacaccatcagcgggtacaagcggatgatcgccacgaaggactccttccagagcttcaacgtgaccgagccgcacatctccaccagcgccctcgagtggatcgaccccgactccagcctgcgcgaccacatcaacgtcatcgtgtcccgggacctgagcttccaggacctctccgagaccccctgccagatcgacctggccacggcgagcatcgacggcgcctggggcagcggggtgggcttcaacctggtctgcaccgtgtccctcaccgagtgcagcgccttcctgacctccatcaaggcctgcgacgcggccatgtgctacgggagcacgaccgccaacctggtgcgcggccagaacaccatccacatcgtcgggaagggcggccactccgggagcaagttcatgtgctgccacgacaccaagtgctccagcacgggcctcgtggccgccgcgccccacctggaccgggtgaccgggtacaaccaggccgactccgacaagatcttcgacgacggcgccccggagtgcggcatgagctgctggttcaagaagtccggggagtggatcctgggcgtcctcaacgggaactggatggtggtggccgtcctggtggtgctgctcatcctgagcatcctgctgttcaccctgtgctgcccccgccggccctcctaccgcaaggagcacaagccctga

SEQ ID NO: 11801 - RNA, 3447 nt, synthetic construct
  misc_feature 1..3447: note = derived and/or modified CDS sequence (opt1) from PUUV(DTK/Ufa-97)__AB297666.2__GP
  source 1..3447: mol_type = other RNA
atgggcgagctgagccccgtgtgcctctacctgctgctccaggggctgctgctctgcaacaccggcgccgcccgcaacctgaacgagctgaagatggagtgcccgcacaccgtccggctcgggcagggcctggtggtggggtccgtcgagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtggagaccgccgcccggatgcgcaagaccatcgcgtgctacgacctcagctgcaaccagaccgtgtgccagccgacggtctacctgatgggccccatccagacctgcatcaccaccaagtcctgcctgctcagcctgggggaccagcggatccaggtgaactacgagaagacgtactgcgtgtccggccagctggtcgaggggatctgcttcaaccccatccacaccatggccctcagccagccctcccacacctacgacatcatgaccatgatggtgcgctgcttcctggtgatcaagaaggtcacgagcggcgactccatgaagatcgagaagaacttcgagaccctggtgcagaagaacggctgcaccgccaacaacttccaggggtactacatctgcctcatcggcagcagctccgagccgctgtacgtgcccgccctggacgactaccggagcgcggaggtcctctcccgcatggccttcgcgccccacggggaggaccacgacatcgagaagaacgccgtgagcgccatgcggatcgccggcaaggtgaccggcaaggccccctccacggagagctccgacaccgtccaggggatcgccttcagcggctccccgctgtacaccagcaccggggtgctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtcttctgcaccctcgccgggcccggcgcggactgcgaggcctacagcgagacggggatcttcaacatctccagcccgacctgcctgatcaaccgcgtgcagcggttccgcggctccgagcagcagatcaagttcgtctgccagcgggtggacatggacatcaccgtgtactgcaacgggatgaagaaggtcatcctgaccaagaccctcgtgatcggccagtgcatctacacgttcaccagcatcttctccctgatccccggcgtggcccacagcctggccgtcgagctctgcgtgcccgggctgcacggctgggccaccatgctgctcctgctgaccttctgcttcgggtgggtgctgatccccacgatcaccatgatcctcctgaagatcctgatcgcgttcgcctacctctgcagcaagtacaacaccgactccaagttccgcatcctgatcgagaaggtcaagcgggagtaccagaagaccatgggcagcatggtgtgcgaggtgtgccagtacgagtgcgagacggccaaggagctggagtcccaccgcaagagctgctccatcgggagctgcccctactgcctcaacccctccgaggccaccaccagcgccctgcaggcgcacttcaaggtctgcaagctgacctcccggttccaggagaacctccgcaagagcctgacggtgtacgagccgatgcagggctgctaccggaccctgtccctcttccgctaccggagccgcttcttcgtgggcctggtctggtgcgtgctgctcgtgctggagctgatcgtctgggccgcctccgccgagacccagaacctcaacgcggggtggaccgacacggcccacggcagcgggatcatccccatgaagaccgacctggagctggacttctccctccccagctccgccagctacacctaccgccggcagctgcagaaccccgccaacgagcaggagaagatcccgttccacctccagctcagcaagcaggtcatccacgccgagatccagcacctgggccactggatggacgcgaccttcaacctgaagacggccttccactgctacggctcctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctcaagagcgtggggaaggtgttcaagatcgtctccctgcgctacacccggaaggtgtgcatccagctgggcaccgagcagacctgcaagacggtggacagcaacgactgcctgatcaccacctccgtcaaggtgtgcctgatcgggaccatcagcaagttccagccctccgacacgctcctgttcctgggccccctccagcagggcgggctgatcttcaagcagtggtgcaccacgacctgccagttcggcgacccgggggacatcatgagcacccccaccggcatgaagtgccccgagctgaacgggtccttccgcaagaagtgcgcgttcgccaccacccccgtgtgccagttcgacggcaacaccatcagcgggtacaagcggatgatcgccacgaaggactccttccagagcttcaacgtcaccgagccgcacatctccaccagcgccctcgagtggatcgaccccgactccagcctgcgcgaccacatcaacgtgatcgtgtcccgggacctgagcttccaggacctctccgagaccccctgccagatcgacctggccacggcgagcatcgacggcgcctggggcagcggggtcggcttcaacctggtgtgcaccgtgtccctcaccgagtgcagcgccttcctgacctccatcaaggcctgcgacgcggccatgtgctacgggagcacgaccgccaacctggtccgcggccagaacaccatccacatcgtggggaagggcggccactccgggagcaagttcatgtgctgccacgacaccaagtgctccagcacgggcctcgtggccgccgcgccccacctggaccgggtcaccgggtacaaccaggccgactccgacaagatcttcgacgacggcgccccggagtgcggcatgagctgctggttcaagaagtccggggagtggatcctgggcgtgctcaacgggaactggatggtggtcgccgtgctggtggtcctgctcatcctgagcatcctgctgttcaccctgtgctgcccccgccggccctcctaccgcaaggagcacaagccctga

SEQ ID NO: 11802 - RNA, 3447 nt, synthetic construct
  misc_feature 1..3447: note = derived and/or modified CDS sequence (opt1) from PUUV(PUU/Cg-Erft)__AJ238778.1__GP
  source 1..3447: mol_type = other RNA
atgggcaagatcatccccgtgtgcctgtacctcctgttcctgtgcctcctgctgtggaaccgcggggacgcccggaacctcaacgagctgaagatcgagtgcccgcacaccatcggcctggggcagggcctcgtcatcgggagcgtggagctgccgcccgtgcccctgacccaggtcgagtccctcaagctggagagctcctgcaacttcgacctgcacacgagcacctccagccagcagcccttcaccaagtggacctgggagatgaagtccgacctcgccgagaacacgcaggcgagctccaccagcttccagaccaagtccagcgagatcaacctgcgcggcctgtgcctcgtgccgcccctggtgatcgagaccgccgcccggacgcgcaagaccatcgcctgcttcgacctgtcctgcaaccagaccgcctgccagcccaccgtcttcctcatcggccccatccagacgtgcatcaccaccaagagctgcctgctggggctcggcgaccagcggatccaggtgaactacgagaagacctactgcgtgtccgggcagctggtcgagggcgtgtgcttcaaccccgtgcacacgatggcgctgagccagccctcccacacctacgacatcgtcaccgtgatggtgcgctgcttcctcatcgccaagaaggtcagcaccggggactccatgaagctggagaagtccttcgagacgctggtgcagaagaccagctgcaccggcaacggcttccaggggtactacatctgcctcgtgggcagcagctccgagcccctgtacatcccgaccctggacgactaccggagcgccgaggtcctctcccgcatggccttcgcgccccacggggaggaccacgacgtggagaagaacgccatcagcgccatgcggatcatcggcaaggtgacgggcaaggccccctccaccgagagctccgacaccatccagggggtcgccttcagcggcaaccccctgtacacctccacgggggtgctgaccgcgaaggacgacccggtgtacatctgggcccccggcatcatcatggaggggaaccacagcgtctgcgacaagaagaccctccccctgacctggacgggcttcatccccctgccgggcgagatcgagaagaccacccagtgcaccgtgttctgcacgctcgccgggcccggcgccgactgcgaggcctactccgagaccgggatcttcaacatcagctccccgacctgcctgatcaaccgcgtccagcggttccgcggcgcggagcagcagatcaagttcatctgccagcgggtggacatggacatcaccgtgtactgcaacgggctgaagaaggtcatcctcaccaagacgctgatcatcggccagtgcatctacaccttcaccagcatcttctccctgatccccggcgtggcccacagcctcgccgtggagctgtgcgtccccgggctgcacggctgggccaccatgctcctgctgctgacgttctgcttcgggtggatcctcatccccttcttctccatgatcctgctgaagatcctcatcgccttcgcgtacctgtgcagcaagtacaacaccgacagcaagttcaagatcctgatcgagaaggtgaagaaggagtaccagaagaccatgggctccatggtgtgcgaggtctgccactacgagtgcgagaccgccaaggagctcgagagccaccgcaagtcctgccccatggggagctgcccctactgcctgaacccggccgaggccacgacctccgccctgcaggcgcacttcaaggtgtgcaagctcaccagccggttccaggacaacctgcgcaagtccctgggcgcctacgagcccaagcagggctgctaccggaccctcagcctgttccgctaccggtcccgcttcttcgtggggttcatctggtgcctgctcctggtcctggagctcatcgtgtgggccgccagcgcggagacgcagaacctgaactccggctggaccgacaccgcccacgggagcggcatcatccccatgcggaccgacctggagctcgacttctccctgccgagctccgccagctacacgtaccgccgccagctgcagaaccccgccaacgagcaggagaagatccccttccacctccagatctccaagcaggtcatccacgccgagatccagcacctgggccactggatggacgggaccttcaacctgaagaccgcgttccactgctacggcagctgcgagaagtacgcctacccctggcagaccgccgggtgcttcatcgagaaggactacgagtacgagagcggctgggggtgcaacccgcccgactgccccggcgtgggcacggggtgcaccgcctgcggcgtgtacctcgacaagctgaagtccgtggggaaggccttcaagatcgtcagcctgcggtacacccgcaaggcgtgcatccagctcggcaccgagcagacgtgcaagtccgtggacagcaacgactgcctggtgaccacctccgtcaaggtgtgcctgatcgggaccgtgagcaagttccagccctccgacacgctcctgttcctgggcccgctcgagcagggcgggctgatcttcaagcagtggtgcaccacgacctgccagttcggcgaccccggggacatcatgagcacccccgtcggcatgaagtgccccgagctgaacgggtccttccggaagaagtgcgccttcgccaccaccccggtgtgccagttcgacggcaacaccctcagcggctacaagcgcatgatcgccacgaaggactccttccagagcttcaacgtgaccgagccccacatctccgccagctccctggagtggatcgaccccgacagctccctgcgggaccacatcaacgtcatcgtggggcgcgacctcagcttccaggacctgtccgagaccccctgccaggtggacctggcgaccaccagcatcgacggcgcctgggggagcggcgtcgggttcaacctcgtgtgctccgtgagcctgacggagtgctccaccttcctgaccagcatcaaggcctgcgactccgccatgtgctacggcagcaccacggcgaacctcctgcggggccagaacaccgtccacatcgtggggaagggcgggcactccggcagcaagttcatgtgctgccacgacaccaagtgctccagcaccggcctggtggccgccgccccgcacctcgaccgcgtcacggggtacaaccaggccgactccgacaagatcttcgacgacggcgcgcccgagtgcgggatcagctgctggttcaccaagtccggcgagtggatcctgggggtgctgaacggcaactggatggtggtcgccgtgctcgtggccctgttcatcctgagcatcttcctcttcaccctgtgctgcccccggcgcccctcctacgccaaggagcacaagccgtga

SEQ ID NO: 11803 - RNA, 3447 nt, synthetic construct
  misc_feature 1..3447: note = derived and/or modified CDS sequence (opt1) from PUUV(PUUV/Konnevesi/Mg_M105A/2005)__JQ319173.1__GP
  source 1..3447: mol_type = other RNA
atgggcaagagctcccccgtgtgcctgtacctcatcctgcaggggctgctcctgatcggcgccgtcaacgcccgcaacctgaacgagctcaagatggagtgcccgcacaccatcgggctgggccaggggctggtggtgggcagcgtcgagctcccgcccgtgcccatccagcaggtcgagtccctgaagctggagagctcctgcaacttcgacctccacaccagcacggcgggccagcagtccttcaccaagtggacctgggagaccaagagcgacctggccgagaacacgcaggcctccagcacctccttccagaccaagagctccgaggtgaacctgcgggggctctgcctgatccccaccctggtggtggagacggccgcccgcatgcggaagaccatcgcgtgctacgacctcagctgcaaccagaccgtctgccagcccaccgtgtacctgatgggccccatccagacgtgcctgaccaccaagtcctgcctcctggggctgggcgaccagcgcatccaggtgaactacgagcggacctactgcgtcagcgggcagctcgtggagggcgtgtgcttcaaccccatccacacgatggccctgtcccagccgagccacacctacgacatcgtcaccgtgatggtgcgctgcttcctggtcatcaagaaggtgacctccggcgacagcatgaagatcgagaagaacttcgagacgctcgtgcagaagaccgggtgcaccgccaacagcttccagggctactacatctgcctggtcgggtccagctccgagcccctgtacgtgcccaccctcgacgactaccggagcgccgaggtgctgtcccgcatggcgttcgcgccccacggcgaggaccacgacatcgagaagaacgccatcagcgccctgcggatcgccggcaaggtcacggggaaggccccgtccaccgagagctccgacaccgtgcagggcatcgccttcagcgggagccccctctacaccagcacgggcgtcctgaccgccaaggacgaccccgtgtacatctgggcccccgggatcatcatggagggcaaccactccgtgtgcgagaagaagaccctgccgctcacctggacgggcttcatccccctgcccggggagatcgagaagaccacccagtgcaccgtcttctgcacgctggccggccccggggcggactgcgaggcctacagcgagaccggcatcttcaacatctccagcccgacctgcctcatcaaccgcgtgcagcggttccgcggggccgagcagcagatcaagttcgtgtgccagcgggtcgacatggacatcaccgtgtactgcaacggcgtgaagaaggtcatcctgaccaagacgctggtgatcggccagtgcatctacaccttcacctccatcttcagcctcatccccgggatcgcccactccctggccgtggagctgtgcgtccccggcctccacgggtgggcgaccgtgctgctgctcctgacgttctgcttcggctgggtgctgatccccaccatcaccatgatcctgctcaagatcctgatcgccttcgcctacctgtgcagcaagtacaacaccgacagcaagttcaagatcctcgtcgagaaggtgaagaaggagtaccagaagacgatggggtccatggtgtgcgaggtctgccagtacgagtgcgagaccgccaaggagctggagagccaccgcaagtcctgcagcatcggctcctgcccgtactgcctgaaccccagcgaggccaccccctccgcgctccaggcccacttcaaggtgtgcaagctgaccagccggttccaggagaacctgaagaagtccctcacgatgtacgagcccatgcagggctgctaccgcaccctgagcctgttccggtaccgctcccggttcttcgtggggctcgtctggtgcatgctgctggtgctcgagctgatcgtgtgggccgccagcgcggagacccagaacctgaacgccggctggaccgacacggcccacgggtccggcatcatcccgatgaaggccgacctcgagctggacttcagcctgccctccagcgcctcctacacctaccgccggcagctccagaaccccgcgaacgagcaggagaagatcccgttccacctccagatcagcaagcaggtcatccacgccgagatccagcacctgggccactggatggacgccaccttcaacctgaagaccgccttccactgctacgggagctgcgagaagtacgcctacccctggcagacggcgggctgcttcgtggagaaggactacgagtacgagaccgggtggggctgcaacccgcccgactgccccggggtgggcaccggctgcaccgcctgcggggtctacctggacaagctgaagtccgtgggcaaggtgttcaagatcgtcagcctccgctacacgcgcaaggtgtgcatccagctggggaccgagcagacctgcaagaccgtggactccaacgactgcctgatcacgaccagcgtcaaggtgtgcctcatcggcaccatctccaagttccagcccagcgacaccctgctgttcctcgggcccctgcagcagggcggcctgatcttcaagcagtggtgcacgacgacctgccagttcggggaccccggcgacatcatgtccaccccgaccgggatgaagtgccccgagctcaacggcagcttccggaagaagtgcgccttcgccaccacccccgtgtgccagttcgacgggaacaccatctccggctacaagcgcatgatcgccaccaaggacagcttccagtccttcaacgtcacggagccccacatcagcacctccgcgctggagtggatcgacccggacagctccctgcgggaccacatcaacgtgatcgtgagccgcgacctctccttccaggacctgagcgagaccccctgccagatcgacctgaccgcctccgccatcgacggcgcctgggggagcggcgtcgggttcaacctcgtgtgcacgatcagcctgaccgagtgctccaccttcctgaccagcatcaaggcgtgcgacgccgccatgtgctacggctccacgaccaccaacctcgtgcgggggcagaacaccatccacgtcgtgggcaagggcgggcacagcggctccaagttcatgtgctgccacgacacgaagtgcagctccaccgggctggtggccgccgcgccccacctgaaccgcgtcaccggcttcaaccaggccgacagcgacaagatcttcgacgacggcgcccccgagtgcggggtgtcctgctggttcaagaagtccggcgagtgggtgctcggggtcctgaacggcaactggatggtggtggccgtcctgatcgccctcctgatcctgtccatcttcctcttcgcgctgtgctgcccgcggcgccccagctacaagaaggagcacaagccctga

SEQ ID NO: 11804 - RNA, 3447 nt, synthetic construct
  misc_feature 1..3447: note = derived and/or modified CDS sequence (opt1) from PUUV(PUUV/Konnevesi/Mg_M114B/2005)__JQ319175.1__GP
  source 1..3447: mol_type = other RNA
atgggcaagagctcccccgtgtgcctgtacctcatcctgcaggggctgctcctgttcggcgccgtcaacgcccgcaacctgaacgagctcaagatggagtgcccgcacaccatcgggctgggccaggggctggtggtgggcagcgtcgagctcccgcccgtgcccatccagcaggtcgagtccctgaagctggagagctcctgcaacttcgacctccacaccagcacggcgggccagcagtccttcaccaagtggacctgggagatcaagaacgacctggccgagaacacccaggccagctccacgagcttccagaccaagtccagcgaggtgaacctgcgggggctctgcctgatccccaccctggtggtggagaccgccgcccgcatgcggaagacgatcgcgtgctacgacctctcctgcaaccagaccgtctgccagcccaccgtgtacctgatgggccccatccagacctgcctgacgaccaagagctgcctcctggggctgggcgaccagcgcatccaggtgaactacgagcggacctactgcgtctccgggcagctcgtggagggcgtgtgcttcaaccccatccacaccatggccctgagccagccgtcccacacgtacgacatcgtcaccatcatggtgcgctgcttcctggtgatcaagaaggtcaccagcggcgacaacatgaagatcgagaagaacttcgagaccctcgtgcagaagacggggtgcaccgccaactccttccagggctactacatctgcctggtggggagcagctccgagcccctgtacgtccccaccctcgacgactaccggagcgccgaggtgctgtcccgcatggcgttcgcgccccacggcgaggaccacgacatcgagaagaacgccatcagcgccctgcggatcgccggcaaggtgaccgggaaggccccgtccacggagagctccgacaccgtccagggcatcgccttcagcgggagccccctctacaccagcaccggcgtgctgacggccaaggacgaccccgtctacatctgggcccccgggatcatcatggagggcaaccactccgtgtgcgagaagaagaccctgccgctcacctggaccggcttcatccccctgcccggggagatcgagaagacgacccagtgcaccgtgttctgcaccctggccggccccggggcggactgcgaggcctacagcgagacgggcatcttcaacatctccagcccgacctgcctcatcaaccgcgtccagcggttccgcggggccgagcagcagatcaagttcgtgtgccagcgggtggacatggacatcaccgtctactgcaacggcgtgaagaaggtgatcctgaccaagaccctggtcatcggccagtgcatctacacgttcacctccatcttcagcctcatccccgggatcgcccactccctggccgtggagctgtgcgtgcccggcctccacgggtgggcgaccgtcctgctgctcctgaccttctgcttcggctgggtgctgatccccacgatcaccatgatcctgctcaagatcctgatcgccttcgcctacctgtgcagcaagtacaacaccgactccaagttcaagatcctcgtggagaaggtcaagaaggagtaccagaagaccatggggagcatggtgtgcgaggtgtgccagtacgagtgcgagacggccaaggagctggagagccaccgcaagtcctgcagcatcggctcctgcccgtactgcctgaaccccagcgaggccaccccctccgcgctccaggcccacttcaaggtctgcaagctgaccagccggttccaggagaacctgaagaagtccctcaccatgtacgagcccatgcagggctgctaccgcacgctgagcctgttccggtaccgctcccggttcttcgtggggctcgtgtggtgcatgctgctggtcctcgagctgatcgtgtgggccgccagcgcggagacccagaacctgaacgccggctggaccgacaccgcccacgggtccggcatcatcccgatgaaggccgacctcgagctggacttcagcctgccctccagcgcctcctacacgtaccgccggcagctccagaaccccgcgaacgagcaggagaagatcccgttccacctccagatcagcaagcaggtcatccacgccgagatccagcacctgggccactggatggacgccaccttcaacctgaagaccgccttccactgctacgggtcctgcgagaagtacgcctacccctggcagaccgcgggctgcttcgtggagaaggactacgagtacgagacggggtggggctgcaacccgcccgactgccccggggtgggcaccggctgcaccgcctgcggggtgtacctggacaagctcaagagcgtcggcaaggtgttcaagatcgtgagcctgcgctacacccgcaaggtctgcatccagctggggacggagcagacctgcaagaccgtggactccaacgactgcctgatcaccacgagcgtgaaggtctgcctcatcggcaccatctccaagttccagcccagcgacaccctgctgttcctcgggcccctgcagcagggcggcctgatcttcaagcagtggtgcaccacgacctgccagttcggggaccccggcgacatcatgtccaccccgaccgggatgaagtgccccgagctcaacggcagcttccggaagaagtgcgccttcgccacgacccccgtgtgccagttcgacgggaacaccatctccggctacaagcgcatgatcgccaccaaggacagcttccagtccttcaacgtgaccgagccccacatcagcacgtccgcgctggagtggatcgacccggacagctccctgcgggaccacatcaacgtcatcgtgagccgcgacctctccttccaggacctgagcgagaccccctgccagatcgacctgatcgcctccgccatcgacggcgcctgggggagcggcgtggggttcaacctcgtctgcaccgtgtccctgaccgagtgcagcacgttcctgaccagcatcaaggcgtgcgacgccgccatgtgctacggctccaccaccatcaacctcatccgggggcagaacacgatccacgtggtcggcaagggcgggcacagcggctccaagttcatgtgctgccacgacaccaagtgcagctccaccgggctggtggccgccgcgccccacctggaccgcgtgaccggcttcaaccaggccgacagcgacaagatcttcgacgacggcgcccccgagtgcggggtctcctgctggttcaagaagtccggcgagtgggtgctcggggtgctgaacggcaactggatggtcgtggccgtgctgatcgccctcctgatcctgtccatcttcctcttcgcgctgtgctgcccgcggcgccccagctacaagaaggagcacaagccctga

SEQ ID NO: 11805 - RNA, 3447 nt, synthetic construct
  misc_feature 1..3447: note = derived and/or modified CDS sequence (opt1) from PUUV(PUUV/Konnevesi/Mg_M78B/2005)__JQ319174.1__GP
  source 1..3447: mol_type = other RNA
atgggcaagagctcccccgtgtgcctgtacctcatcctgcaggggctgctcctgttcggcgccgtcaacgcccgcaacctgaacgagctcaagatggagtgcccgcacaccatcgggctgggccaggggctggtggtgggcagcgtcgagctcccgcccgtgcccatccagcaggtcgagtccctgaagctggagagctcctgcaacttcgacctccacaccagcacggcgggccagcagtccttcaccaagtggacctgggagatcaagaacgacctggccgagaacacccaggccagctccacgagcttccagaccaagtccagcgaggtgaacctgcgggggctctgcctgatccccaccctggtggtggagaccgccgcccgcatgcggaagacgatcgcgtgctacgacctctcctgcaaccagaccgtctgccagcccaccgtgtacctgatgggccccatccagacctgcctgacgaccaagagctgcctcctggggctgggcgaccagcgcatccaggtgaactacgagcggacctactgcgtctccgggcagctcgtggagggcgtgtgcttcaaccccatccacaccatggccctgagccagccgtcccacacgtacgacatcgtcaccatcatggtgcgctgcttcctggtgatcaagaaggtcaccagcggcgacaacatgaagatcgagaagaacttcgagaccctcgtgcagaagacggggtgcaccgccaacggcttccaggggtactacatctgcctggtgggctccagcagcgagcccctgtacgtccccaccctcgacgactaccggtccgccgaggtgctgagccgcatggcgttcgcgccccacggcgaggaccacgacatcgagaagaacgccatctccgccctgcggatcgccgggaaggtgaccggcaaggccccgagcacggagtccagcgacaccgtccaggggatcgccttctccggcagccccctctacacctccaccggggtgctgacggccaaggacgaccccgtctacatctgggcccccggcatcatcatggagggcaaccacagcgtgtgcgagaagaagaccctgccgctcacctggaccgggttcatccccctgcccggcgagatcgagaagacgacccagtgcaccgtgttctgcaccctggccgggcccggcgcggactgcgaggcctactccgagacggggatcttcaacatcagctccccgacctgcctcatcaaccgcgtccagcggttccgcggcgccaagcagcagatcaagttcgtgtgccagcgggtggacatggacatcaccgtctactgcaacggcgtgaagaaggtgatcctgaccaagaccctggtcatcgggcagtgcatctacacgttcaccagcatcttctccctcatccccggcatcgcccacagcctggccgtggagctgtgcgtgcccgggctccacggctgggcgaccgtcctgctgctcctgaccttctgcttcgggtgggtgctgatccccacgatcaccatgatcctgctcaagatcctgatcgccttcgcctacctgtgctccaagtacaacaccgacagcaagttcaagatcctcgtggagaaggtcaagaaggagtaccagaagaccatgggctccatggtgtgcgaggtgtgccagtacgagtgcgagacggccaaggagctggagagccaccgcaagagctgctccatcggcagctgcccgtactgcctgaacccctccgaggccacccccagcgcgctccaggcccacttcaaggtctgcaagctgacctcccggttccaggagaacctgaagaagtccctcaccatgtacgagcccatgcaggggtgctaccgcacgctgagcctgttccggtaccgcagccggttcttcgtgggcctcgtgtggtgcatgctgctggtcctcgagctgatcgtgtgggccgcctccgcggagacccagaacctgaacgccgggtggaccgacaccgcccacggcagcggcatcatcccgatgaaggccgacctcgagctggacttctccctgcccagctccgccagctacacgtaccgccggcagctccagaaccccgcgaacgagcaggagaagatcccgttccacctccagatctccaagcaggtcatccacgccgagatccagcacctggggcactggatggacgccaccttcaacctgaagaccgccttccactgctacggcagctgcgagaagtacgcctacccctggcagaccgcggggtgcttcgtggagaaggactacgagtacgagacgggctgggggtgcaacccgcccgactgccccggcgtgggcaccgggtgcaccgcctgcggcgtgtacctggacaagctgaagtccgtcgggaaggtgttcaagatcgtgagcctccgctacacccgcaaggtctgcatccagctgggcacggagcagacctgcaagaccgtggacagcaacgactgcctgatcaccacgtccgtgaaggtctgcctcatcgggaccatcagcaagttccagccctccgacaccctgctgttcctcggccccctgcagcagggcgggctgatcttcaagcagtggtgcaccacgacctgccagttcggcgaccccggggacatcatgagcaccccgaccggcatgaagtgccccgagctcaacgggtccttccggaagaagtgcgccttcgccacgacccccgtgtgccagttcgacggcaacaccatcagcggctacaagcgcatgatcgccaccaaggactccttccagagcttcaacgtgaccgagccccacatctccacgagcgcgctggagtggatcgacccggactccagcctgcgggaccacatcaacgtcatcgtgtcccgcgacctcagcttccaggacctgtccgagaccccctgccagatcgacatgaccgccagcgccatcgacggggcctggggctccggggtgggcttcaacctggtctgcaccgtgagcctcacggagtgctccaccttcctgaccagcatcaaggcgtgcgacgccgccatgtgctacgggagcaccacgaccaacctggtgcggggccagaacaccatccacgtcgtgggcaagggcgggcactccgggagcaagttcatgtgctgccacgacaccaagtgctccagcaagggcctcgtggccgccgcgccccacctggaccgcgtcacgggcttcaaccaggccgactccgacaagatcttcgacgacggggcccccgagtgcggcgtgagctgctggttcaagaagtccggggagtgggtgctgggcgtcctcaacgggaactggatggtggtggccgtcctgatcgccctgctcatcctgagcatcttcctgttcgcgctctgctgcccgcggcgcccctcctacaagaaggagcacaagccctga

SEQ ID NO: 11806 - RNA, 3447 nt, synthetic construct
  misc_feature 1..3447: note = derived and/or modified CDS sequence (opt1) from PUUV(PUUV/Konnevesi/Mg_O78A/2005)__JQ319172.1__GP
  source 1..3447: mol_type = other RNA
atgggcaagagctcccccgtgtgcctgtacctcatcctgcaggggctgctcctgttcggcgccgtcaacgcccgcaacctgaacgagctcaagatggagtgcccgcacaccatcgggctgggccaggggctggtggtgggcagcgtcgagctcccgcccgtgcccatccagcaggtcgagtccctgaagctggagagctcctgcaacttcgacctccacaccagcacggcgggccagcagtccttcaccaagtggacctgggagatcaagagcgacctggccgagaacacccaggcctccagcacgtccttccagaccaagagctccgaggtgaacctgcgggggctctgcctgatccccaccctggtggtggagaccgccgcccgcatgcggaagacgatcgcgtgctacgacctcagctgcaaccagaccgtctgccagcccaccgtgtacctgatgggccccatccagacctgcctgacgaccaagtcctgcctcctggggctgggcgaccagcgcatccaggtgaactacgagcggacctactgcgtcagcgggcagctcgtggagggcgtgtgcttcaaccccatccacaccatggccctgtcccagccgagccacacgtacgacatcgtcaccatcatggtgcgctgcttcctggtgatcaagaaggtcacctccggcgacagcatgaagatcgagaagaacttcgagaccctcgtgcagaagacggggtgcaccgccaacagcttccagggctactacatctgcctggtggggtccagctccgagcccctgtacgtccccaccctcgacgactaccggagcgccgaggtgctgtcccgcatggcgttcgcgccccacggcgaggaccacgacatcgagaagaacgccatcagcgccctgcggatcgccggcaaggtgaccgggaaggccccgtccacggagagctccgacaccgtccagggcatcgccttcagcgggagccccctctacaccagcaccggcgtgctgacggccaaggacgaccccgtctacatctgggcccccgggatcatcatggagggcaaccactccgtgtgcgagaagaagaccctgccgctcacctggaccggcttcatccccctgcccggggagatcgagaagacgacccagtgcaccgtgttctgcaccctggccggccccggggcggactgcgaggcctacagcgagacgggcatcttcaacatctccagcccgacctgcctcatcaaccgcgtccagcggttccgcggggccgagcagcagatcaagttcgtgtgccagcgggtggacatggacatcaccgtctactgcaacggcgtgaagaaggtgatcctgaccaagaccctggtcatcggccagtgcatctacacgttcacctccatcttcagcctcatccccgggatcgcccactccctggccgtggagctgtgcgtgcccggcctccacgggtgggcgaccgtcctgctgctcctgaccttctgcttcggctgggtgctgatccccacgatcaccatgatcctgctcaagatcctgatcgccttcgcctacctgtgcagcaagtacaacaccgacagcaagttcaagatcctcgtggagaaggtcaagaaggagtaccagaagaccatggggtccatggtgtgcgaggtgtgccagtacgagtgcgagacggccaaggagctggagagccaccgcaagtcctgcagcatcggctcctgcccgtactgcctgaaccccagcgaggccaccccctccgcgctccaggcccacttcaaggtctgcaagctgaccagccggttccaggagaacctgaagaagtccctcaccatgtacgagcccatgcagggctgctaccgcacgctgagcctgttccggtaccgctcccggttcttcgtggggctcgtgtggtgcatgctgctggtcctcgagctgatcgtgtgggccgccagcgcggagacccagaacctgaacgccggctggaccgacaccgcccacgggtccggcatcatcccgatgaaggccgacctcgagctggacttcagcctgccctccagcgcctcctacacgtaccgccggcagctccagaaccccgcgaacgagcaggagaagatcccgttccacctccagatcagcaagcaggtcatccacgccgagatccagcacctgggccactggatggacgccaccttcaacctgaagaccgccttccactgctacgggagctgcgagaagtacgcctacccctggcagaccgcgggctgcttcgtggagaaggactacgagtacgagacggggtggggctgcaacccgcccgactgccccggggtgggcaccggctgcaccgcctgcggggtgtacctggacaagctgaagtccgtcggcaaggtgttcaagatcgtgagcctccgctacacccgcaaggtctgcatccagctggggacggagcagacctgcaagaccgtggactccaacgactgcctgatcaccacgagcgtgaaggtctgcctcatcggcaccatctccaagttccagcccagcgacaccctgctgttcctcgggcccctgcagcagggcggcctgatcttcaagcagtggtgcaccacgacctgccagttcggggaccccggcgacatcatgtccaccccgaccgggatgaagtgccccgagctcaacggcagcttccggaagaagtgcgccttcgccacgacccccgtgtgccagttcgacgggaacaccatctccggctacaagcgcatgatcgccaccaaggacagcttccagtccttcaacgtgaccgagccccacatcagcacgtccgcgctggagtggatcgacccggacagctccctgcgggaccacatcaacgtcatcgtgagccgcgacctctccttccaggacctgagcgagaccccctgccagatcgacctgaccgcctccgccatcgacggcgcctgggggagcggcgtggggttcaacctcgtctgcaccatcagcctgacggagtgctccaccttcctgaccagcatcaaggcgtgcgacgccgccatgtgctacggctccaccacgaccaacctcgtgcgggggcagaacaccatccacgtggtcggcaagggcgggcacagcggctccaagttcatgtgctgccacgacaccaagtgcagctccacggggctggtggccgccgcgccccacctgaaccgcgtgaccggcttcaaccaggccgacagcgacaagatcttcgacgacggcgcccccgagtgcggggtctcctgctggttcaagaagtccggcgagtgggtgctcggggtgctgaacggcaactggatggtcgtggccgtgctgatcgccctcctgatcctgtccatcttcctcttcgcgctgtgctgcccgcggcgccccagctacaagaaggagcacaagccctga

SEQ ID NO: 11807 - RNA, 3447 nt, synthetic construct
  misc_feature 1..3447: note = derived and/or modified CDS sequence (opt1) from PUUV(PUUV/Pieksamaki/human_kidney/2008)__JN831951.1__GP
  source 1..3447: mol_type = other RNA
atgggcaagagctcccccgtgtgcctgtacctcatcctgcaggggctgctcctgttcggcgccgtcaacgcccgcaacctgaacgagctcaagatggagtgcccgcacaccatcgggctgggccaggggctggtggtgggcagcgtcgagctcccgcccgtgcccatccagcaggtcgagtccctgaagctggagagctcctgcaacttcgacctccacaccagcacggcgggccagcagtccttcaccaagtggacctgggagatcaagagcgacctggccgagaacacccaggcctccagcacgtccttccagaccaagagctccgaggtgaacctgcgggggctctgcctgatccccaccctggtggtggagaccgccgcccgcatgcggaagacgatcgcgtgctacgacctcagctgcaaccagaccgtctgccagcccaccgtgtacctgatgggccccatccagacctgcctgacgaccaagtcctgcctcctggggctgggcgaccagcgcatccaggtgaactacgagcggacctactgcgtcagcgggcagctcgtggagggcgtgtgcttcaaccccatccacaccatggccctgtcccagccgagccacacgtacgacgtcgtgaccatcatggtgcgctgcttcctggtcatcaagaaggtgacctccggcgacagcatgaagatcgagaagaacttcgagaccctcgtgcagaagacggggtgcaccgccaacaacttccagggctactacatctgcctggtcgggagctccagcgagcccctgtacgtgcccaccctcgacgactaccggtccgccgaggtgctgagccgcatggcgttcgcgccccacggcgaggaccacgacatcgagaagaacgccatctccgccctgcggatcgccggcaaggtcaccgggaaggccccgagcacggagtccagcgacaccgtgcagggcatcgccttctccgggagccccctctacacctccaccggcgtcctgacggccaaggacgaccccgtgtacatctgggcccccgggatcatcatggagggcaaccacagcgtgtgcgagaagaagaccctgccgctcacctggaccggcttcatccccctgcccggggagatcgagaagacgacccagtgcaccgtcttctgcaccctggccggccccggggcggactgcgaggcctactccgagacgggcatcttcaacatcagctccccgacctgcctcatcaaccgcgtgcagcggttccgcggggccgagcagcagatcaagttcgtgtgccagcgggtcgacatggacatcaccgtgtactgcaacggcgtgaagaaggtcatcctgaccaagaccctggtgatcggccagtgcatctacacgttcaccagcatcttctccctcatccccgggatcgcccacagcctggccgtggagctgtgcgtccccggcctccacgggtgggcgaccgtgctgctgctcctgaccttctgcttcggctgggtgctgatccccacgatcaccatgatcctgctcaagatcctgatcgccttcgcctacctgtgctccaagtacaacaccgacagcaagttcaagatcctcgtcgagaaggtgaagaaggagtaccagaagaccatggggagcatggtgtgcgaggtctgccagtacgagtgcgagacggccaaggagctggagtcccaccgcaagagctgctccatcggcagctgcccgtactgcctgaacccctccgaggccacccccagcgcgctccaggcccacttcaaggtgtgcaagctgacctcccggttccaggagaacctgaagaagtccctcaccatgtacgagcccatgcagggctgctaccgcacgctgagcctgttccggtaccgcagccggttcttcgtggggctcgtctggtgcatgctgctggtgctcgagctgatcgtgtgggccgcctccgcggagacccagaacctgaacgccggctggaccgacaccgcccacgggagcggcatcatcccgatgaaggccgacctcgagctggacttctccctgcccagctccgccagctacacgtaccgccggcagctccagaaccccgcgaacgagcaggagaagatcccgttccacctccagatctccaagcaggtcatccacgccgagatccagcacctgggccactggatggacgccaccttcaacctgaagaccgccttccactgctacgggagctgcgagaagtacgcctacccctggcagaccgcgggctgcttcgtggagaaggactacgagtacgagacggggtggggctgcaacccgcccgactgccccggggtgggcaccggctgcaccgcctgcggggtctacctggacaagctcaagagcgtgggcaaggtgttcaagatcgtctccctgcgctacacccgcaaggtgtgcatccagctggggacggagcagacctgcaagaccgtggacagcaacgactgcctgatcaccacgtccgtcaaggtgtgcctcatcggcaccatcagcaagttccagccctccgacaccctgctgttcctcgggcccctgcagcagggcggcctgatcttcaagcagtggtgcaccacgacctgccagttcggggaccccggcgacatcatgagcaccccgaccgggatgaagtgccccgagctcaacggctccttccggaagaagtgcgccttcgccacgacccccgtgtgccagttcgacgggaacaccatcagcggctacaagcgcatgatcgccaccaaggactccttccagagcttcaacgtcaccgagccccacatctccacgagcgcgctggagtggatcgacccggactccagcctgcgggaccacatcaacgtgatcgtgtcccgcgacctcagcttccaggacctgtccgagaccccctgccagatcgacctgaccgccagcgccatcgacggcgcctgggggtccggcgtcgggttcaacctcgtgtgcaccatcagcctgacggagtgcagcaccttcctgacctccatcaaggcgtgcgacgccgccatgtgctacggcagcaccacgaccaacctcgtgcgggggcagaacaccatccacgtcgtgggcaagggcgggcactccggcagcaagttcatgtgctgccacgacaccaagtgctccagcacggggctggtggccgccgcgccccacctggaccgcgtcaccggcttcaaccaggccgactccgacaagatcttcgacgacggcgcccccgagtgcggggtgagctgctggttccggaagtccggcgagtgggtgctcggggtcctgaacggcaactggatggtggtggccgtcctgatcgccctcctgatcctgagcatcttcctcttcgcgctgtgctgcccgcgccggccctcctacaagaaggagcacaagccctga

SEQ ID NO: 11808 - RNA, 3447 nt, synthetic construct
  misc_feature 1..3447: note = derived and/or modified CDS sequence (opt1) from PUUV(Samara_49/CG/2005)__AB433850.2__GP
  source 1..3447: mol_type = other RNA
atgggcaagctgagccccgtgtgcctctacctgctgctccaggggctgctgctctgcaagaccggcaccgcccgcaacctgaacgagctgaagatggagtgcccgcacacgatcgggctcggccaggggctggtcgtgggctccgtggagctgccgcccgtccccatccagcaggtcgagaccctcaagctggagagctcctgcaacttcgacctgcacaccagcaccgccggccagcaggcgttcacgaagtggacctgggagatcaagggggacctcgccgagaacacccaggcctccagcacctccttccagaccaagagctccgaggtgaacctgcggggcctgtgcctcatccccaccctggtgatcgagaccgccgcccgcatgcggaagaccatcgcgtgctacgacctgagctgcaaccagacggtgtgccagcccaccgtgtacctcatggggcccatccagacctgcatcaccacgaagtcctgcctgctgggcctcggggaccagcgcatccaggtcaactacgagaagacctactgcgtgagcggccagctggtggagggcgtctgcttcaaccccatccacaccatggccctgtcccagccgagccacacctacgacatcgtgacgatgatggtgcggtgcttcctcgtcatcaagaaggtgacctccggggacagcatgaagatcgagaagaacttcgagaccctggtgcagaagaacggctgcaccgccaactccttccaggggtactacatctgcctgatcggcagctccagcgagcccctctacgtccccacgctggacgactaccgcagcgccgaggtgctgtcccggatggcgttcgcgccccacggcgaggaccacgacgtggagaagaacgccatcagcgccctccgcatcgccgggaaggtcaccggcaaggccccgtccaccgagagctccgacaccgtgcaggggatcgccttcagcggcagccccctgtacacgagcaccggggtgctgaccgccaaggacgaccccgtctacatctgggcccccggcatcatcatggagggcaaccactccgtgtgcgagaagaagaccctcccgctgacgtggaccgggttcatcagcctgcccggcgagatcgagaagaccacccagtgcacggtcttctgcaccctcgccgggcccggcgcggactgcgaggcctactccgagaccgggatcttcaacatcagctcccccacgtgcctgatcaaccgggtgcagcgcttccggggcgccgagcagcagatcaagttcgtgtgccagcgcgtcgacatggacatcaccgtgtactgcaacggcgtgaagaaggtcatcctgacgaagaccctcgtgatcgggcagtgcatctacaccttcaccagcatcttctccctgatcccgggcgtggcccacagcctggccgtcgagctctgcgtgcccgggctgcacggctgggcgacgatgctgctcctgctgaccttctgcttcgggtgggtgctgatccccaccatcaccatgatcctcctgaagatcctgatcgccttcgcctacctctgctccaagtacaacacggacagcaagttccggatcctgatcgagaaggtcaagcgcgagtaccagaagaccatgggctccatggtgtgcgaggtgtgccagtacgagtgcgagaccgccaaggagctggagagccacaagaagtcctgctccatcggcagctgcccctactgcctcaacccgtccgaggccaccacgagcgcgctgcaggcccacttcaaggtctgcaagctgacctcccggttccaggagaacctccgcaagagcctgaccgtgtacgagcccatgcaggggtgctaccggaccctgtccctcttccgctaccggagccgcttcttcgtgggcctggtctggtgcgtgctgctcgtgctggagctgatcgtctgggccgcctccgcggagacgcagaacctcaacgccgggtggaccgacaccgcccacggcagcggcatcatccccatgaagaccgacctggagctggacttctccctccccagctccgccagctacacgtaccggcgccagctgcagaacccggccaacgagcaggagaacatccccttccacctccagatctccaagcaggtcatccacgcggagatccagcacctcgggcactggatggacgccaccttcaacctgaagaccgccttccactgctacggcagctgcgagaagtacgcctacccctggcagaccgccgggtgcttcgtggagaaggactacgagtacgagacgggctgggggtgcaacccgcccgactgccccggcgtgggcaccgggtgcaccgcgtgcggcgcctacctggacaagctcaagtccgtggggaaggtgttcaagatcgtcagcctgcgctacacccggaaggtgtgcatccagctgggcacggagcagacctgcaagaccgtggacagcaacgactgcctcatcaccacgtccgtcaaggtgtgcctgatcgggaccatcagcaagttccagccctccgacaccctgctgttcctgggcccgctgcagcagggcgggctcatcttcaagcagtggtgcaccacgacctgccagttcggcgaccccggggacatcatgagcacccccaccggcatgaagtgccccgacctgaacgggtccttccgcaagaagtgcgccttcgccaccacgccggtgtgccagttcgacggcaacaccatcagcggctacaagcggatgatcgccaccaaggactccttccagagcttcaacgtcaccgagccccacatctccgcgagcgccctggagtggatcgaccccgactccagcctccgcgaccacatcaacgtgatcgtgtcccgggacctgagcttccaggacctgtccgagacgccctgccagatcgacctcagcaccgcctccatcgacggggcctggggcagcggggtcggcttcaacctggtgtgcaccgtgtccctgaccgagtgcagcgcgttcctcacgagcatcaaggcctgcgacgccgccatgtgctacgggtccaccaccgccaacctgatccgcggccagaacaccatccacatcgtcggcaagggcgggcacagcgggtccaagttcatgtgctgccacgacacgaagtgcagcaccaccggcctggtggcggccgccccgcacctcgaccgggtgaccggctacaaccaggccgactccgacaagatcttcgacgacggggcccccgagtgcggcatgagctgctggttcaagaagtccggggagtggatcctgggcgtcctgaacgggaactggatggtggtggcggtcctcatcgccctgctggtgctcagcatcctgctgttcacgctctgctgcccccgccggccctcctaccgcaaggagcacaagccgtga

SEQ ID NO: 11809 - RNA, 3447 nt, synthetic construct
  misc_feature 1..3447: note = derived and/or modified CDS sequence (opt1) from PUUV(Samara_94/CG/2005)__AB433852.2__GP
  source 1..3447: mol_type = other RNA
atgggcaagctgagccccgtgtgcctctacctgctgctccaggggctgctgctctgcaacaccggcaccgcccgcaacctgaacgagctgaagatcgagtgcccgcacacgatcgggctcggccaggggctggtcgtgggctccgtggagctgccgcccgtccccatccagcaggtcgagaccctcaagctggagagctcctgcaacttcgacctgcacaccagcaccgccggccagcaggcgttcacgaagtggacctgggagatcaagggggacctcgccgagaacacccaggcctccagcacctccttccagacgaagtcctccgaggtgaacctgcggggcctgtgcctcatccccaccctggtgatcgagaccgccgcccgcatgcggaagaccatcgcgtgctacgacctgagctgcaaccagacggtgtgccagcccaccgtgtacctcatggggcccatccagacctgcatcaccacgaagtcctgcctgctgggcctcggggaccagcgcatccaggtcaactacgagaagacctactgcgtgagcggccagctggtggagggcgtctgcttcaaccccatccacaccatggccctgtcccagccgagccacacctacgacatcgtgacgatgatggtgcggtgcttcctcatcatcaagaaggtcacctccggggacagcatgaagatcgagaagaacttcgagaccctggtgcagaagaacgactgcaccgccaactccttccagggctactacatctgcttcatcgggagctccagcgagcccctgtacgtgcccacgctcgacgactaccgcagcgccgaggtcctgtcccggatggcgttcgcgccccacggcgaggaccacgacgtggagaagaacgccatcagcgccctgcgcatcgccggcaaggtgaccgggaaggccccgtccaccgagagctccgacaccgtccagggcatcgccttcagcgggagccccctctacacgagcaccggcgtgctggccgccaaggacgaccccgtgtacatctgggcccccgggatcatcatggagggcaaccactccatctgcgagaagaagaccctgccgctcacctggacgggcttcatcagcctgcccggggagatcgagaagaccacccagtgcaccgtcttctgcacgctggcgggccccggggccgactgcgaggcctactccgagaccggcatcttcaacatcagctccccgacctgcctcatcaaccgggtgcagcgcttccgcggggccgagcagcagatcaagttcgtctgccagcgggtggacatggacatcaccgtgtactgcaacggcgtcaagaaggtgatcctgaccaagacgctggtgatcggccagtgcatctacaccttcaccagcatcttctccctcatccccggggtcgcccacagcctggcggtggagctgtgcgtgcccggcctccacgggtgggccaccatgctgctgctcctgacgttctgcttcggctgggtcctgatccccaccatcaccatgatcctgctcaagatcctgatcgccttcgcctacctgtgctccaagtacaacaccgacagcaagttccggatcctcatcgagaaggtgaagaaggagtaccagaagacgatggggtccatggtgtgcgaggtctgccagtacgagtgcgagaccgccaaggagctggagagccaccgcaagagctgctccatcggcagctgcccctactgcctgaacccgtccgaggcgaccaccagcgccctccaggcccacttcaaggtgtgcaagctgacgtcccggttccaggagaacctgcgcaagagcctcaccgtgtacgagcccatgcagggctgctaccggaccctgtccctgttccgctaccggagccgcttcttcgtcgggctcgtgtggtgcgtgctgctggtcctcgagctgatcgtgtgggccgcgtccgccgagacccagaacctgaacgccggctggacggacaccgcccacgggagcggcatcatccccatgaagaccgacctcgagctggacttctccctgcccagctccgccagctacacctaccggcgccagctccagaacccggcgaacgagcaggagaacatccccttccacctccagatctccaagcaggtcatccacgccgagatccagcacctgggccactggatggacgccacgttcaacctgaagaccgccttccactgctacgggagctgcgagaagtacgcctacccctggcagaccgcgggctgcttcgtggagaaggactacgagtacgagaccgggtggggctgcaacccgcccgactgccccggggtgggcacgggctgcaccgcctgcggggcctacctggacaagctgaagtccgtgggcaaggtcttcaagatcgtgagcctccgctacacccggaaggtgtgcatccagctggggaccgagcagacgtgcaagaccgtcgacagcaacgactgcctgatcaccacctccgtgaaggtgtgcctcatcggcacgatcagcaagttccagccctccgacaccctgctgttcctcgggccgctgcagcagggcggcctgatcttcaagcagtggtgcaccaccacgtgccagttcggggaccccggcgacatcatgagcacccccaccgggatgaagtgccccgacctcaacggctccttccgcaagaagtgcgccttcgccaccaccccggtctgccagttcgacgggaacacgatcagcggctacaagcggatgatcgcgaccaaggactccttccagagcttcaacgtgaccgagccccacatctccgccagcgccctggagtggatcgaccccgactccagcctgcgcgaccacatcaacgtgatcgtctcccgggacctcagcttccaggacctgtccgagaccccctgccagatcgacctgagcacgacctccatcgacggcgcctgggggagcggcgtggggttcaacctcgtgtgcaccgtctccctgaccgagtgcagcgcgttcctgacgagcatcaaggcctgcgacgccgccatgtgctacggctccaccaccgccaacctcatccgcgggcagaacaccatccacatcgtgggcaagggcgggcacagcggctccaagttcatgtgctgccacgacacgaagtgcagcaccaccgggctggtggcggccgccccgcacctggaccgggtcaccggctacaaccaggccgactccgacaagatcttcgacgacggcgcccccgagtgcgggatgagctgctggttcaagaagtccggcgagtggatcctcggggtgctgaacggcaactggatggtggtcgcggtgctgatcgccctcctggtgctgagcatcctcctgttcacgctgtgctgcccccgccggccctcctaccgcaaggagcacaagccgtga

SEQ ID NO: 11810 - RNA, 3447 nt, synthetic construct
  misc_feature 1..3447: note = derived and/or modified CDS sequence (opt1) from PUUV(Sotkamo)__NC_005223.1__GP
  source 1..3447: mol_type = other RNA
atgggcaagagctcccccgtgtgcctgtacctcatcctgcaggggctgctcctgttcgacaccgtcaacgccaagaacctgaacgagctcaagatggagtgcccgcacaccatcggcctggggcagggcctggtggtggggagcgtcgagctcccgcccgtgcccatccagcagatcgagtccctgaagctggagagctcctgcaacttcgacctccacacgagcaccgccggccagcagtccttcaccaagtggacctgggagacgaagggcgacctggcggagaacacccaggccagctccaccagcttccagaccaagtccagcgaggtgaacctgcgcgggctctgcctgatccccacgctggtcgtggagaccgccgcccggatgcgcaagaccatcgcctgctacgacctctcctgcaaccagaccgtgtgccagcccacggtctacctgatgggccccatccagacctgcctgaccaccaagagctgcctcctggggctgggcgaccagcggatccaggtgaactacgagcgcacgtactgcgtgtccgggcagctcgtcgagggcgtgtgcttcaaccccatccacaccatggcgctgagccagccgtcccacacctacgacatcgtgaccatcatggtccggtgcttcctggtgatcaagaaggtgacgagcggcgactccatgaagatcgagaagaacttcgagaccctcgtccagaagaccgggtgcaccgccaacggcttccaggggtactacatctgcctgatcggcagcagctccgagcccctgtacgtgcccacgctcgacgactaccgcagcgccgaggtgctgtcccggatggccttcgcgccccacggcgaggaccacgacatcgagaagaacgccgtcagcgccctgcgcatcgccgggaaggtgaccggcaaggccccgtccaccgagagctccgacaccgtgcaggggatcgcgttcagcggcagccccctctacacgagcaccggggtcctgaccgccaaggacgaccccgtgtacgtctgggcccccggcatcatcatggagggcaaccactccgtgtgcgagaagaagaccctgccgctcacgtggaccgggttcatccccctgcccggcgagatcgagaagaccacccagtgcacggtgttctgcaccctggccgggcccggcgccgactgcgaggcgtacagcgagaccgggatcttcaacatctccagcccgacctgcctcatcaaccgggtccagcgcttccggggcgccgagcagcagatcaagttcgtgtgccagcgcgtggacatggacatcaccgtctactgcaacggcgtgaagaaggtgatcctgacgaagaccctggtcatcgggcagtgcatctacaccttcacctccatcttcagcatgatccccggcatcgcccactccctcgccgtggagctgtgcgtgcccgggctgcacggctgggccacggtcctcctgctgctcaccttctgcttcgggtgggtgctgatccccaccatcaccatgatcctgctgaagatcctcatcgcgttcgcctacctgtgcagcaagtacaacacggactccaagttccggatcctggtggagaaggtcaagaaggagtaccagaagaccatgggcagcatggtgtgcgaggtgtgccagtacgagtgcgagaccgccaaggagctcgagagccaccgcaagtcctgcagcatcggctcctgcccgtactgcctgaaccccagcgaggccaccccctccgccctgcaggcgcacttcaaggtctgcaagctcacgagccggttccaggagaacctgaagaagtccctgaccatgtacgagcccatgcaggggtgctaccgcaccctcagcctgttccggtaccgctcccggttcttcgtgggcctggtgtggtgcatgctcctggtcctggagctcatcgtgtgggccgccagcgccgagacccagaacctgaacgacgggtggacggacaccgcgcacggctccggcatcatcccgatgaaggccgacctggagctcgacttcagcctgccctccagcgcctcctacacctaccgccggcagctgcagaaccccgccaacgagcaggagaagatcccgttccacctccagatcagcaagcaggtcatccacgccgagatccagcacctggggcactggatggacgcgaccttcaacctgaagacggccttccactgctacggctcctgcgagaagtacgcctacccctggcagaccgccgggtgcttcgtggagaaggactacgagtacgagaccggctgggggtgcaacccgcccgactgccccggcgtgggcaccgggtgcacggcctgcggcgtgtacctcgacaagctgaagtccgtcgggaaggtgttcaagatcgtgagcctgcgctacacccgcaaggtctgcatccagctcggcaccgggcagacctgcaagacggtggactccaacgactgcctgatcaccaccagcgtgaaggtctgcctgatcggcaccatctccaagttccagcccagcgacacgctcctgttcctgggccccctccagcagggcgggctgatcttcaagcagtggtgcaccacgacctgccagttcggggaccccggcgacatcatgtccaccccgaccgggatgaagtgccccgagctgaacggcagcttccggaagaagtgcgcgttcgccaccacccccgtgtgccagttcgacggcaacaccatctccgggtacaagcgcatggtggccacgaaggacagcttccagtccttcaacgtcaccgagccccacatcagcacctccgccctcgagtggatcgacctggacagctccctgcgggaccacatcaacgtgatcgtgagccgcgacctctccttccaggacctgagcgagaccccgtgccaggtcgacctgacgacctccgccaccgacggcgcgtgggggagcggcgtggggttcaacctcgtgtgcaccgtctccctgacggagtgcagcgccttcctgaccagcatcaaggcctgccacgccgcgatgtgctacggctccaccaccacgaacctcgtgcggggccagaacaccatccacgtggtcgggaagggcgggcacagcggctccaagttcatgtgctgccacgacaccaagtgcagctccaccggcctggtggccgccgcgccccacctggaccgcgtgacggggttcaaccaggccgacagcgacaagatcttcgacgacggcgcccccgagtgcgggatgtcctgctggttcaagaagctcggcgagtgggtcctgggggtgctgaacggcaactggatggtggtcgccgtgctcatcgccctgctgatcctcagcatcttcctgttcgccctgtgctgcccccggcgcccgtcctacaagaaggaccacaagccctga

SEQ ID NO: 11811 - RNA, 3447 nt, synthetic construct
  misc_feature 1..3447: note = derived and/or modified CDS sequence (opt1) from PUUV(2009)__HE801634.1__GP
  source 1..3447: mol_type = other RNA
atgggcaagagctcccccgtgtgcctgtacctcatcctgcaggggctgctcctgttcgacaccgtcaacgcccgcaacctgaacgagctcaagatggagtgcccgcacaccatcggcctggggcagggcctggtggtggggagcgtcgagctcccgcccgtgcccatccagcagatcgagtccctgaagctggagagctcctgcaacttcgacctccacacgagcaccgccggccagcagtccttcaccaagtggacctgggagacgaagggcgacctggcggagaacacccaggccagctccaccagcttccagaccaagtccagcgaggtgaacctgcgggggctctgcctgatccccacgctggtcgtggagaccgccgcccgcatgcggaagaccatcgcctgctacgacctctcctgcaaccagaccgtgtgccagcccacggtctacctgatgggccccatccagacctgcctgaccaccaagagctgcctcctggggctgggcgaccagcgcatccaggtgaactacgagcggacgtactgcgtgtccgggcagctcgtcgagggcgtgtgcttcaaccccatccacaccatggcgctgagccagccgtcccacacctacgacatcgtgaccatcatggtccgctgcttcctggtgatcaagaaggtgacgagcggcgactccatgaagatcgagaagaacttcgagaccctcgtccagaagaccgggtgcaccgccaacggcttccaggggtactacatctgcctgatcggcagcagctccgagcccctgtacgtgcccacgctcgacgactaccggagcgccgaggtgctgtcccgcatggccttcgcgccccacggcgaggaccacgacatcgagaagaacgccgtcagcgccctgcggatcgccgggaaggtgaccggcaaggccccgtccaccgagagctccgacaccgtgcaggggatcgcgttcagcggcagccccctctacacgagcaccggggtcctgaccgccaaggacgaccccgtgtacgtctgggcccccggcatcatcatggagggcaaccactccgtgtgcgagaagaagaccctgccgctcacgtggaccgggttcatccccctgcccggcgagatcgagaagaccacccagtgcacggtgttctgcaccctggccgggcccggcgccgactgcgaggcgtacagcgagaccgggatcttcaacatctccagcccgacctgcctcatcaaccgcgtccagcggttccgcggcgccgagcagcagatcaagttcgtgtgccagcgggtggacatggacatcaccgtctactgcaacggcgtgaagaaggtgatcctgacgaagaccctggtcatcgggcagtgcatctacaccttcacctccatcttcagcctcatccccggcatcgcccactccctggccgtggagctgtgcgtgcccgggctccacggctgggccacggtcctgctgctcctgaccttctgcttcgggtgggtgctgatccccaccatcaccatgatcctgctcaagatcctgatcgcgttcgcctacctgtgcagcaagtacaacacggactccaagttcaagatcctcgtggagaaggtcaagaaggagtaccagaagaccatgggcagcatggtgtgcgaggtgtgccagtacgagtgcgagaccgccaaggagctggagagccaccgcaagtcctgcagcatcggctcctgcccgtactgcctgaaccccagcgaggccaccccctccgccctccaggcgcacttcaaggtctgcaagctgacgagccggttccaggagaacctgaagaagtccctcaccatgtacgagcccatgcaggggtgctaccgcaccctgagcctgttccggtaccgctcccggttcttcgtgggcctcgtgtggtgcatgctgctggtcctcgagctgatcgtgtgggccgccagcgccgagacccagaacctgaacgcggggtggacggacaccgcccacggctccggcatcatcccgatgaaggccgacctcgagctggacttcagcctgccctccagcgcctcctacacctaccgccggcagctccagaaccccgccaacgagcaggagaagatcccgttccacctccagatcagcaagcaggtcatccacgcggagatccagcacctggggcactggatggacgccaccttcaacctgaagacggccttccactgctacggctcctgcgagaagtacgcctacccctggcagaccgccgggtgcttcgtggagaaggactacgagtacgagaccggctgggggtgcaacccgcccgactgccccggcgtgggcaccgggtgcacggcgtgcggcgtgtacctggacaagctgaagtccgtcgggaaggtgttcaagatcgtgagcctccgctacacccgcaaggtctgcatccagctgggcaccgagcagacctgcaagacggtggactccaacgactgcctgatcaccaccagcgtgaaggtctgcctcatcgggaccatctccaagttccagcccagcgacacgctgctgttcctcggccccctgcagcagggcgggctgatcttcaagcagtggtgcaccacgacctgccagttcggcgaccccggggacatcatgtccaccccgaccggcatgaagtgccccgagctcaacgggagcttccggaagaagtgcgccttcgccaccacccccgtgtgccagttcgacggcaacaccatctccggctacaagcgcatggtggccacgaaggacagcttccagtccttcaacgtcaccgagccccacatcagcacctccgccctggagtggatcgacccggacagctccctgcgggaccacatcaacgtgatcgtgagccgcgacctctccttccaggacctgagcgagaccccctgccaggtcgacctgacgacctccgcgatcgacggggcctggggcagcggggtgggcttcaacctcgtgtgcaccgtctccctgaccgagtgcagcgccttcctgacgagcatcaaggcctgcgacgcggccatgtgctacgggtccaccaccaccaacctcgtgcggggccagaacacgatccacgtggtcggcaagggcgggcacagcgggtccaagttcatgtgctgccacgacaccaagtgcagctccaccggcctggtggccgccgcgccccacctggaccgcgtgaccggcttcaaccaggccgacagcgacaagatcttcgacgacggggcccccgagtgcggcatgtcctgctggttcaagaagctcggggagtgggtcctgggcgtgctgaacgggaactggatggtggtcgccgtgctcatcgccctgctgatcctcagcatcttcctgttcgccctgtgctgcccgcggcgcccctcctacaagaaggagcacaagccctga

SEQ ID NO: 11812 - RNA, 3447 nt, synthetic construct
  misc_feature 1..3447: note = derived and/or modified CDS sequence (opt1) from PUUV(Umea/hu)__AY526218.1__GP
  source 1..3447: mol_type = other RNA
atgggcaagctgagccccgtgtgcctctacctgttcctgcagtgcctcctgctgtggtcccgcgggagcgcccggaacctcaacgagctgaagatggagtgcccgcacaccatcggcctggggcagggcctcgtcatcgggtccgtggagctgccgcccgtgcccgtccagcaggtcgagagcctgaagctcgagtccagctgcaacttcgacctgcacacctccacggccacccagcagagcttcaccaagtggacctgggagatgaaggacgacctggcggagaacacgcaggcctccagcacctccttccagaccaagagctccgaggtgaacctccgcggcctgtgcctgatcccgcccctcgtggtggagaccgccagccggacgcgcaagaccatcgcctgcttcgacatctcctgcaaccagaccgtgtgccagcccaccgtctacctggtgggccccatccagacgtgcatcaccaccaagagctgcctgctcgggctgggcgaccagcggatccaggtgaactacgagaagacctactgcgtctccgggcagctggtggagggcgtgtgcttcaacccggtccacacgatggtgctcagccagccctcccacacctacgacatcgtgaccatgatggtccgctgcttcctggtggtgaagaaggtcaccagcggggacagcatgaagatcgagaagaacctggagacgctcgtgcagaagaccgactgcaacgccaacggcttccagggctactacatctgcctggtggggtccagctccgagcccctgtacgtccccaccctcgacgactaccggagcgcggaggtgctgtcccgcatggccttcgccccgcacggcgaggaccacgacatcgagcggaacgccgtcagcgcgctgcgcatcgtggggaaggtgaccggcaaggccccctccacggaggccagcgacaccatccagggcatcgccttctccgggagccccctctacacctccaccggcgtcctgacggccaaggacaaccccgtgtacgtgtggagcccggggatcatcatggagggcaaccactccgtctgcgagaagaagaccctgcccctcacctggaccgggttcatccccctgcccggcgagatcggcaagacgagccagtgcaccgtgttctgcaccctggcggggccgggcgccgactgcgaggcctactccgagaccgggatcttcaacatcagctcccccacgtgcctcatcaaccgggcccagcgcttccggggcgccgagcagcagatcaagttcgtgtgccagcgcgtcgacatggacatcaccgtgtactgcaacgggatgaagaaggtgatcctgaccaagaccctggtcatcggccagtgcatctacaccttcacgagcatcttctccctcatccccggcatcgcgcacagcctggccgtggagctgtgcgtgcccgggctccacggctgggccaccgtcctgctgctcctgaccttctgcttcgggtggatcctgatcccgttcatcgccatgatcagcctgaagatcctcatcgccttcgcgtacctgtgctccaagtacaacaccgacagcaagttcaagatcctgatcgagaaggtgaagaaggagtaccagaagacgatgggctccatggtgtgcgaggtctgccagtacgagtgcgagaccgccaaggagctcgagagccaccggaagtcctgccccatcgggagctgcccctactgcctgaacccctccgaggccaccaccagcgccctgcaggcccacttcaaggtgtgcaagctcacgtcccgcgtgcaggacaacctgcgcaagagcctggcggcctacgagccgaagcagggctgctaccggaccctctccctgttccggtaccgcagccggttcttcgtcggcttcatctggtgcatcctgctcgtgctggagctgatcatctgggccgcctccgcggagacccagaacctcaacagcgggtggaccgacacggcccacggctccgggatcatccccatgcgcaccgacctggagctggacttcagcctcccctccagcgccagctacacctaccgccggcagctgcagaacccggccaacgagcacgagaagatccccttccacctccagatctccaagcaggtcatccacgccgagatccagcacctgggccactggatggacgcgaccttcaacctgaagacggccttccactgctacggcagctgcgagaagtacgcctacccctggcagaccgccgggtgcttcttcgagaaggactacgagttcgagtccagctggggctgcaacccgcccgactgccccggggtgggcaccgggtgcaccgcctgcggcgtgtacctggacaagctcaagtccgtgggcaaggtcttcaagatcatcagcctgcgctacacgcggaaggcgtgcatccagctggggaccgagcagacctgcaagtccgtggacagcaacgactgcctcgtgaccacgtccgtcaaggtgtgcctgatcggcaccgtgagcaagttccagccctccgacaccctcctgttcctggggcccctggagcagggcgggctcatcttcaagcagtggtgcaccacgacctgccagttcggcgaccccggcgacatcatgagcacccccaccgggatgaagtgccccgagctgaacggctccttccgcaagaagtgcgccttcgccacgacccccgtctgccagttcgacgggaacaccatcagcggctacaagcggatgatcgccaccaaggactccttccagagcttcaacgtgacggacccgcacatctccaccagcgccctggagtggatcgaccccgactccagcctccgcgaccacatcaacgtggtcgtgagccgggacctgtccttccaggacctgagcgagaccccctgccaggtggacctcaccacctccagcatcgacggggcgtggggctccggcgtcgggttcaacctggtgtgcacggtgagcctgaccgagtgctccaccttcctcaccagcatcaaggcctgcgactccgccatgtgctacggcagcacgaccatcaacctgatgcgcgggcagaacaccgtccacatcgtgggcaagggcgggcactccggcagcaagttcatgtgctgccacgacaccaagtgctccagcacggggctggtggccgcggcgccccacctcgaccgggtcaccggcttcaaccaggccgactccgacaagatcttcgacgacggggccccggagtgcggcatgagctgctggttcaagaagtccggcgagtggatcctgggggtgctgaacggcaactggctcgtggtcgccgtgctggtggccctgttcatcctcagcatcttcctgttcaccctgtgctgcccccgccggcccatctacgccaaggagcacaagccctga

SEQ ID NO: 11813 - RNA, 3447 nt, synthetic construct
  misc_feature 1..3447: note = derived and/or modified CDS sequence (opt1) from PUUV(P360)__L08755.1__GP
  source 1..3447: mol_type = other RNA
atgggcgagctgagccccgtgtgcctctgcctgctgctccaggggctgctgctctgcaacaccggcgccgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgcctgatcaaccgcgtccagcggttccgcggctccgagcagcagatcaagttcgtgtgccagcgggtcgacatggacatcaccgtgtactgcaacgggatgaagaaggtgatcctgaccaagaccctcgtcatcggccagtgcatctacacgttcaccagcatcttctccctgatccccggcgtggcccacagcctggccgtggagctctgcgtccccgggctgcacggctgggccaccatgctgctcctgctgaccttctgcttcgggtgggtgctgatccccacgatcaccatgatcctcctgaagatcctgatcgcgttcgcctacctctgcagcaagtacaacaccgactccaagttccgcatcctgatcgagaaggtgaagcgggagtaccagaagaccatgggcagcatggtctgcgaggtgtgccagtacgagtgcgagacggccaaggagctggagtcccaccgcaagagctgctccatcgggagctgcccctactgcctcaacccctccgaggccaccaccagcgccctgcaggcgcacttcaaggtgtgcaagctgacctcccggttccaggagaacctccgcaagagcctgacggtctacgagccgatgcagggctgctaccggaccctgtccctcttccgctaccggagccgcttcttcgtgggcctggtgtggtgcgtcctgctcgtgctggagctgatcgtgtgggccgcctccgccgagacccagaacctcaacgcggggtggaccgacacggcccacggcagcgggatcatccccatgaagaccgacctggagctggacttctccctccccagctccgccagctacacctaccgccggcagctgcagaaccccgccaacgagcaggagaagatcccgttccacctccagctcagcaagcaggtcatccacgccgagatccagcacctgggccactggatggacgcgaccttcaacctgaagacggccttccactgctacggctcctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctcaagagcgtcgggaaggtgttcaagatcgtgtccctgcgctacacccggaaggtctgcatccagctgggcaccgagcagacctgcaagacggtggacagcaacgactgcctgatcaccacctccgtgaaggtctgcctgatcgggaccatcagcaagttccagccctccgacacgctcctgttcctgggccccctccagcagggcgggctgatcttcaagcagtggtgcaccacgacctgccagttcggcgacccgggggacatcatgagcacccccaccggcatgaagtgccccgagctgaacgggtccttccgcaagaagtgcgcgttcgccaccacccccgtgtgccagttcgacggcaacaccatcagcgggtacaagcggatgatcgccacgaaggactccttccagagcttcaacgtgaccgagccgcacatctccaccagcgccctcgagtggatcgaccccgactccagcctgcgcgaccacatcaacgtcatcgtgtcccgggacctgagcttccaggacctctccgagaccccctgccagatcgacctggccacggcgagcatcgacggcgcctggggcagcggggtgggcttcaacctggtctgcaccgtgtccctcaccgagtgcagcgccttcctgacctccatcaaggcctgcgacgcggccatgtgctacgggagcacgaccgccaacctggtgcgcggccagaacaccatccacatcgtcgggaagggcggccactccgggagcaagttcatgtgctgccacgacaccaagtgctccagcacgggcctcgtggccgccgcgccccacctggaccgggtgaccgggtacaaccaggccgactccgacaagatcttcgacgacggcgccccggagtgcggcatgagctgctggttcaagaagtccggggagtggatcctgggcgtcctcaacgggaactggatggtggtggccgtcctggtggtgctgctcatcctgagcatcctgctgttcaccctgtgctgcccccgccggccctcctaccgcaaggagcacaagccctga

SEQ ID NO: 11814 - RNA, 3447 nt, synthetic construct
  misc_feature 1..3447: note = derived and/or modified CDS sequence (opt1) from MUV(11-1)__JX028272.1__GP
  source 1..3447: mol_type = other RNA
atgggcaagatcagccccgtgtacctgtacctcctgttccaggggctgctcctgtggcgcgacggcctggcccggaacctcaacgagctgaagatggagtgcccgcacaccatcgggctgggccaggggctcgtcatcggctccgtggagctgccgcccgtgcccctgcgccaggtcgagagcctcaagctggagtccagctgcaacttcgacctgcacacctccacggccacccagcagagcttcaccaagtggatctgggagtccaagaacgacctcaccgacagcacgcaggcgtccagcacctcctaccagaccaagagcaccgaggtgaacctgaagggcctgtgcctcgtgcccacgctggtcatcgagaccgccgcccggacccgcaagaccatcgcctgcttcgacctgtcctgcaaccagacggtgtgccagcccaccgtgtacctcatcgggcccatccagacctgcatcaccaccaagagctgcctgatcggcctgggggaccagcggatccaggtcaactacgagaagacctactgcgtgtccggccagctcgtggagggggtctgcttcaaccccatccacaccatggccctgagccagccgtcccacacctacgacgtggtgacgatgatggtccgctgcttcctggtggtgaagaaggtcaccagcggcgactccatgaagatcgagaagaacttcgagaccctcgtgcagaagaccggctgcagcaacaacaacttccaggggtactacgtgtgcctgatcggcagctccagcgagcccctgtacgtccccacgctcgacgactaccggtccgcggagatcctgagccgcatggccttcgcgccccacggggaggaccacgacatcgagcggaacgccatctccgccatgcgcatcgtgggcaaggtgaccggcaaggccccgagctccgagagctccgacaccgtccagggggtggccttcagcggcaaccccctgtacacctccacgggggtcctcaccagcaaggacgaccccgtgtacgtgtgggcccccggcatcatcatggaggggaaccactccgtctgcgacaagaagaccctgccgctgacctggacgggctacatccccctccccggcgagatcgagaagaccacccagtgcaccgtgttctgcacgctggccgggcccggcgcggactgcgaggcctacagcgagaccgggatcttcaacatctccagcccgacctgcctgatcaaccgggtgcagcgcttccggggcgccgagcagcagatcaagttcgtctgccagcgcgtggacatggacatcaccgtgtactgcaacgggatcaagaaggtcatcctcaccaagacgctggtgatcggccagtgcatctacaccttcacctccatcttcagcctgatgcccggcgtggcccactccctcgccgtcgagctgtgcgtgcccgggctgcacggctgggcgaccatgctcctgctgctcacgttctgcttcgggtggatcctgatccccaccatcaccctgatcctgctcaagatcctgctggccttcgcctacgtgtgcagcaagtacaacaccgacagcaagttcaagatcctcatcgagaaggtcaagcaggagtaccagaagacgatgggctccatggtgtgcgaggtgtgccagcacgagtgcgagaccgccaaggagctggagagccacaagaagtcctgcccgatcgggagctgcccctactgcctgaaccccgccgaggcgaccacctccgccctccaggcccacttcaaggtctgcaagctgacgagccggttccaggagaacctgcgcaagtccctcaccgtgtacgagcccaagcagggctgctaccggaccctgagcctgttccgctaccggtcccgctgcttcgtgggcctcatctggtgcatcctgctgaccctcgagctgatcgtctgggccgccagcgcggagacgctgaacctcaacccggggtggaccgacaccgcccacggctccgggatcgtgcccatgaagaccgacctggagctggacttcagcctcccctccagcgcctcctacacgtaccggcgcagcctgcagaacccggccaacgagcaggagcaggtccccttccacctccagatcgagaagcaggtcatccacgcggagatccagcacctgggccactggatggacgccaccttcaacctgaagaccgccttccactgctacggcgcctgcgagaagtacgcctacccctggcagaccgcggggtgcttcgtggagaaggacttcgagttcgagaacggctgggggtgcaacccgcccgactgccccggcgtggggacgggctgcaccgcctgcggcgcctacctggacaagctcaagtccgtggggaaggtgttcaagatcgtgagcctgcgctacacccggaaggcctgcatccagctgggcaccgagcagacgtgcaagaacgtcgacagcaacgactgcctcgtgaccacctccgtgaaggtctgcctgatcgggaccatcagcaagttccagccctccgacacgctcctgttcctgggccccctggagcagggcgggatcatcttcaagcagtggtgcaccacgacctgccagttcggcgacccgggggacatcatgagcacgcccatcggcatgaagtgccccgagctcaacgggtccttccgcaagaagtgcagcttcgccaccacccccgtgtgccagttcgacggcaacaccatctccgggtacaagcggatgatcgcgaccaaggacagcttccagtccttcaacgtgacggagccgcacatcagcgcctccgccctggagtggatcgaccccgacagctccctgcgcgaccacatcaacgtcgtggtgggccgggacctccccttccaggacctgagcgagaccccctgccagatcgacctgtccaccagctccatcgacggcgcctgggggagcggcgtcgggttcaacctcgtgtgctccgtgagcctgaccgagtgcttcacgttcctgaacagcatcaaggcctgcgacaccgcgatgtgctacggctccaccaccgccaacctcgtccgcgggcagaacacggtgcacgtggtcggcaagggcgggcacagcggctccaagttcatgtgctgccacgacaccaagtgcagcaacaccgggctgctggccgccgcgccgcacctcgaccgggtgaccggctacaaccaggccgactccgacaaggtgttcgacgacggcgcccccgagtgcgggatgacgtgctggttcaagaagtccggcgagtggatcatgggggtcctgagcggcaactggatggtggtggccgtcctgatcaccctcctggtgctgagcatcttcctcttcgccctgtgctgcccccgccgggcggcctacaagaaggagcacaagccctga

SEQ ID NO: 11815 - RNA, 3447 nt, synthetic construct
  misc_feature 1..3447: note = derived and/or modified CDS sequence (opt1) from MUV(11-4)__JX046483.1__GP
  source 1..3447: mol_type = other RNA
atgggcaagatcagccccgtgtacctgtgcctcctgctgcaggggctcctgctgtggcgcgacggcctcgcccggaacctgaacgagctgaagatggagtgcccgcacaccatcgggctcggccaggggctggtcatcggctccgtggagctgccgcccgtgcccctccgccaggtcgagagcctgaagctggagtccagctgcaacttcgacctccacacctccacggccacccagcagagcttcaccaagtggatctgggagtccaagaacgacctgaccgacagcacgcaggcgtccagcacctcctaccagaccaagagcaccgaggtgaacctgaagggcctctgcctggtgcccacgctggtcatcgagaccgccgcccggacccgcaagaccatcgcctgcttcgacctctcctgcaaccagacggtgtgccagcccaccgtgtacctgatcgggcccatccagacctgcatcaccaccaagagctgcctgatcggcctcggggaccagcggatccaggtcaactacgagaagacctactgcgtgtccggccagctggtggagggggtctgcttcaaccccatccacaccatggccctgagccagccgtcccacacctacgacgtggtgacgatgatggtccgctgcttcctcgtggtgaagaaggtcaccagcggcgactccatgaagatcgagaagaacttcgagaccctggtgcagaagaccggctgcagcaacaacaacttccaggggtactacgtgtgcctgatcggcagctccagcgagcccctctacgtccccacgctggacgactaccggtccgcggagatcctgagccgcatggccttcgcgccccacggggaggaccacgacatcgagcggaacgccatctccgccatgcgcatcgtgggcaaggtgaccggcaaggccccgagctccgagagctccgacaccgtccaggggatcgccttcagcggcaaccccctctacacctccacgggggtgctgaccagcaaggacgaccccgtctacgtgtgggcccccggcatcatcatggaggggaaccactccgtgtgcgacaagaagaccctgccgctcacctggacgggctacatccccctgcccggcgagatcgagaagaccacccagtgcaccgtcttctgcacgctggccgggcccggcgcggactgcgaggcctacagcgagaccgggatcttcaacatctccagcccgacctgcctcatcaaccgggtgcagcgcttccggggcgccgagcagcagatcaagttcgtgtgccagcgcgtcgacatggacatcaccgtgtactgcaacgggatcaagaaggtgatcctgaccaagacgctggtcatcggccagtgcatctacaccttcacctccatcttcagcctcatgcccggcgtggcccactccctggccgtggagctgtgcgtccccgggctccacggctgggcgaccatgctgctgctcctgacgttctgcttcgggtggatcctgatccccaccatcaccctgatcctcctgaagatcctgctcgccttcgcctacgtgtgcagcaagtacaacaccgacagcaagttcaagatcctgatcgagaaggtgaagcaggagtaccagaagacgatgggctccatggtctgcgaggtgtgccagcacgagtgcgagaccgccaaggagctggagagccacaagaagtcctgcccgatcgggagctgcccctactgcctcaaccccgccgaggcgaccacctccgccctgcaggcccacttcaaggtgtgcaagctgacgagccggttccaggagaacctccgcaagtccctgaccgtctacgagcccaagcagggctgctaccggaccctgagcctcttccgctaccggtcccgctgcttcgtgggcctgatctggtgcatcctgctcaccctggagctgatcgtgtgggccgccagcgcggagacgctcaacctgaacccggggtggaccgacaccgcccacggctccgggatcgtccccatgcggaccgacctggagctcgacttcagcctgccctccagcgcctcctacacgtaccgccgcagcctgcagaacccggccaacgagcaggagcagatccccttccacctccagatcgagaagcaggtcatccacgcggagatccagcacctgggccactggatggacgccaccttcaacctgaagaccgccttccactgctacggcgcctgcgagaagtacgcctacccctggcagaccgcggggtgcttcgtggagaaggacttcgagttcgagaacggctgggggtgcaacccgcccgactgccccggcgtggggacgggctgcaccgcctgcggcgcctacctcgacaagctgaagtccgtggggaaggtgttcaagatcgtcagcctgcggtacacccgcaaggcctgcatccagctcggcaccgagcagacgtgcaagaacgtggacagcaacgactgcctggtgaccacctccgtcaaggtgtgcctgatcgggaccatcagcaagttccagccctccgacacgctcctgttcctgggccccctcgagcagggcgggatcatcttcaagcagtggtgcaccacgacctgccagttcggcgacccgggggacatcatgagcacgcccatcggcatgaagtgccccgagctgaacgggtccttccggaagaagtgcagcttcgccaccacccccgtgtgccagttcgacggcaacaccatctccgggtacaagcgcatgatcgcgaccaaggacagcttccagtccttcaacgtcacggagccgcacatcagcgcctccgccctggagtggatcgaccccgacagctccctccgggaccacatcaacgtggtggtcggccgcgacctgcccttccaggacctgagcgagaccccctgccagatcgacctctccaccagctccatcgacggcgcctgggggagcggcgtggggttcaacctggtgtgctccgtcagcctgaccgagtgcagcacgttcctcacctccatcaaggcctgcgacaccgcgatgtgctacggcagcaccacggccaacctggtgcgggggcagaacaccgtgcacgtcgtgggcaagggcgggcactccggcagcaagttcgtgtgctgccacgacaccaagtgctccaacaccgggctgctcgccgccgcgccgcacctggaccgcgtcacgggctacaaccaggccgacagcgacaaggtgttcgacgacggcgcccccgagtgcgggatgacctgctggttcaagaagtccggcgagtggatcatgggggtgctgagcggcaactggatggtcgtggccgtgctcatcaccctgctggtcctctccatcttcctgttcgccctgtgctgcccccggcgcgcggcctacaagaaggagcacaagccctga

SEQ ID NO: 11816 - RNA, 3447 nt, synthetic construct
  misc_feature 1..3447: note = derived and/or modified CDS sequence (opt1) from MUV(11-5)__JX046486.1__GP
  source 1..3447: mol_type = other RNA
atgggcaagatcagccccgtgtacctgtgcctcctgctgcaggggctcctgctgtggcgcgacggcctcgcccggaacctgaacgagctgaagatggagtgcccgcacaccatcgggctcggccaggggctggtcatcggctccgtggagctgccgcccgtgcccctccgccaggtcgagagcctgaagctggagtccagctgcaacttcgacctccacacctccacggccacccagcagagcttcaccaagtggatctgggagtccaagaacgacctgaccgacagcacgcaggcgtccagcacctcctaccagaccaagagcaccgaggtgaacctgaagggcctctgcctggtgcccacgctggtcatcgagaccgccgcccggacccgcaagaccatcgcctgcttcgacctctcctgcaaccagacggtgtgccagcccaccgtgtacctgatcgggcccatccagacctgcatcaccaccaagagctgcctgatcggcctcggggaccagcggatccaggtcaactacgagaagacctactgcgtgtccggccagctggtggagggggtctgcttcaaccccatccacaccatggccctgagccagccgtcccacacctacgacgtggtgacgatgatggtccgctgcttcctcgtggtgaagaaggtcaccagcggcgactccatgaagatcgagaagaacttcgagaccctggtgcagaagaccggctgcagcaacaacaacttccaggggtactacgtgtgcctgatcggcagctccagcgagcccctctacgtccccacgctggacgactaccggtccgcggagatcctgagccgcatggccttcgcgccccacggggaggaccacgacatcgagcggaacgccatctccgccatgcgcatcgtgggcaaggtgaccggcaaggccccgagctccgagagctccgacaccgtccaggggatcgccttcagcggcaaccccctctacacctccacgggggtgctgaccagcaaggacgaccccgtctacgtgtgggcccccggcatcatcatggaggggaaccactccgtgtgcgacaagaagaccctgccgctcacctggacgggctacatccccctgcccggcgagatcgagaagaccacccagtgcaccgtcttctgcacgctggccgggcccggcgcggactgcgaggcctacagcgagaccgggatcttcaacatctccagcccgacctgcctcatcaaccgggtgcagcgcttccggggcgccgagcagcagatcaagttcgtgtgccagcgcgtcgacatggacatcaccgtgtactgcaacgggatcaagaaggtgatcctgaccaagacgctggtcatcggccagtgcatctacaccttcacctccatcttcagcctcatgcccggcgtggcccactccctggccgtggagctgtgcgtccccgggctccacggctgggcgaccatgctgctgctcctgacgttctgcttcgggtggatcctgatccccaccatcaccctgatcctcctgaagatcctgctcgccttcgcctacgtgtgcagcaagtacaacaccgacagcaagttcaagatcctgatcgagaaggtgaagcaggagtaccagaagacgatgggctccatggtctgcgaggtgtgccagcacgagtgcgagaccgccaaggagctggagagccacaagaagtcctgcccgatcgggagctgcccctactgcctcaaccccgccgaggcgaccacctccgccctgcaggcccacttcaaggtgtgcaagctgacgagccggttccaggagaacctccgcaagtccctgaccgtctacgagcccaagcagggctgctaccggaccctgagcctcttccgctaccggtcccgctgcttcgtgggcctgatctggtgcatcctgctcaccctggagctggtggtctgggccgccagcgcggagacgctcaacctgaacccggggtggaccgacaccgcccacggctccgggatcgtgcccatgcggaccgacctggagctcgacttcagcctgccctccagcgcctcctacacgtaccgccgcagcctgcagaacccggccaacgagcaggagcagatccccttccacctccagatcgagaagcaggtcatccacgcggagatccagcacctgggccactggatggacgccaccttcaacctgaagaccgccttccactgctacggcgcctgcgagaagtacgcctacccctggcagaccgcggggtgcttcgtggagaaggacttcgagttcgagaacggctgggggtgcaacccgcccgactgccccggcgtggggacgggctgcaccgcctgcggcgcctacctcgacaagctgaagtccgtggggaaggtcttcaagatcgtgagcctgcggtacacccgcaaggcctgcatccagctcggcaccgagcagacgtgcaagaacgtggacagcaacgactgcctggtcaccacctccgtgaaggtgtgcctgatcgggaccatcagcaagttccagccctccgacacgctcctgttcctgggccccctcgagcagggcgggatcatcttcaagcagtggtgcaccacgacctgccagttcggcgacccgggggacatcatgagcacgcccatcggcatgaagtgccccgagctgaacgggtccttccggaagaagtgcagcttcgccaccacccccgtctgccagttcgacggcaacaccatctccgggtacaagcgcatgatcgcgaccaaggacagcttccagtccttcaacgtgacggagccgcacatcagcgcctccgccctggagtggatcgaccccgacagctccctccgggaccacatcaacgtggtcgtgggccgcgacctgcccttccaggacctgagcgagaccccctgccagatcgacctctccaccagctccatcgacggcgcctgggggagcggcgtggggttcaacctggtctgctccgtgagcctgaccgagtgcagcacgttcctcacctccatcaaggcctgcgacaccgcgatgtgctacggcagcaccacggccaacctggtgcgggggcagaacaccgtccacgtggtgggcaagggcgggcactccggcagcaagttcgtctgctgccacgacaccaagtgctccaacaccgggctgctcgccgccgcgccgcacctggaccgcgtgacgggctacaaccaggccgacagcgacaaggtgttcgacgacggcgcccccgagtgcgggatgacctgctggttcaagaagtccggcgagtggatcatgggggtcctgagcggcaactggatggtggtggccgtcctcatcaccctgctggtgctctccatcttcctgttcgccctgtgctgcccccggcgcgcggcctacaagaaggagcacaagccctga

SEQ ID NO: 11817 - RNA, 3408 nt, synthetic construct
  misc_feature 1..3408: note = derived and/or modified CDS sequence (opt1) from SANGV(SA14)__NC_034516.1__GP
  source 1..3408: mol_type = other RNA
atgatcatgtggggcctgctcctgctggccgccatcaccttcccctgccagagcctcaagaacgtgtacgacatgaagatcgagtgcccgcactccgtcaacttcggggagagctccgtgatgggcaaggtgcagctgcccagcctgtccatcaccgaggccgagcagctcgtccccgagagctcctgcaacatggacaaccaccagagcctgtccgtgctgcagaaggccacgaagaccacctggcgcaagaaggccgaccacagcaacgccgggaaggactcctacgagctcatcaccagcgagatccagttcaagggcgtgtgctccctgacgcacaagatgatcgaggagagccaccggctgcgccggtccgtcatctgctacgacctcagctgcaacaccacccactgcaagcccaccctgtacatggtggtgccggtccactcctgcaacatgatgaagtcctgcctgatcgggctcggcccctaccgcatccaggtggtgtacgagcggacgtactgcaccgtcggcgtgctgaacgaggggaagtgcttcgtgcccgaccagtccgtcgccaacatcgtgaagaacggcatcttcgacatcgtgagcgtccagatcatctgcttcttcatccgcatcaaggggagcacctacaagatcctggagaccgtgaagacggccatgaacggcaagtgcaacgggaccgacgacaaggtgcagggctactacatctgcctcctgggcgggaactccggccccatctacgtcccgagcgggaccgacttccgggccatggaggccctggccaacatgctccgcgcgccccacggcgaggaccacgacctgcccggcgaggagctggcctcctacagcatcgccgggaccatcgagggcaagatcccccacacggcctccagccagaacctcgagttcaccgcctactccgggatcccgagctactccagcttctccgtgcacaccctgacccaggacggccagctgagctactcccccggcctcttccccaacctgaaccagagcgactgcaagaagaacgcgctgcccctcatctgggaggggacgatcgagctgccgggctactacgaggccatccacccctgcaacgtgttctgcgtcttctccgggcccggcgccagctgcgaggccttctccgagggcgggatcttcaacatcaccagcccgacctgcctggtgtccaagcagaaccggttccgcgccgcggagcagcagatcaccttcgtctgccagcgggtggacatggacatcatcatctactgcaacgggcagcgcaaggtgatcctcacgaagaccctggtcatcggccagtgcatctacagcatcaccagcctgttctccctcctgcccagcgtggcccactccatcgccatcgagctgtgcgtgcccggcttccacgggtgggccaccgccgcgctcctgacgaccttctgcttcggctggctgctcatccccagcatcacctacatcgtcctgctgatcctcaagttcatcgccgccatcttccacaacaccacgcaggagaacaagttcaaggccatcctgcggaagatcaaggaggagttcgagaagaccaaggggtccatggtgtgcgacatctgcaagtacgagtgcgagaccggcaaggagctgaaggcccacaacctcagctgcaaccagtcccagtgcccctactgcttcacccactgcgagatgacggagagcgcgttccaggcccactacaaggtgtgccaggccacccaccgcttccgggaggacctgaagaagaccatcaccccgcagaccatctcccccgggtgctaccgcacgctgaacctgttccggtacaagagccgctgctacatcctcaccgtctggctgtgcctgctcatcctggagtccatcgcctgggcggccagcgcctccgagaccagcctgaaccccctctggaccgacaacgcccacggcgtgggctccgtgcccatgcacacggacctggagctggacttcagcctcccgtccagcagcaagtacacctacaagcggaagctgacctcccccaccaaccccgagcaggccgtcagcctgcacatcgagatcgagtcccaggggatcgcggccgacgtgcacagcctcggccactggtacgacgcccgcctgaacctgaagacgtccttccactgctacggggcctgcaccaagtaccagtacccgtggcacaccgccaagtgccacttcgagcacgacttccagtacgagaacagctggggctgcaacccgcccgactgccccggcgtggggaccggctgcacggcgtgcgggctctacctggaccagctgaagcccgtcggctccgcctacaagctcatcaccgtgcggtacagccgcaaggtgtgcgtccagttcggggaggagaacctgtgcaagaccatcgacatgaacgactgcttcatgtcccgccacgtgaaggtgtgcatcatcggcaccgtcagcaagttctcccagggcgacacgctggtgttcctcgggcccctggagggcgggggcctgatcttcaaggactggtgcaccagcacgtgccagtacggggaccccggcgacatcatgagcccccgggaccgcggcttcagctgcccggagttccccgggtccttccggaagaagtgcaacttcgccaccacccccgtgtgcgagtacagcggcaacatggtctccgggtacaagaaggtgatggccaccatcgacagcttccagtccttcaacaccagcctcatccacttcaccgaggagcgcatcgagtggaaggaccccgacggcatgctgcgggaccacctgaacatcctcgtgacgaaggacatcgacttcgagaacctgggggagaacccgtgcaaggtcggcctgcagaccagctccatcgagggcgcctgggggagcggcgtggggttcaccctcgtgtgccaggtctccctgatcgactgcgcgcgcttcctgaccagcatcaaggcctgcgacatggccatctgctacggcgcccagtccgtgagcctcgtgcgggggcagaacacggtcaagatcaccggcaagggcgggcactccggcagctccttcaagtgctgccacgaggtggactgcagctccaccgggctgcaggcgagcgcgccccacctggacaaggtgaacggcatctccgagcaggagaacgacaaggtctacgacgacggcgcgccccagtgcggggtgagctgctggttcgtgaagtccggcgagtggatcagcgggatcctccacggcaactgggtcgtggtggtcgtgctggtgatcctgctcctgttctccctgatcctcctgagcatcctgtgccccgtccgcaagcacaagcggtcctga

SEQ ID NO: 11818 - RNA, 3408 nt, synthetic construct; identical to SEQ ID NO: 11817
  misc_feature 1..3408: note = derived and/or modified CDS sequence (opt1) from SANGV(SA14)__NC_034516.1__GP
  source 1..3408: mol_type = other RNA

SEQ ID NO: 11819 - RNA, 3402 nt, synthetic construct
  misc_feature 1..3402: note = derived and/or modified CDS sequence (opt1) from SEOV(L99)__AF288298.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagctggccaaccagaactccttcgaggtcgtggagagcgaggtgtccttcaagggcctctgcatgctgaagcaccgcatggtcgaggagagctaccggaaccgccggtccgtgatctgctacgacctggcctgcaacagcaccttctgcaagcccaccgtgtacatgatcgtcccgatccacgcgtgcaacatgatgaagtcctgcctcatcgggctgggcccctaccgcatccaggtggtgtacgagcggacgtactgcaccaccggcatcctgaccgaggggaagtgcttcgtccccgacaaggccgtggtgagcgccctcaagcgcggcatgtacgccatcgcgtccatcgagacgatctgcttcttcatccacaagaaggggaacacctacaagatcgtcaccgccatcaccagcgccatgggctccaagtgcaacaacacggacaccaaggtgcaggggtactacatctgcatcatcggcggcaacagcgcccccgtgtacgccccggcgggggaggacttccgggccatggaggtcttcagcggcatcatcaccagcccccacggggaggaccacgacctgcccggcgaggagatcgccacctaccagatcagcggccagatcgaggccaagatcccccacacggtgtccagcaagtccctgaagctcatcgccttcgcggggatcccgagctactccagcacctccatcctggccgccagcgaggacggccgcttcatcttctcccccgggctgttccccaacctcaaccagagcgtgtgcgacaacaacgccctgcccctgatctggcggggcctcatcgacctgaccgggtactacgaggccgtccacccgtgcaacgtgttctgcgtcctgtccggccccggcgcgagctgcgaggccttctccgagggcgggatcttcaacatcaccagccccatgtgcctcgtgtccaagcagaaccgcttccgggccgccgagcagcagatcagcttcatctgccagcgcgtggacatggacatcatcgtctactgcaacgggcagaagaagacgatcctgaccaagaccctggtgatcggccagtgcatctacaccatcacgtccctcttcagcctgctgcccggggtggcccacagcatcgcgatcgagctctgcgtcccgggcttccacggctgggccaccgccgccctgctgatcaccttctgcttcgggtgggtgctcatccccgcgtgcaccctggccatcctgctcgtgctgaagttcttcgccaacatcctgcacacgtccaaccaggagaaccggttcaaggccatcctccgcaagatcaaggaggagttcgagaagaccaagggcagcatggtctgcgagatctgcaagtacgagtgcgagaccctgaaggagctgaaggcccacaacctctcctgcgtgcagggggagtgcccctactgcttcacccactgcgagcccacggagaccgcgatccaggcccactacaaggtgtgccaggccacccaccggttccgcgaggacctgaagaagaccgtcacgccgaagaacatcggccccgggtgctaccggaccctgaacctgttccgctacaagagccggtgctacatcctcaccatgtggaccctgctgctcatcatcgagtccatcctgtgggccgccagcgcggccgagatccccctggtgcccctctggaccgacaacgcccacggcgtgggctccgtcccgatgcacacggacctggagctggacttcagcctcccctccagctccaagtacgcctacaagcgccacctgaccaaccccgtgaacgaccagcagagcgtgtccctgcacatcgagatcgagagccaggggatcggcgccgacgtccaccacctcgggcactggtacgacgcgcgcctgaacctgaagacctccttccactgctacggcgcctgcaccaagtaccagtacccgtggcacacggccaagtgccacttcgagaaggactacgagtacgagaacagctgggcctgcaacccgcccgactgccccggcgtggggaccggctgcaccgcgtgcgggctctacctggaccagctgaagcccgtgggcaccgccttcaagatcatctccgtccggtacagccgcaaggtgtgcgtgcagttcggggaggagtacctctgcaagacgatcgacatgaacgactgcttcgtcacccggcacgccaagatctgcatcatcggcaccgtgagcaagttctcccagggcgacaccctgctgttcctcgggcccatggagggcgggggcatcatcttcaagcactggtgcacgagcacgtgccacttcggggaccccggcgacgtgatgggccccaaggacaagccgttctcctgccccgagttccccgggcagttccgcaagaagtgcaacttcgccaccacccccatctgcgagtacgacggcaacatcatcagcgggtacaagaaggtcctggccaccatcgactccttccagagcttcaacacctccaacatccacttcaccgacgagcggatcgagtggcgcgacccggacggcatgctgcgggaccacatcaacatcgtgatcagcaaggacatcgacttcgagaacctcgcggagtccccctgcaaggtggggctgcaggccgccaacatcgagggcgcctggggcagcggggtcggcttcaccctgacgtgccaggtgtccctcaccgagtgccccaccttcctgaccagcatcaaggcctgcgacatggcgatctgctacggggccgagtccgtgacgctgagccgcggccagaacaccgtccggatcaccgggaagggcggccactccgggagctccttcaagtgctgccacggcaaggagtgcagctccaccgggctccaggccagcgcgccccacctggacaaggtgaacggcatcagcgagctggagaacgagaaggtgtacgacgacggcgccccggagtgcggggtcacgtgctggttcaagaagtccggcgagtgggtgatggggatcatcaacggcaactgggtggtcctcatcgtgctgtgcgtgctgctcctgttcagcctgatcctcctgtccatcctgtgccccgtccgcaagcacaagaagtcctga

SEQ ID NO: 11820 - RNA, 3402 nt, synthetic construct
  misc_feature 1..3402: note = derived and/or modified CDS sequence (opt1) from SEOV(Rn10-134)__JF693883.2__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgccagcgcggtggagatccccctggtgcccctgtggacggacaacgcccacggcgtcggctccgtgccgatgcacaccgacctcgagctggacttcagcctgccctccagctcccgctacacctacaagcgccacctcaccaaccccgtgaacgaccagcagagcgtctccctgcacatcgagatcgagagccaggggatcggcgccgacgtgcaccacctggggcactggtacgacgcccggctcaacctgaagacgtccttccactgctacggcgcctgcaccaagtaccagtacccgtggcacaccgcgaagtgccacttcgagaaggactacgagtacgagaacagctgggcctgcaacccgcccgactgccccggcgtggggaccggctgcacggcctgcgggctgtacctcgaccagctgaagcccgtcggcaccgccttcaagatcatctccgtgcgctacagccggaaggtgtgcgtccagttcggggaggagtacctgtgcaagaccatcgacatgaacgactgcttcgtgacccgccacgcgaagatctgcatcatcggcacggtgagcaagttctcccagggcgacaccctcctgttcctggggcccatggagggcgggggcatcatcttcaagcactggtgcaccagcacgtgccacttcggggaccccggcgacgtcatgggccccaaggacaagccgttcatctgccccgagttccccgggcagttccggaagaagtgcaacttcgccaccacccccgtgtgcgagtacgacggcaacatcatctccgggtacaagaaggtgctcgccaccatcgacagcttccagtccttcaacaccagcaacatccacttcacggacgagcgcatcgagtggcgggacccggacggcatgctgcgcgaccacatcaacatcgtcatctccaaggacatcgacttcgagaacctggccgagaacccctgcaaggtggggctccaggccgcgaacatcgagggcgcctggggcagcggggtgggcttcaccctgacctgccaggtctccctgaccgagtgccccacgttcctcaccagcatcaaggcctgcgacatggccatctgctacggggccgagtccgtgaccctgagccggggccagaacaccgtgaagatcacggggaagggcggccactccgggagctccttcaagtgctgccacggcaaggagtgcagcctgaccgggctccaggcgtccgcgccccacctggacaaggtcaacggcatcagcgagctggagaacgagaaggtgtacgacgacggcgccccggagtgcgggatcacgtgctggttcaagaagtccggcgagtgggtgatggggatcatcaacggcaactgggtcgtgctcatcgtgctgtgcgtcctgctcctgttcagcctgatcctcctgagcatcctgtgccccgtgcgcaagcacaagaagtcctga

SEQ ID NO: 11821 - RNA, 3402 nt, synthetic construct
  misc_feature 1..3402: note = derived and/or modified CDS sequence (opt1) from SEOV(Gou3-e5)__AF288650.1__GP
  source 1..3402: mol_type = other RNA
atgtggggcctgctcctgctggccgccctcgtggggcagggcctggcgctgaagaacgtcttcgacatgaagatccagtgcccccacagcgtgaacttcggggagaccagcgtgagcggctacaccgagctcccgcccctgcccctgcaggaggccgagcagctcgtccccgagtccagctgcaacatggacaaccaccagtccctgagcaccatcaacaagctgaccaaggtgatctggcgcaagaaggccaaccaggagtccgccagccagaactccttcgaggtggtcgagaacgaggtgagcttcaaggggctctgcatgctgaagcaccggatggtggaggagtcctaccgcaaccggcgcagcgtcatctgctacgacctggcctgcaacaccaccttctgcaagccgacggtgtacatgatcgtgcccatccacgcgtgcaacatgatgaagtcctgcctcatcggcctgggcccctaccggatccaggtcatctacgagcgcacctactgcaccaccgggatcctgacggagggcaagtgcttcgtgcccgacaaggccgtggtcagcgccctcaagcgggggatgtacgccatcgcgtccatcgagaccatctgcttcttcgtgcaccagaagggcaacacctacaagatcgtgagcgccatcacctccgccatggggagcaagtgcaacaacacggactccaaggtccagggctactacatctgcatcatcggcgggaacagcgccccggtgtacgcccccgcgggcgaggacttccgcgccatggaggtgttcagcgggatcatcaccagcccccacggcgaggaccacgacctgcccggcgaggagatcgccacctaccagatcagcgggcagatcgaggccaagatcccgcacaccgtctccagcaagaacctgaagctcacggccttcgcgggcatcccctcctacagctccaccagcatcctggccgcctccgaggacgggcggttcatcttcagccccggcctgttccccaacctcaaccagtccgtgtgcgacaacaacgccctgccgctgatctggcgcgggctcatcgacctgaccggctactacgaggccatccacccctgcaacgtgttctgcgtcctgagcggccccggggcgtcctgcgaggccttcagcgagggcgggatcttcaacatcacctcccccatgtgcctcgtgagcaagcagaaccggttccgcgccgccgagcagcagatctccttcatctgccagcgggtcgacatggacatcgtggtgtactgcaacggccagaagaagacgatcctgaccaagaccctggtcatcgggcagtgcatctacaccatcacgagcctcttctccctgctgccgggcgtggcccacagcatcgcgatcgagctctgcgtgcccggcttccacgggtgggccaccgccgccctgctggtcaccttctgcttcggctgggtgctcatccccgcgtgcaccctggccgtgctcctgttcctgaagttcttcgccaacatcctgcacacgagcaaccaggagaaccgcttcaaggccatcctccggaagatcaaggaggagttcgagaagaccaaggggtccatggtctgcgagatctgcaagtacgagtgcgagaccctgaaggagctgaaggcccacaacctcagctgcgtgcagggcgagtgcccctactgcttcacccactgcgagccgacggagaccgcgatccaggcccactacaaggtgtgccaggccacccaccgcttccgggaggacctgaagaagaccgtcacgccccagaacatcgggcccggctgctaccgcaccctgaacctgttccggtacaagtcccgctgctacatcctcaccatgtggatcctgctgctcgtgatcgagagcatcctgtgggccgcctccgcggccgagatccccctggtgccgctctggaccgacaacgcccacggcgtcgggagcgtgcccatgcacaccgacctggagctggacttctccctccccagctccagcaagtacacgtacaagcggcacctgaccaacccggtgaacgaccagcagtccgtcagcctgcacatcgagatcgagtcccagggcatcggggccgacgtgcaccacctcggccactggtacgacgcccgcctgaacctgaagaccagcttccactgctacggcgcgtgcaccaagtaccagtacccctggcacacggccaagtgccacttcgagaaggactacgagtacgagaactcctgggcctgcaacccgcccgactgccccggggtgggcaccgggtgcaccggctgcgggctctacctggaccagctgaagcccgtcggcaccgccttcaagatcatcagcgtgcgctactcccggaaggtgtgcgtccagttcggcgaggagtacctctgcaagacgatcgacatgaacgactgcttcgtgacccgccacgcgaagatctgcatcatcgggaccgtgagcaagttcagccagggcgacaccctgctgttcctcgggcccatggagggcgggggcatcatcttcaagcactggtgcacgtccacgtgccacttcggcgaccccggggacgtcatgggcccgaaggacaagcccttcatctgccccgagttccccgggcagttccggaagaagtgcaacttcgccaccaccccggtgtgcgagtacgacggcaacgtgatcagcgggtaccgcaaggtcctggccaccatcgactccttccagagcttcaacacctccaacgtgcacttcaccgacgagcggatcgagtggaaggaccccgacggcatgctgcgcgaccacatcaacatcgtgatcagcaaggacatcgacttcgagaacctcgccgagaacccctgcaaggtcggcctgcaggccgcgaacatcgagggggcctggggctccggggtgggcttcaccctgacgtgccaggtgagcctcaccgagtgccccaccttcctgacctccatcaaggcctgcgacatggccatctgctacggggccgagagcgtcacgctgtcccggggccagaacaccatcaagatcaccggccgcgggggccacagcgggtccagcttcaagtgctgccacggcaaggagtgctccgcgaacggcctccaggccagcgccccgcacctggacaaggtgaacgggatctccgagctggagaacgagaaggtgtacgacgacggcgcccccgagtgcgggatcacgtgctggttcaagaagtccggcgagtgggtcatggggatcatcaacggcaactgggtggtgctcatcgtcctgtgcgtgctgctcctgttctccctgatcctcctgagcatcctgtgccccgtgcggaagcacaagaagtcctga

SEQ ID NO: 11822 - RNA, 3402 nt, synthetic construct
  misc_feature 1..3402: note = derived and/or modified CDS sequence (opt1) from SEOV(China)__EU163437.1__GP
  source 1..3402: mol_type = other RNA
atgtggagcctgctcctgctggccgccctcgtgggccaggggttcgccctgaagaacgtcttcgacatgcgcatccagtgcccccactccgtgaagttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgagatcctggagtccgaggtgagcttcaagggcctctgcatgctgaagcaccgcatggtcgaggagtcctaccggaaccgccggagcgtgatctgctacgacctggcctgcaactccaccttctgcaagcccaccgtgtacatgatcgtcccgatccacgcgtgcaacatcatgaagtcctgcctcatcgggctgggcccctaccgcatccaggtggtgtacgagcggacgtactgcaccaccggcatcctgaccgaggggaagtgcttcgtccccgacaaggccgtggtgagcgccctcaagcgcggcatgtacgccatcgcgagcatcgagacgatctgcttcttcatccaccagaaggggaacaagtacaagatcgtcaccgccatcacctccgccatgggcagcaagtgcaacaacaccgacacgaaggtgcaggggtactacatctgcatcatcggcggcaacagcgcccccgtgtacgccccggcgggggaggacttccgggccatggaggtcttctccggcatcatcaccagcccccacggggaggaccacgacctgcccggcgaggagatcgccacctaccagatctccggccagatcgaggccaagatcccccacaccgtgagctcccagaacctgaagctcacggccttcgcggggatcccgagctactccagcacctccatcctggccgccagcgaggacggccgcttcatcttctcccccgggctgttccccaacctcaaccagagcgtgtgcgacaacaacgccctgcccctgatctggcggggcctcatcgacctgaccgggtactacgaggccgtccacccgtgcaacgtgttctgcgtgctgtccggccccggcgcgagctgcgaggccttctccgagggcgggatcttcaacatcaccagccccatgtgcctcgtctccaagcagaaccgcttccgggccgccgagcagcagatcagcttcatctgccagcgcgtggacatggacatcatcgtctactgcaacgggcagaagaagacgatcctgaccaagaccctggtgatcggccagtgcatctacaccatcacgtccctcttcagcctgctgcccggggtggcccacagcatcgcgatcgagctctgcgtcccgggcttccacggctgggccaccgccgccctgctgatcaccttctgcttcgggtgggtgctcatccccgcgtgcaccctggccatcctgctcgtgctgaagttcttcgccaacatcctgcagacgtccaaccaggagaaccggttcaaggccatcctccgcaagatcaaggaggagttcgagaagaccaagggcagcatggtctgcgagatctgcaagtacgagtgcgagaccctgaaggagctgaaggcccacaacctctcctgcgtgcagggggagtgcccctactgcttcacccactgcgagcccacggagaccgcgatccaggcccactacaaggtgtgccaggccacccaccggttccgcgaggacctgaagaagaccgtcacgccgcagaacatcggccccgggtgctaccggaccctgaacctgttccgctacaagagccggtgctacatcctcaccatgtggaccctgctgctcatcatcgagtccatcctgtgggccgccagcgcggccgagatccccctggtgcccctctggaccgacaacgcccacggcgtgggctccgtcccgatgcacacggacctggagctggacttcagcctcccctccagctccaagtacacctacaagcgccacctgaccaaccccgtgaacgaccagcagagcgtgtccctgcacatcgagatcgagagccaggggatcggcgccgacgtccaccacctcgggcactgctacgacgcccgcctgaacctgaagacctccttccactgctacggcgcgtgcacgaagtaccagtacccgtggcacaccgccaagtgccacttcgagaaggactacgagtacgagaacagctgggcctgcaacccgcccgactgccccggcgtggggaccggctgcaccgcctgcgggctctacctggaccagctgaagcccgtgggcacggcgttcaagatcatctccgtccggtacagccgcaaggtgtgcgtgcagttcggggaggagtacctctgcaagaccatcgacatgaacgactgcttcgtcacccggcacgccaagatctgcatcatcggcaccgtgagcaagttctcccagggcgacacgctgctgttcctcgggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaaccggagctacatccacttcaccgacgagcgcatcgagtggcgggacccggacggcatgctgcgcgaccacatcaacatcgtgatctccaaggacatcgacttcgagaacctcgccgagaacccctgcaaggtcgggctgcaggcggccaacatcgagggcgcctggggcctgggggtgggcttcaccctcacgtgccaggtgagcctgaccgagtgccccaccttcctgacctccatcaaggcctgcgacatggccatctgctacggggcggagagcgtcacgctctcccggggccagaacaccgtgaagatcaccgggaagggcggccacagcgggtccagcttcaagtgctgccacggcaaggagtgctccagcaccgggctgcaggcctccgcgccccacctggacaaggtgaacggcatcagcgagctcgagaacgagaaggtctacgacgacggcgccccggagtgcgggatcacgtgctggttcaagaagtccggcgagtgggtgatggggatcatcaacggcaactgggtggtcctgatcgtgctgtgcgtgctcctgctgttcagcctcatcctgctgagcatcctctgccccgtccgcaagcacaagaagtcctga

SEQ ID NO: 11823 - RNA, 3402 nt, synthetic construct
  misc_feature 1..3402: note = derived and/or modified CDS sequence (opt1) from SEOV(DPRK08)__JX853576.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtgcccatctggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccggtacagccgcaaggtgtgcatgcagttcggggaggagtacctgtgcaagaccatcgacatgaacgactgcttcgtgacccggcacgccaagatctgcatcatcggcacggtcagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatctccgggtacaagaaggtcctggccaccatcgacagcttccagtccttcaacaccagcaacatccacttcacggacgagcggatcgagtggcgcgacccggacggcatgctccgggaccacatcaacatcgtgatctccaaggacatcgacttcgagaacctggccgagaacccctgcaaggtggggctgcaggcggccaacatcgagggcgcctggggcagcggggtcggcttcaccctgacctgccaggtgtccctgaccgagtgccccacgttcctgaccagcatcaaggcctgcgacatggccatctgctacggggcggagtccgtgaccctcagccgcggccagaacaccgtcaagatcacggggaagggcggccactccgggagctccttcaagtgctgccacggcaaggagtgcagctccaccgggctgcaggccagcgcgccccacctggacaaggtgaacggcatctccgagctcgagaacgagaaggtgtacgacgacggcgccccggagtgcggggtgacctgctggttcaagaagtccggcgagtgggtcatggggatcatcaacggcaactgggtggtcctgatcgtgctgtgcgtgctcctgctgttcagcctcatcctgctgagcatcctctgccccgtccggaagcacaagaagtcctga

SEQ ID NO: 11824 - RNA, 3402 nt, synthetic construct
  misc_feature 1..3402: note = derived and/or modified CDS sequence (opt1) from SEOV(Fj372/2013)__KP645197.1__GP
  source 1..3402: mol_type = other RNA
atgtggagcctgctcctgctggccgccctcgtgggccccgggttcgcgctgaagaacgtcttcgacatgcgcatccagtgcccgcacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcagaagaaggccaaccaggagtccgccaaccagaacagcttcgaggtggtcgagtccgaggtgagcttcaagggcctgtgcatgctcaagcaccggatggtggaggagtcctaccgcaaccggcgcagcgtcatctgctacgacctggcctgcaactccaccttctgcaagcccaccgtgtacatgatcgtgcccatccacgcgtgcaacatgatgaagtcctgcctgatcgggctcggcccctaccggatccaggtcgtgtacgagcgcacgtactgcaccaccggcatcctgaccgaggggaagtgcttcgtgcccgacaaggccgtcgtgagcgccctgaagcggggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgccccggtgtacgcccccgcgggggaggacttccgcgccatggaggtgttctccggcatcatcaccagcccccacggggaggaccacgacctccccggcgaggagatcgccacctaccagatctccggccagatcgaggccaagatcccgcacacggtcagctccaagaacctgaagctgaccgccttcgcggggatccccagctactccagcacctccatcctcgccgccagcgaggacggccggttcatcttctcccccgggctgttccccaacctgaaccagagcgtgtgcgacaacaacgccctcccgctgatctggcgcggcctgatcgacctcaccgggtactacgaggccgtgcacccctgcaacgtcttctgcgtgctgtccggccccggcgcgagctgcgaggccttctccgagggcgggatcttcaacatcacgagccccatgtgcctggtctccaagcagaaccggttccgcgccgccgagcagcagatcagcttcgtgtgccagcgggtggacatggacatcatcgtctactgcaacgggcagaagaagaccatcctcaccaagaccctggtgatcggccagtgcatctacacgatcacctccctgttcagcctcctgccgggggtggcccacagcatcgcgatcgagctgtgcgtccccggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccgcttcaaggccatcctgcggaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagccgaccgagaccgcgatccaggcccactacaaggtgtgccaggccacccaccgcttccgggaggacctcaagaagacggtcacgccccagaacatcggccccgggtgctaccgcaccctgaacctgttccggtacaagagccgctgctacatcctgaccatgtggaccctcctgctgatcatcgagtccatcctctgggccgccagcgcggccgagatccccctggtgccgctgtggaccgacaacgcccacggcgtgggctccgtccccatgcacaccgacctcgagctggacttcagcctgccctccagctccaagtacacctacaagcggcacctcaccaacccggtgaacgaccagcagagcgtgtccctgcacatcgagatcgagagccaggggatcggcgccgacgtccaccacctggggcactggtacgacgcccgcctcaacctgaagacgtccttccactgctacggcgcgtgcaccaagtaccagtacccctggcacaccgccaagtgccacttcgagaaggactacgagtacgagaacagctgggcctgcaacccgcccgactgccccggcgtggggaccggctgcacggcctgcgggctgtacctcgaccagctgaagcccgtgggcaccgcgttcaagatcatctccgtccgctacagccggaaggtgtgcgtgcagttcggggaggagtacctgtgcaagaccatcgacatgaacgactgcttcgtcacccgccacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtgatgggcccgaaggacaagcccttcatctgccccgagttccccgggcagttccggaagaagtgcaacttcgccaccaccccggtctgcgagtacgacggcaacatcatctccgggtacaagaaggtgctcgccaccatcgacagcttccagtccttcaacaccagcaacatccacttcacggacgagcgcatcgagtggcgggaccccgacggcatgctgcgcgaccacatcaacatcgtgatctccaaggacatcgacttcgagaacctggccgagaacccctgcaaggtcgggctccaggcggccaacatcgagggcgcctggggcagcggggtgggcttcaccctgacctgccaggtgtccctgaccgagtgccccacgttcctcaccagcatcaaggcctgcgacatggccatctgctacggggcggagtccgtcaccctgagccggggccagaacaccgtgaagatcacggggaagggcggccactccgggagctccttcaagtgctgccacggcaaggagtgcagctccaccgggctgcaggccagcgccccgcacctcgacaaggtgaacggcatctccgagctggagaacgagaaggtctacgacgacggcgcccccgagtgcgggatcacgtgctggttcaagaagtccggcgagtgggtgatggggatcatcaacggcaactgggtggtcctgatcgtgctctgcgtgctgctcctgttcagcctgatcctgctcagcatcctgtgccccgtccgcaagcacaagaagtcctga

SEQ ID NO: 11825 - RNA, 3402 nt, synthetic construct
  misc_feature 1..3402: note = derived and/or modified CDS sequence (opt1) from SEOV(HeB38)__JN377554.1__GP
  source 1..3402: mol_type = other RNA
atgtggagcctgctcctgctggccgccctcgtgggccaggggttcgccctgaagaacgtcttcgacatgcgcatccagtgcccccacagcgtgaagttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcagaagaaggccaaccaggagtccgccaaccagaacagcttcgaggtggccgagtccgaggtcagcttcaagggcctgtgcatgctcaagcaccggatggtggaggagtcctaccgcaaccggcgcagcgtgatctgctacgacctggcgtgcaactccaccttctgcaagcccaccgtctacatgatcgtgccgatccacgcctgcaacatgatgaagtcctgcctgatcgggctcggcccctaccggatccaggtggtctacgagcgcacgtactgcaccaccggcatcctgaccgaggggaagtgcttcgtgcccgacaaggccgtggtctccgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccgtccggggaggacttccgcgccatggaggtgttcagcggcatcatcatgagcccccacggggaggaccacgacctccccggcgaggagatcgccacctaccagatcagcggccagatcgaggccaagatcccccacaccgtgtccagcaagaacctgaagctgacggccttcgcggggatcccgtcctacagctccaccagcatcctcgccgcctccgaggacggccggttcatcttcagccccgggctgttccccaacctgaaccagtccgtctgcgacaacaacgccctccccctgatctggcgcggcctgatcgacctcaccgggtactacgaggccgtgcacccgtgcaacgtgttctgcgtcctgagcggccccggcgcgtcctgcgaggccttcagcgagggcgggatcttcaacatcacctcccccatgtgcctggtgagcaagcagaaccggttccgcgccgccgagcagcagatctccttcgtctgccagcgggtggacatggacatcatcgtgtactgcaacgggcagaagaagacgatcctcaccaagaccctggtcatcggccagtgcatctacaccatcacgagcctgttcagcctcctgcccggggtggcccactccatcgcgatcgagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgagcaaccaggagaaccgcttcaaggccatcctgcggaagatcaaggaggagttcgagaagaccaagggctccatggtgtgcgagatctgcaagtacgagtgcgagaccctcaaggagctgaaggcccacaacctgagctgcgtccagggggagtgcccctactgcttcacccactgcgagcccacggagaccgcgatccaggcccactacaaggtgtgccaggccacccaccgcttccgggaggacctcaagaagaccgtgacgccgcagaacatcggccccgggtgctaccgcaccctgaacctgttccggtacaagtcccgctgctacatcctgaccatgtggaccctcctgctgatcatcgagagcatcctctgggccgcctccgcggccgagatccccctggtccccctgtggaccgacaacgcccacggcgtgggcagcgtgccgatgcacacggacctcgagctggacttctccctgcccagctccagcaagtacacctacaagcggcacctcaccaaccccgtcaacgaccagcagtccgtgagcctgcacatcgagatcgagtcccaggggatcggcgccgacgtgcaccacctggggcactggtacgacgcccgcctcaacctgaagaccagcttccactgctacggcgcgtgcacgaagtaccagtacccgtggcacaccgccaagtgccacttcgagaaggactacgagtacgagaactcctgggcctgcaacccgcccgactgccccggcgtcgggaccggctgcaccgcctgcgggctgtacctcgaccagctgaagcccgtgggcacggcgttcaagatcatcagcgtgcgctacagccggaaggtctgcgtgcagttcggggaggagtacctgtgcaagaccatcgacatgaacgactgcttcgtgacccgccacgccaagatctgcatcatcggcaccgtctccaagttcagccagggcgacacgctcctgttcctggggcccatggagggcgggggcatcatcttcaagcactggtgcacctccacgtgccacttcggggaccccggcgacgtgatgggccccaaggacaagccgttcatctgccccgagttccccgggcagttccggaagaagtgcaacttcgccaccacccccgtgtgcgagtacgacggcaacatcatcagcgggtacaagaaggtcctcgccaccatcgactccttccagagcttcaacacctccaacatccacttcaccgacgagcgcatcgagtggcgggacccggacggcatgctgcgcgaccacatcaacatcgtgatcagcaaggacatcgacttcgagaacctggccgagaacccctgcaaggtggggctccaggcggccaacatcgagggcgcctggggctccggggtcggcttcacgctgacctgccaggtgagcctgaccgagtgccccaccttcctcacgtccatcaaggcctgcgacatggccatctgctacggggcggagagcgtgaccctgctgcggggccagaacaccgtcaagatcaccgggaagggcggccactccgggagctccttcaagtgctgccacggcaaggagtgcagctccacggggctccaggccagcgcgccccacctggacaaggtgaacggcatctccgagctggagaacgagaaggtgtacgacgacggcgccccggagtgcgggatcacgtgctggttcaagaagtccggcgagtgggtcatggggatcatcaacggcaactgggtggtgctcatcgtcctgtgcgtgctgctcctgttcagcctgatcctcctgagcatcctgtgccccgtgcgcaagcacaagaagtcctga

SEQ ID NO: 11826 - RNA, 3402 nt, synthetic construct
  misc_feature 1..3402: note = derived and/or modified CDS sequence (opt1) from SEOV(JiangxiXinjianRn-07-2011)__KP859513.1__GP
  source 1..3402: mol_type = other RNA
atgtggagcctgctcctgctggccgccctcgtgggccagtgcttcgccctgaagaacgtcttcgacatgcgcatccagtgcccccacagcgtgaacttcggggagaccagcgtgtccggctacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaaggggctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcggcctcgggccctaccgcatccaggtcgtgtacgagcggacgtactgcaccaccggcatcctgaccgagggcaagtgcttcgtgcccgacaaggccgtcgtgagcgccctgaagcgcgggatgtacgccatcgcgagcatcgagacgatctgcttcttcatccaccagaagggcaacacctacaagatcgtgaccgccatcacctccgccatggggagcaagtgcaacaacacggacaccaaggtccagggctactacatctgcatcatcgggggcaacagcgcccccgtgtacgccccggcgggcgaggacttccgggccatggaggtgttctccgggatcatcaccagcccccacggcgaggaccacgacctccccggggaggagatcgccacctaccagatctccggccagatcgaggccaagatcccccacacggtcagctccaagaacctgaagctgaccgccttcgcgggcatcccgagctactccagcacctccatcctcgccgccagcgaggacgggcgcttcatcttctcccccggcctgttccccaacctgaaccagagcgtgtgcgacaacaacgccctccccctgatctggcgggggctgatcgacctcaccggctactacgaggccgtgcacccgtgcaacgtcttctgcgtgctgtccgggcccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacggccagaagaagaccatcctcaccaagaccctggtgatcgggcagtgcatctacacgatcacctccctgttcagcctcctgcccggcgtggcccacagcatcgcgatcgagctgtgcgtcccggggttccacggctgggccaccgccgccctcctgatcaccttctgcttcggctgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaaggggagcatggtctgcgagatctgcaagtacgagtgcgagaccctcaaggagctgaaggcccacaacctgtcctgcgtgcagggcgagtgcccctactgcttcacgcactgcgagcccaccgagaccgcgatccaggcccactacaaggtgtgccaggccacccaccggttccgcgaggacctcaagaagacggtcaccccgcagaacatcgggcccggctgctaccggaccctgaacctgttccgctacaagagccggtgctacatcctgaccatgtggaccctcctgctgatcatcgagtccatcctctgggccgccagcgcggccgagatccccctggtgcccctgtggacggacaacgcccacggggtgggctccgtcccgatgcacaccgacctcgagctggacttcagcctgccctccagctccaagtacacctacaagcgccacctcaccaaccccgtgaacgaccagcagagcgtgtccctgcacatcgagatcgagagccagggcatcggggccgacgtccaccacctgggccactggtacgacgcccgcctcaacctgaagacgtccttccactgctacggggcgtgcaccaagtaccagtacccgtggcacaccgccaagtgccacttcgagaaggactacgagtacgagaacagctgggcctgcaacccgcccgactgccccggcgtgggcaccgggtgcacggcctgcggcctgtacctcgaccagctgaagcccgtggggaccgcgttcaagatcatctccgtccggtacagccgcaaggtgtgcgtgcagttcggcgaggagtacttctgcaagaccatcgacatgaacgactgcttcgtcacccggcacgccaagatctgcatcatcgggacggtgagcaagttctcccagggcgacaccctcctcttcctgggccccatggagggcggcgggatcatcttcaagcactggtgcaccagcacgtgccacttcggggaccccggggacgtgatgggccccaaggacaagccgttcatctgccccgagttccccggccagttccgcaagaagtgcaacttcgccaccacccccgtctgcgagtacgacgggaacatcatctccggctacaagaaggtgctggccaccatcgacagcttccagtccttcaacaccagcaacatccacttcacggacgagcggatcgagtggcgcgacccggacgggatgctccgggaccacatcaacatcgtgatctccaaggacatcgacttcgagaacctggccgagaacccctgcaaggtcggcctgcaggcggccaacatcgagggggcctggggcagcggcgtggggttcaccctgacctgccaggtgtccctgaccgagtgccccacgttcctgaccagcatcaaggcctgcgacatggccatctgctacggcgcggagtccgtcaccctcagccgcgggcagaacaccgtgaagatcacgggcaagggcgggcactccggcagctccttcaagtgctgccacgggaaggagtgcagctccaccggcctgcaggccagcgcgccccacctggacaaggtgaacgggatctccgagctcgagaacgagaaggtctacgacgacggcgccccggagtgcggcatcacgtgctggttcaagaagtccggggagtgggtgatgggcatcatcaacgggaactgggtggtcctgatcgtgctgtgcgtgctcctgctgttcagcctcatcctgctgagcatcctctgccccgtccggaagcacaagaagtcctga

SEQ ID NO: 11827 - RNA, 3402 nt, synthetic construct
  misc_feature 1..3402: note = derived and/or modified CDS sequence (opt1) from SEOV(LYON/Rn/FRA/2013/LYO852)__KF387724.1__GP
  source 1..3402: mol_type = other RNA
atgtggagcctgctcctgctggccgccctcgccggccaggggttcgccctgaagaacgtgttcgacatgcgcatccagtgcccccacagcgtcaacttcggcgagaccagcgtgtccgggtacaccgagctgccgcccctcagcctgcaggaggccgagcagctggtgcccgagtccagctgcaacatggacaaccaccagtccctcagcaccatcaacaagctgaccaaggtcatctggcggaagaaggccaaccaggagtccgccagccagaactccttcgaggtggtggagagcgaggtctccttcaagggcctgtgcatgctccgccaccggatggtggaggagagctacaagaaccgccggtccgtgatctgctacgacctggcgtgcaacagcaccttctgcaagcccaccgtctacatgatcgtgccgatccacgcctgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgcgatcgcctccatcgagacgatctgcttcttcatccaccagaaggggaacacctacaagatcgtgaccgccatcaccagcgccatgggcagcaagtgcaacaacacggacaccaaggtgcaggggtactacatctgcatcatcggcggcaactccgcccccgtctacgcgccggccggggaggacttccgggccatggaggtgttcagcggcatcatcaccagcccccacggggaggaccacgacctccccggcgaggagatcgccacctaccagatcagcggccagatcgaggccaagatcccccacacggtgtccagcaagaacctgaagctgaccgcgttcgccgggatcccgtcctacagctccaccagcatcctcgccgcctccgaggacggccgcttcatcttcagccccgggctgttccccaacctgaaccagtccgtctgcgacaacaacgccctccccctgatctggcggggcctgatcgacctcaccgggtactacgaggcggtgcacccgtgcaacgtgttctgcgtcctgagcggccccggcgcctcctgcgaggccttcagcgagggcgggatcttcaacatcacgtcccccatgtgcctggtgagcaagcagaaccgcttccgggccgccgagcagcagatctccttcgtctgccagcgcgtggacatggacatcatcgtgtactgcaacgggcagaagaagaccatcctcaccaagaccctggtcatcggccagtgcatctacacgatcaccagcctgttcagcctcctgcccggggtggcgcactccatcgccatcgagctgtgcgtgccgggcttccacggctgggccaccgccgcgctcctgatcaccttctgcttcgggtgggtcctgatccccgcctgcacgctcgccatcctgctggtgctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcgcacaacctgagctgcgtccagggggagtgcccctactgcttcacgcactgcgagcccaccgagaccgccatccaggcccactacaaggtgtgccaggccacccaccggttccgcgaggacctcaagaagacggtgaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctggtccccctgtggacggacaacgcccacggcgtgggcagcgtgccgatgcacaccgacctcgagctggacttctccctgcccagctccagcaagtacacctacaagcgccacctcaccaaccccgtcaacgaccagcagtccgtgagcctgcacatcgagatcgagtcccaggggatcggcgccgacgtgcaccacctggggcactggtacgacgcgcgcctcaacctgaagacgagcttccactgctacggcgcctgcaccaagtaccagtacccgtggcacaccgccaagtgccacttcgagaaggactacgagtacgagaactcctgggcctgcaacccgcccgactgccccggcgtcgggaccggctgcacggcgtgcgggctgtacctcgaccagctgaagcccgtgggcaccgccttcaagatcatcagcgtgcggtacagccgcaaggtctgcgtgcagttcggggaggagtacctgtgcaagaccatcgacatgaacgactgcttcgtgacccggcacgccaagatctgcatcatcggcacggtctccaagttcagccagggcgacaccctcctgttcctggggcccatggagggcgggggcatcatcttcaagcactggtgcacctccacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatcagcgggtacaagaaggtcctcgccaccatcgactccttccagagcttcaacacctccaacatccacttcacggacgagcggatcgagtggcgcgacccggacggcatgctgcgggaccacatcaacatcatcatcagcaaggacatcgacttcgagaacctggcggagaacccctgcaaggtggggctccaggccgccaacatcgagggcgcctggggctccggggtgggcttcaccctgacctgccaggtcagcctgaccgagtgccccacgttcctcacctccatcaaggcctgcgacatggcgatctgctacggggccgagagcgtgaccctgtcccgcggccagaacaccgtgaagatcacggggaagggcggccacagcgggtccagcttcaagtgctgccacggcaaggagtgctccctgaccgggctccaggccagcgcgccccacctggacaaggtcaacggcatctccgagctggagaacgagaaggtgtacgacgacggcgccccggagtgcgggatcacgtgctggttcaagaagtccggcgagtgggtgatggggatcatcaacggcaactgggtcgtgctcatcgtgctgtgcgtcttcctcctgttcagcctgatcctgctctccatcctgtgccccgtgcggaagcacaagaagtcctga

SEQ ID NO: 11828 - RNA, 3402 nt, synthetic construct
  misc_feature 1..3402: note = derived and/or modified CDS sequence (opt1) from SEOV(Seoul-Baxter/NYC-D1_M)__KJ950863.1__GP
  source 1..3402: mol_type = other RNA
atgtggagcctgctcctgctggccgccctcgtgggccaggggttcgccctgaagaacgtcttcgacatgaagatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcgcaagaaggccaaccaggagtccgccaaccagaacagcttcgaggtggccgagtccgaggtcagcttcaagggcctgtgcatgctcaagcaccggatggtggaggagtcctaccgcaaccggcgcagcgtgatctgctacgacctggcgtgcaactccaccttctgcaagcccaccgtctacatgatcgtgccgatccacgcctgcaacatgatgaagtcctgcctgatcgggctcggcccctaccggatccaggtggtctacgagcgcacgtactgcaccaccggcatcctgaccgaggggaagtgcttcgtgcccgacaaggccgtggtcagcgccctgaagcggggcatgtacgcgatcgccagcatcgagacgatctgcttcttcatccaccagaaggggaacacctacaagatcgtgaccgccatcacctccgccatgggcagcaagtgcaacgacacggacaccaaggtgcaggggtactacatctgcatcatcggcggcaacagcgcccccgtctacgcgccggccggggaggacttccgcgccatggaggtgttctccggcatcatcaccagcccccacggggaggaccacgacctccccggcgaggagatcgccacctaccagatctccggccagatcgaggccaagatcccccacacggtgagctccaagaacctgaagctgaccgcgttcgccgggatcccgagctactccagcacctccatcctcgccgccagcgaggacggccggttcatcttctcccccgggctgttccccaacctgaaccagagcgtctgcgacaacaacgccctccccctggtgtggcgcggcctgatcgacctcaccgggtactacgaggcggtgcacccgtgcaacgtcttctgcgtgctgtccggccccggcgccagctgcgaggccttctccgagggcgggatcttcaacatcacgagccccatgtgcctggtctccaagcagaaccggttccgcgccgccgagcagcagatcagcttcgtgtgccagcgggtggacatggacatcatcgtctactgcaacgggcagaagaagaccatcctcaccaagaccctggtgatcggccagtgcatctacacgatcacctccctgttcagcctcctgcccggggtggcgcacagcatcgccatcgagctgtgcgtcccgggcttccacggctgggccaccgccgcgctcctgatcaccttctgcttcgggtgggtgctgatccccgcctgcacgctcgccatcctgctggtgctcaagttcttcgccaacatcctgcacacctccaaccaggagaaccgcttcaaggccatcctgcggaagatcaaggaggagttcgagaagaccaagggcagcatggtctgcgagatctgcaagtacgagtgcgagaccctcaaggagctgaaggcgcacaacctgtcctgcgtgcagggggagtgcccctactgcttcacgcactgcgagcccaccgagaccgccatccaggcccactacaaggtgtgccaggccacccaccgcttccgggaggacctcaagaagacggtcaccccgcagaacatcggccccgggtgctaccgcaccctgaacctgttccggtacaagagccgctgctacatcctgaccatgtggaccctcctgctgatcatcgagtccatcctctgggccgcgagcgccgccgagatccccctggtgcccctgtggacggacaacgcccacggcgtgggctccgtcccgatgcacaccgacctcgagctggacttcagcctgccctccagctccaagtacacctacaagcggcacctcaccaaccccgtgaacgaccagcagagcgtgtccctgcacatcgagatcgagagccaggggatcggcgccgacgtccaccacctggggcactggtacgacgcgcgcctcaacctgaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctcgaccagctgaagcccgtgggcaccgccttcaagatcatctccgtccgctacagccggaaggtgtgcctgcagttcggggaggagtacctctgcaagaccatcgacatgaacgactgcttcgtgacccgccacgtcaagatctgcatcatcggcacggtgagcaagttctcccagggcgacaccctgctgttcctcgggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacaccagcaacatccacttcacggacgagcgcatcgagtggcgggacccggacggcatgctgcgcgaccacatcaacatcgtgatctccaaggacatcgacttcgagaacctcgccgagaacccctgcaaggtcgggctgcaggcggccaacatcgagggcgcctggggcagcggggtgggcttcaccctgacctgccaggtgtccctcaccgagtgccccacgttcctgaccagcatcaaggcctgcgacatggccatctgctacggggcggagtccgtcaccctgagccggggccagaacaccgtgaagatcacggggaagggcggccactccgggagctccttcaagtgctgccacggcaaggagtgcagctccaccgggctccaggccagcgcgccccacctggacaaggtgaacggcatctccgagctggagaacgagaaggtctacgacgacggcgccccggagtgcgggatcacgtgctggttcaagaagtccggcgagtgggtgatggggatcatcaacggcaactgggtggtcctcatcgtgctgtgcgtgctgctcctgttcagcctgatcctcctgagcatcctgtgccccgtccgcaagcacaagaagtcctga

SEQ ID NO: 11829 - RNA, 3402 nt, synthetic construct
  misc_feature 1..3402: note = derived and/or modified CDS sequence (opt1) from SEOV(Singapore/06(RN41))__GQ274942.1__GP
  source 1..3402: mol_type = other RNA
atgtggagcctgctcctgctggccgccctcgccggccaggggttcgccctgaagaacgtgttcgacatgcgcatccagtgcccccactccgtcaacttcggcgagaccagcgtgtccgggtacaccgagctgccgcccctcagcctgcaggaggccgagcagctggtgcccgagtccagctgcaacatggacaaccaccagtccctcagcaccatcaacaagctgaccaaggtcatctggcggaagaaggccaaccaggagtccgccagccagaactccttcgaggtggtggagagcgagatctccttcaagggcctgtgcatgctcaagcaccgcatggtcgaggagagctaccggaaccgccggtccgtgatctgctacgacctggcgtgcaacagcaccttctgcaagcccaccgtgtacatgatcgtcccgatccacgcctgcaacatgatgaagtcctgcctgatcgggctcggcccctaccgcatccaggtggtgtacgagcggacgtactgcaccaccggcatcctgaccgaggggaagtgcttcgtccccgacaaggccgtggtgagcgccctgaagcgcggcatgtacgcgatcgcctccatcgagacgatctgcttcttcatccaccagaaggggaacacctacaagatcgtcaccgccatcaccagcgccatgggcagcaagtgcaacaacacggacaccaaggtgcaggggtactacatctgcatcatcggcggcaactccgcccccgtgtacgcgccggccggggaggacttccgggccatggaggtcttcagcggcatcatcaccagcccccacggggaggaccacgacctccccggcgaggagatcgccacctaccagatcagcggccagatcgaggccaagatcccccacacggtgtccagcaagaacctgaagctgaccgcgttcgccgggatcccgtcctacagctccaccagcatcctcgccgcctccgaggacggccgcttcatcttcagccccgggctgttccccaacctgaaccagtccgtgtgcgacaacaacgccctccccctgatctggcggggcctgatcgacctcaccgggtactacgaggcggtccacccgtgcaacgtgttctgcgtgctgagcggccccggcgcctcctgcgaggccttcagcgagggcgggatcttcaacatcacgtcccccatgtgcctggtcagcaagcagaaccgcttccgggccgccgagcagcagatctccttcgtgtgccagcgcgtcgacatggacatcatcgtgtactgcaacgggcagaagaagaccatcctcaccaagaccctggtgatcggccagtgcatctacacgatcaccagcctgttcagcctcctgcccggggtcgcgcactccatcgccatcgagctgtgcgtgccgggcttccacggctgggccaccgccgcgctcctgatcaccttctgcttcgggtgggtgctgatccccgcctgcacgctcgccatcctgctggtcctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcgcacaacctgagctgcgtgcagggggagtgcccctactgcttcacgcactgcgagcccaccgagaccgccatccaggcccactacaaggtctgccaggccacccaccggttccgcgaggacctcaagaagacggtgaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctggtgcccctgtggacggacaacgcccacggcgtcggcagcgtgccgatgcacaccgacctcgagctggacttctccctgcccagctccagcaagtacacctacaagcgccacctcaccaaccccgtgaacgaccagcagtccgtcagcctgcacatcgagatcgagtcccaggggatcggcgccgacgtgcaccacctggggcactggtacgacgcgcgcctcaacctgaagacgagcttccactgctacggcgcctgcaccaagtaccagtacccgtggcacaccgccaagtgccacttcgagaaggactacgagtacgagaactcctgggcctgcaacccgcccgactgccccggcgtggggaccggctgcacggcgtgcgggctgtacctcgaccagctgaagcccgtcggcaccgccttcaagatcatcagcgtgcggtacagccgcaaggtgtgcgtccagttcggggaggagtacctgtgcaagaccatcgacatgaacgactgcttcgtgacccggcacgccaagatctgcatcatcggcacggtgtccaagttcagccagggcgacaccctcctgttcctggggcccatggagggcgggggcatcatcttcaagcactggtgcacctccacgtgccacttcggggaccccggcgacgtcatgggccccaaggacaagccgttcatctgccccgagttccccgggcagttccgcaagaagtgcaacttcgccaccacccccgtgtgcgagtacgacggcaacatcatcagcgggtacaagaaggtgctcgccaccatcgactccttccagagcttcaacacctccaacatccacttcacggacgagcggatcgagtggcgcgacccggacggcatgctgcgggaccacatcaacatcgtcatcagcaaggacatcgacttcgagaacctggcggagaacccctgcaaggtggggctccaggccgccaacatcgagggcgcctggggctccggggtgggcttcaccctgacctgccaggtcagcctgaccgagtgccccacgttcctcacctccatcaaggcctgcgacatggcgatctgctacggggccgagagcgtgaccctgtcccgcggccagaacaccgtgaagatcacggggaagggcggccacagcgggtccagcttcaagtgctgccacggcaaggagtgctccagcaccgggctgcaggcctccgcgccccacctcgacaaggtcaacggcatcagcgagctggagaacgagaaggtgtacgacgacggcgccccggagtgcgggatcacgtgctggttcaagaagtccggcgagtgggtgatggggatcatcaacggcaactgggtcgtgctgatcgtgctctgcgtcctgctcctgttctccctgatcctgctcagcatcctgtgccccgtgcggaagcacaagaagtcctga

SEQ ID NO: 11830 - RNA, 3402 nt, synthetic construct
  misc_feature 1..3402: note = derived and/or modified CDS sequence (opt1) from SEOV(11CSG)__AB618131.1__GP
  source 1..3402: mol_type = other RNA
atgtggagcctgctcctgctggccgccctcgccggccaggggttcgccctgaagaacgtgttcgacatgcgcatccagtgcccccactccgtcaacttcggcgagaccagcgtgtccgggtacaccgagctgccgcccctcagcctgcaggaggccgagcagctggtgcccgagtccagctgcaacatggacaaccaccagtccctcagcaccatcaacaagctgaccaaggtcatctggcggaagaaggccaaccaggagtccgccagccagaactccttcgaggtggtggagagcgaggtctccttcaagggcctgtgcatgctcaagcaccgcatggtggaggagagctaccggaaccgccggtccgtgatctgctacgacctggcgtgcaacagcaccttctgcaagcccaccgtctacatgatcgtgccgatccacgcctgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgcgatcgcctccatcgagacgatctgcttcttcgtgcaccagaaggggaacacctacaagatcgtgaccgccatcaccagcgccatgggcagcaagtgcaacaacacggacaccaaggtccaggggtactacatctgcatcatcggcggcaactccgcccccgtgtacgcgccggccggggaggacttccgggccatggaggtgttcagcggcatcatcaccagcccccacggggaggaccacgacctccccggcgaggagatcgccacctaccagatcagcggccagatcgaggccaagttcccccacacggtctccagcaagaacctgaagctgaccgcgttcgccgggatcccgtcctacagctccaccagcatcctcgccgcctccgaggacggccgcttcatcttcagccccgggctgttccccaacctgaaccagtccgtgtgcgacaacaacgccctccccctgatctggcggggcctgatcgacctcaccgggtactacgaggcggtgcacccgtgcaacgtcttctgcgtgctgagcggccccggcgcctcctgcgaggccttcagcgagggcgggatcttcaacatcacgtcccccatgtgcctggtcagcaagcagaaccgcttccgggccgccgagcagcagatctccttcgtgtgccagcgcgtggacatggacatcatcgtctactgcaacgggcagaagaagaccatcctcaccaagaccctggtgatcggccagtgcatctacacgatcaccagcctgttcagcctcctgcccggggtggcgcactccatcgccatcgagctgtgcgtcccgggcttccacggctgggccaccgccgcgctcctgatcaccttctgcttcgggtgggtgctgatccccgcctgcacgctcgccatcctgctggtgctcaagttcttcgccaacatcctgcacaccagcaaccaggagaaccggttcaaggccatcctgcgcaagatcaaggaggagttcgagaagaccaagggctccatggtctgcgagatctgcaagtacgagtgcgagaccctcaaggagctgaaggcgcacaacctgagctgcgtgcagggggagtgcccctactgcttcacgcactgcgagcccaccgagaccgccatccaggcccactacaaggtgtgccaggccacccaccggttccgcgaggacctcaagaagacggtcaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctggtgcccctgtggacggacaacgcccacggcgtgggcagcgtcccgatgcacaccgacctcgagctggacttctccctgcccagctccagcaagtacacctacaagcgccacctcaccaaccccgtgaacgaccagcagtccgtgagcctgcacatcgagatcgagtcccaggggatcggcgccgacgtccaccacctggggcactggtacgacgcgcgcctcaacctgaagacgagcttccactgctacggcgcctgcaccaagtaccagtacccgtggcacaccgccaagtgccacttcgagaaggactacgagtacgagaactcctgggcctgcaacccgcccgactgccccggcgtggggaccggctgcacggcgtgcgggctgtacctcgaccagctgaagcccgtgggcaccgccttcaagatcatcagcgtccggtacagccgcaaggtgtgcgtgcagttcggggaggagtacctgtgcaagaccatcgacatgaacgactgcttcgtcacccggcacgccaagatctgcatcatcggcacggtgtccaagttcagccagggcgacaccctcctgttcctggggcccatggagggcgggggcatcatcttcaagcactggtgcacctccacgtgccacttcggggaccccggcgacgtgatgggccccaaggacaagccgttcatctgccccgagttccccgggcagttccgcaagaagtgcaacttcgccaccacccccgtctgcgagtacgacggcaacaccatcagcgggtacaagaaggtgctcgccaccatcgactccttccagagcttcaacacgtccaacatccacttcaccgacgagcggatcgagtggcgcgacccggacggcatgctgcgggaccacatcaacatcgtgatcagcaaggacatcgacttcgagaacctggcggagaacccctgcaaggtcgggctccaggccgccaacatcgagggcgcctggggctccggggtgggcttcaccctgacctgccaggtgagcctgacggagtgccccaccttcctcacctccatcaaggcctgcgacatggcgatctgctacggggccgagagcgtcaccctgtcccgcggccagaacacggtgaagatcaccgggaagggcggccacagcgggtccagcttcaagtgctgccacggcaaggagtgctccagcaccgggctgcaggcctccgcgccccacctcgacaaggtgaacggcatcagcgagctggagaacgagaaggtctacgacgacggcgccccggagtgcgggatcacgtgctggttcaagaagtccggcgagtgggtgatggggatcatcaacggcaactggatcgtgctgatcgtcctctgcgtgctgctcctgttctccctgatcctgctcagcatcctgtgccccgtgcggaagcacaagaagtcctga

SEQ ID NO: 11831 - RNA, 3402 nt, synthetic construct
  misc_feature 1..3402: note = derived and/or modified CDS sequence (opt1) from SEOV(5CSG)__AB618130.1__GP
  source 1..3402: mol_type = other RNA
atgtggagcctgctcctgctggccgccctcgccggccaggggttcgccctgaagaacgtgttcgacatgcgcatccagtgcccccactccgtcaacttcggcgagaccagcgtgtccgggtacaccgagctgccgcccctcagcctgcaggaggccgagcagctggtgcccgagtccagctgcaacatggacaaccaccagtccctcagcaccatcaacaagctgaccaaggtcatctggcggaagaaggccaaccaggagtccgccagccagaactccttcgaggtggtggagagcgaggtctccttcaagggcctgtgcatgctcaagcaccgcatggtggaggagagctaccggaaccgccggtccgtgatctgctacgacctggcgtgcaacagcaccttctgcaagcccaccgtctacatgatcgtgccgatccacgcctgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgcgatcgcctccatcgagacgatctgcttcttcatccaccagaaggggaacacctacaagatcgtgaccgccatcaccagcgccatgggcagcaagtgcaacaacacggacaccaaggtgcaggggtactacatctgcatcatcggcggcaactccgcccccgtctacgcgccggccggggaggacttccgggccatggaggtgttcagcggcatcatcaccagcccccacggggaggaccacgacctccccggcgaggagatcgccacctaccagatcagcggccagatcgaggccaagatcccccacacggtgtccagcaagaacctgaagctgaccgcgttcgccgggatcccgtcctacagctccaccagcatcctcgccgcctccgaggacggccgcttcatcttcagccccgggctgttccccaacctgaaccagtccgtctgcgacaacaacgccctccccctgatctggcggggcctgatcgacctcaccgggtactacgaggcgatccacccgtgcaacgtgttctgcgtgctgagcggccccggcgcctcctgcgaggccttcagcgagggcgggatcttcaacatcacgtcccccatgtgcctggtcagcaagcagaaccgcttccgggccgccgagcagcagatctccttcgtgtgccagcgcgtcgacatggacatcatcgtgtactgcaacgggcagaagaagaccatcctcaccaagaccctggtgatcggccagtgcatctacacgatcaccagcctgttcagcctcctgcccggggtcgcgcactccatcgccatcgagctgtgcgtgccgggcttccacggctgggccaccgccgcgctcctgatcaccttctgcttcgggtgggtgctgatccccgcctgcacgctcgccatcctgctggtcctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcgcacaacctgagctgcgtgcagggggagtgcccctactgcttcacgcactgcgagcccaccgagaccgccatccaggcccactacaaggtctgccaggccacccaccggttccgcgaggacctcaagaagacggtgaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctggtgcccctgtggacggacaacgcccacggcgtcggcagcgtgccgatgcacaccgacctcgagctggacttctccctgcccagctccagcaagtacacctacaagcgccacctcaccaaccccgtgaacgaccagcagtccgtcagcgtgcacatcgagatcgagtcccaggggatcggcgccgacgtgcaccacctggggcactggtacgacgcgcgcctgaacctcaagacgagcttccactgctacggcgcctgcaccaagtaccagtacccgtggcacaccgccaagtgccacttcgagaaggactacgagtacgagaactcctgggcctgcaacccgcccgactgccccggcgtcgggaccggctgcacggcgtgcgggctgtacctggaccagctcaagcccgtgggcaccgccttcaagatcatcagcgtgcggtacagccgcaaggtctgcgtgcagttcggggaggagtacctgtgcaagaccatcgacatgaacgactgcttcgtgacccggcacgccaagatctgcatcatcggcacggtctccaagttcagccagggcgacaccctcctcttcctggggcccatggagggcgggggcatcatcttcaagcactggtgcacctccacgtgccacttcggggaccccggcgacgtgatgggccccaaggacaagccgttcatctgccccgagttccccgggcagttccgcaagaagtgcaacttcgccaccacccccgtgtgcgagtacgacggcaacaccatcagcgggtacaagaaggtcctggccaccatcgactccttccagagcttcaacacgtccaacatccacttcaccgacgagcggatcgagtggcgcgacccggacggcatgctccgggaccacatcaacatcgtgatcagcaaggacatcgacttcgagaacctggcggagaacccctgcaaggtggggctgcaggccgccaacatcgagggcgcctggggctccggggtcggcttcaccctgacctgccaggtgagcctgacggagtgccccaccttcctgacctccatcaaggcctgcgacatggcgatctgctacggggccgagagcgtgaccctctcccgcggccagaacacggtcaagatcaccgggaagggcggccacagcgggtccagcttcaagtgctgccacggcaaggagtgctccagcaccgggctgcaggcctccgcgccccacctggacaaggtgaacggcatcagcgagctcgagaacgagaaggtgtacgacgacggcgccccggagtgcgggatcacgtgctggttcaagaagtccggcgagtgggtcatggggatcatcaacggcaactgggtggtgctgatcgtcctgtgcgtgctcctgctgttctccctcatcctgctgagcatcctctgccccgtgcggaagcacaagaagtcctga

SEQ ID NO: 11832 - RNA, 3402 nt, synthetic construct
  misc_feature 1..3402: note = derived and/or modified CDS sequence (opt1) from SEOV(80-39)__S47716.1__GP
  source 1..3402: mol_type = other RNA
atgtggagcctgctcctgctggccgccctcgtgggccaggggttcgccctgaagaacgtcttcgacatgcgcatccagtgcccccactccgtgaagttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgagctgatggagtccgaggtgagcttcaagggcctctgcatgctgaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctcatcgggctgggcccctaccgcgtccaggtggtgtacgagcggacgtactgcaccaccggcatcctgaccgaggggaagtgcttcgtgcccgacaaggccgtggtcagcgccctcaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgccccggcgggggaggacttccgggccatggaggtgttctccggcatcatcaccagcccccacggggaggaccacgacctgcccggcgaggagatcgccacctaccagatctccggccagatcgaggccaagatcccccacacggtgagctccaagaacctgaagctcaccgccttcgcggggatcccgagctactccagcacctccatcctgaccgccagcgaggacggccgcttcatcttctcccccgggctgttccccaacctcaaccagagcgtctgcgacaacaacgccctgcccctgatctggcggggcctcatcgacctgacggggtactacgaggccgtgcacccgtgcaacgtgttctgcgtcctgtccggccccggcgccagctgcgaggcgttctccgagggcgggatcttcaacatcaccagccccatgtgcctcgtgtccaagcagaaccgcttccgggccgccgagcagcagatcagcttcgtctgccagcgcgtggacatggacatcatcgtgtactgcaacgggcagaagaagaccatcctgaccaagacgctggtcatcggccagtgcatctacaccatcacctccctcttcagcctgctgcccggggtggcccacagcatcgccatcgagctctgcgtgccgggcttccacggctgggcgaccgccgccctgctgatcacgttctgcttcgggtgggtcctcatccccgcctgcaccctggcgatcctgctcgtgctgaagttcttcgccaacatcctgcacacctccaaccaggagaaccggttcaaggccatcctccgcaagatcaaggaggagttcgagaagaccaagggcagcatggtgtgcgagatctgcaagtacgagtgcgagacgctgaaggagctgaaggcccacaacctctcctgcgtccagggggagtgcccctactgcttcacccactgcgagcccaccgagaccgccatccaggcgcactacaaggtgtgccaggccacgcaccggttccgcgaggacctgaagaagaccgtgaccccgcagaacatcggccccgggtgctaccggaccctgaacctgttccgctacaagagccggtgctacatcctcaccatgtggacgctgctgctcatcatcgagtccatcctgtgggccgccagcgccgcggagatccccctggtccccctctggaccgacaacgcccacggcgtgggctccgtgccgatgcacaccgacctggagctggacttcagcctcccctccagctcccgctacacctacaagcgccacctgacgaaccccgtcaacgaccagcagagcgtgtccctgcacatcgagatcgagagccaggggatcggcgccgacgtgcaccacctcgggcactggtacgacgcccggctgaacctgaagacctccttccactgctacggcgcctgcaccaagtaccagtacccgtggcacaccgcgaagtgccacttcgagaaggactacgagtacgagaacagctgggcctgcaacccgcccgactgccccggcgtcgggacgggctgcaccgcctgcgggctctacctggaccagctgaagcccgtgggcaccgccttcaagatcatctccgtgcgctacagccggaaggtctgcgtgcagttcggggaggagtacctctgcaagaccatcgacatgaacgactgcttcgtgacgcgccacgcgaagatctgcatcatcggcaccgtcagcaagttctcccagggcgacaccctgctgttcctcgggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtgtgcgagtacgacggcaacatcatctccgggtacaagaaggtcctggccaccatcgacagcttccagtccttcaacacgagcaacatccacttcaccgacgagcgcatcgagtggcgggacccggacggcatgctgcgcgaccacatcaacatcgtgatctccaaggacatcgacttcgagaacctcgccgagaacccctgcaaggtggggctgcaggccgcgaacatcgagggcgcctggggcagcggggtcggcttcaccctgacctgccaggtgtccctcacggagtgccccaccttcctgaccagcatccgggcctgcgacatggccatctgctacggggccgagtccgtgaccctgagccgcggccagaacacggtcaagatcaccgggaagggcggccactccgggagctccttcaagtgctgccacggcaaggagtgcagcctcaccgggctgcaggcgtccgcgccccacctggacaaggtgaacggcatcagcgagctcgagaacgagaaggtgtacgacgacggcgccccggagtgcgggatcacgtgctggttcaagaagtccggcgagtgggtcatggggatcatcaacggcaactgggtggtgctgatcgtcctgtgcgtgctcctgctgttcagcctcatcctgctgagcatcctctgccccgtgcggaagcacaagaagtcctga

SEQ ID NO: 11833 - RNA, 3402 nt, synthetic construct
  misc_feature 1..3402: note = derived and/or modified CDS sequence (opt1) from SEOV(93HBQ3)__KM115585.1__GP
  source 1..3402: mol_type = other RNA
atgtggagcctgctcctgctggccgccctcgtgggccaggggttcgccctgaagaacgtcttcgacatgcgcatccagtgcccccacagcgtgaagttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcagaagaaggccaaccaggagtccgccaaccagaacagcttcgaggtggccgagtccgaggtcagcttcaagggcctgtgcatgctcaagcaccggatggtggaggagtcctaccgcaaccggcgcagcgtgatctgctacgacctggcgtgcaactccaccttctgcaagcccaccgtctacatgatcgtgccgatccacgcctgcaacatgatgaagtcctgcctgatcgggctcggcccctaccggatccaggtggtctacgagcgcacgtactgcaccaccggcatcctgaccgaggggaagtgcttcgtgcccgacaaggccgtggtctccgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccgtccggggaggacttccgcgccatggaggtgttcagcggcatcatcatgagcccccacggggaggaccacgacctccccggcgaggagatcgccacctaccagatcagcggccagatcgaggccaagatcccccacaccgtgtccagcaagaacctgaagctgacggccttcgcggggatcccgtcctacagctccaccagcatcctcgccgcctccgaggacggccggttcatcttcagccccgggctgttccccaacctgaaccagtccgtctgcgacaacaacgccctccccctgatctggcgcggcctgatcgacctcaccgggtactacgaggccgtgcacccgtgcaacgtgttctgcgtcctgagcggccccggcgcgtcctgcgaggccttcagcgagggcgggatcttcaacatcacctcccccatgtgcctggtgagcaagcagaaccggttccgcgccgccgagcagcagatctccttcgtctgccagcgggtggacatggacatcatcgtgtactgcaacgggcagaagaagacgatcctcaccaagaccctggtcatcggccagtgcatctacaccatcacgagcctgttcagcctcctgcccggggtggcccactccatcgcgatcgagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgagcaaccaggagaaccgcttcaaggccatcctgcggaagatcaaggaggagttcgagaagaccaagggctccatggtgtgcgagatctgcaagtacgagtgcgagaccctcaaggagctgaaggcccacaacctgagctgcgtccagggggagtgcccctactgcttcacccactgcgagcccacggagaccgcgatccaggcccactacaaggtgtgccaggccacccaccgcttccgggaggacctcaagaagaccgtgacgccgcagaacatcggccccgggtgctaccgcaccctgaacctgttccggtacaagtcccgctgctacatcctgaccatgtggaccctcctgctgatcatcgagagcatcctctgggccgcctccgcggccgagatccccctggtccccctgtggaccgacaacgcccacggcgtgggcagcgtgccgatgcacacggacctcgagctggacttctccctgcccagctccagcaagtacacctacaagcggcacctcaccaaccccgtcaacgaccagcagtccgtgagcctgcacatcgagatcgagtcccaggggatcggcgccgacgtgcaccacctggggcactggtacgacgcccgcctcaacctgaagaccagcttccactgctacggcgcgtgcacgaagtaccagtacccgtggcacaccgccaagtgccacttcgagaaggactacgagtacgagaactcctgggcctgcaacccgcccgactgccccggcgtcgggaccggctgcaccgcctgcgggctgtacctcgaccagctgaagcccgtgggcacggcgctgaagatcatcagcgtgcgctacagccggaaggtctgcgtgcagttcggggaggagtacctctgcaagaccatcgacatgaacgactgcttcgtgacccgccacgccaagatctgcatcatcggcaccgtctccaagttcagccagggcgacacgctgctgttcctcgggcccatggagggcgggggcatcatcttcaagcactggtgcacctccacgtgccacttcggggaccccggcgacgtgatgggccccaaggacaagccgttcatctgccccgagttccccgggcagttccggaagaagtgcaacttcgccaccacccccgtgtgcgagtacgacggcaacatcatcagcgggtacaagaaggtcctggccaccatcgactccttccagagcttcaacacctccaacatccacttcaccgacgagcgcatcgagtggcgggacccggacggcatgctgcgcgaccacatcaacatcgtgatcagcaaggacatcgacttcgagaacctcgccgagaacccctgcaaggtggggctgcaggcggccaacatcgagggcgcctggggctccggggtcggcttcacgctgacctgccaggtgagcctcaccgagtgccccaccttcctgacgtccatcaaggcctgcgacatggccatctgctacggggcggagagcgtgaccctgctccggggccagaacaccgtcaagatcaccgggaagggcggccactccgggagctccttcaagtgctgccacggcaaggagtgcagctccacggggctgcaggccagcgcgccccacctggacaaggtgaacggcatctccgagctcgagaacgagaaggtgtacgacgacggcgccccggagtgcgggatcacgtgctggttcaagaagtccggcgagtgggtcatggggatcatcaacggcaactgggtggtgctgatcgtcctgtgcgtgctcctgctgttcagcctcatcctgctgagcatcctctgccccgtgcgcaagcacaagaagtcctga

SEQ ID NO: 11834 - RNA, 3402 nt, synthetic construct
  misc_feature 1..3402: note = derived and/or modified CDS sequence (opt1) from SEOV(93HBQ4)__KM115586.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggccgagtccgaggtcagcttcaagggcctgtgcatgctcaagcaccgcatggtggaggagtcctaccggaaccgccggagcgtgatctgctacgacctggcgtgcaactccaccttctgcaagcccaccgtctacatgatcgtgccgatccacgcctgcaacatgatgaagtcctgcctgatcgggctcggcccctaccgcatccaggtggtctacgagcggacgtactgcaccaccggcatcctgaccgaggggaagtgcttcgtgcccgacaaggccgtggtctccgccctgaagcgcggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccgtccggggaggacttccgggccatggaggtgttcagcggcatcatcatgagcccccacggggaggaccacgacctccccggcgaggagatcgccacctaccagatcagcggccagatcgaggccaagatcccccacaccgtgtccagcaagaacctgaagctgacggccttcgcggggatcccgtcctacagctccaccagcatcctcgccgcctccggcgacagccgcttcatcttctcccccgggctgttccccaacctgaaccagagcgtctgcgacaacaacgccctccccctgatctggcggggcctgatcgacctcaccgggtactacgaggccgtgcacccgtgcaacgtgttctgcgtcctgtccggccccggcgcgagctgcgaggccttctccgagggcgggatcttcaacatcaccagccccatgtgcctggtgtccaagcagaaccgcttccgggccgccgagcagcagatcagcttcgtctgccagcgcgtggacatggacatcatcgtgtactgcaacgggcagaagaagacgatcctcaccaagaccctggtcatcggccagtgcatctacaccatcacgagcctgttctccctcctgcccggggtggcccacagcatcgcgatcgagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgtccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacccactgcgagcccacggagaccgcgatccaggcccactacaaggtgtgccaggccacccaccggttccgcgaggacctcaagaagaccgtgacgccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggaccgacaacgcccacggcgtgggctccgtgccgatgcacacggacctcgagctggacttcagcctgccctccagctccaagtacacctacaagcgccacctcaccaaccccgtcaacgaccagcagagcgtgtccctgcacatcgagatcgagagccaggggatcggcgccgacgtgcaccacctggggcactggtacgacgcccgcctcaacctgaagacctccttccactgctacggcgcgtgcacgaagtaccagtacccgtggcacaccgccaagtgccacttcgagaaggactacgagtacgagaacagctgggcctgcaacccgcccgactgccccggcgtcgggaccggctgcaccgcctgcgggctgtacctcgaccagctgaagcccgtgggcacggcgttcaagatcatcagcgtgcggtactcccgcaaggtctgcgtgcagttcggggaggagtacctgtgcaagaccatcgacatgaacgactgcttcgtgacccggcacgccaagatctgcatcatcggcaccgtcagcaagttctcccagggcgacacgctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatctccgggtacaagaaggtcctcgccaccatcgacagcttccagtccttcaacaccagcaacatccacttcaccgacgagacgatcgagtggcgggacccggacggcatgctgcgcgaccacatcaacatcgtgatctccaaggacatcgacttcgagaacctggccgagaacccctgcaaggtggggctccaggcggccaacatcgagggcgcctggggcagcggggtcggcttcaccctgacctgccaggtgtccctgaccgagtgccccacgttcctcaccagcatcaaggcctgcgacatggccatctgctacggggcggagtccgtgaccctgagccggggccagaacaccgtcaagatcacggggaagggcggccactccgggagctccttcaagtgctgccacggcaaggagtgcagctccaccgggctgcaggccagcgcgccccacctcgacaaggtgaacggcatcagcgagctggagaacgagcgcgtgtacgacgacggcgccccggagtgcgggatcacgtgctggttcaagaagtccggcgagtgggtcatggggatcatcaacggcaactgggtggtgctgatcgtcctctgcgtgctgctcctgttcagcctgatcctgctctccatcctgtgccccgtgcggaagcacaagaagtcctga

SEQ ID NO: 11835 - RNA, 3402 nt, synthetic construct
  misc_feature 1..3402: note = derived and/or modified CDS sequence (opt1) from SEOV(B1)__AB457790.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgcgcctgaccgccttcgcggggatcccgagctactccagcacctccatcctcgccgccagcgaggacggccggttcatcttctcccccgggctgttccccaacctgaaccagagcgtgtgcgacaacaacgccctccccctgatctggcgcggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccggttccgcgccgccgagcagcagatcagcttcgtgtgccagcgggtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtggatcctgatccccgcgtggacgctcgccatcctgctggtgctcaagttcttcgccaacatcctgcacacctccaaccaggagaaccgcttcaaggccatcctgcggaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacgcactgcgagcccaccgagaccgcgatccaggcccactacaagatctgccaggccacccaccgcttccgggaggacctcaagaagacggtgaccccgcagaacatcggccccgggtgctaccgcaccctgaacctgttccggtacaagagccgctgctacatcctgaccatgtggaccctcctgctgatcatcgagtccatcctctgggccgccagcgcggccgagatccccctggtgcccctgtggacggacaacgcccacggcgtcggctccgtgccgatgcacaccgacctcgagctggacttcagcctgccctccagctccaagtacacctacaagcgccacctcaccaaccccgtgaacgaccagcagagcgtctccctgcacatcgagatcgagagccaggggatcggcgccgacgtgcaccacctggggcactggtacgacgcccggctcaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctcgaccagctgaagcccgtcggcaccgcgttcaagatcatctccgtgcgctacagccggaaggtgtgcgtccagttcggggaggagtacctgtgcaagaccatcgacatgaacgactgcttcgtgacccgccacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtcatgggccccaaggacaagccgttcatctgccccgagttccccgggcagttccggaagaagtgcaacttcgccaccacccccgtgtgcgagtacgacggcaacatcatctccgggtacaagaaggtgctcgccaccatcgacagcttccagtccttcaacaccagcaacatccacttcacggacgagcgcatcgagtggcgggacccggacggcatgctgcgcgaccacatcaacatcgtcatctccaaggacatcgacttcgagaacctggccgagaacccctgcaaggtggggctccaggcggccaacatcgagggcgcctggggcagcggggtgggcttcaccctgacctgccaggtctccctgaccgagtgccccacgttcctcaccagcatcaaggcctgcgacatggccatctgctacggggcggagtccgtgaagctgagccggggccagaacaccgtgaagatcaccgggaagggcggccactccgggagctccttcaagtgctgccacggcaaggagtgcagctccacggggctgcaggccagcgcgccccacctcgacaaggtcaacggcatctccgagctggagaacgagaaggtgtacgacgacggcgccccggagtgcggggtgacctgctggttcaagaagtccggcgagtgggtcatggggatcatcaacggcaactgggtggtgctgatcgtcctctgcctgctgctcctgttcagcctgatcctcctgagcatcctgtgccccgtgcgcaagcacaagaagtcctga

SEQ ID NO: 11836 - RNA, 3402 nt, synthetic construct
  misc_feature 1..3402: note = derived and/or modified CDS sequence (opt1) from SEOV(B1)__AB457791.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcagaagaaggccaaccaggagtccgccaaccagaacagcttcgaggtggtcgagtccgaggtgagcttcaagggcctgtgcatgctcaagcaccggatggtggaggagtcctaccgcaaccggcgcagcgtcatctgctacgacctggcctgcaactccaccttctgcaagcccaccgtgtacatgatcgtgccgatccacgcgtgcaacatgatgaagtcctgcctgatcgggctcggcccctaccggatccaggtcgcctacgagcgcacgtactgcaccaccggcatcctgaccgaggggaagtgcttcgtgcccgacaaggccgtggtcagcgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccggccggggaggacttccgcgccatggaggtgttctccggcatcatcaccagcccccacggggaggaccacgacctccccggcgaggagatcgccacctaccagatctccggccagatcgaggccaagatcccccacacggtgagctccaagaacctgcggctgaccgcgttcgccgggatcccgagctactccagcacctccatcctcgccgccagcaaggacggccgcttcatcttctcccccgggctgttccccaacctgaaccagagcgtctgcgacaacaacgccctccccctgatctggcggggcctgatcgacctcaccgggtactacgaggcggtgcacccgtgcaacgtgttctgcgtcctgtccggccccggcgccagctgcgaggccttctccgagggcgggatcttcaacatcacgagccccatgtgcctggtgtccaagcagaaccgcttccgggccgccgagcagcagatcagcttcgtctgccagcgcgtggacatggacatcatcgtgtactgcaacgggcagaagaagaccatcctcaccaagaccctggtcatcggccagtgcatctacacgatcacctccctgttcagcctcctgcccggggtggcgcacagcatcgccatcgagctgtgcgtgccgggcttccacggctgggccaccgccgcgctcctgatcaccttctgcttcgggtggatcctgatccccgcctgcacgctcgccatcctgctggtcctcaagttcttcgccaacatcctgcacacctccaaccaggagaaccggttcaaggccatcctgcgcaagatcaaggaggagttcgagaagaccaagggcagcatggtgtgcgagatctgcaagtacgagtgcgagaccctcaaggagctgaaggcgcacaacctgtcctgcgtgcagggggagtgcccctactgcttcacgcactgcgagcccaccgagaccgccatccaggcccactacaagatctgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgcgagcgccgccgagatccccctggtgcccctgtggacggacaacgcccacggcgtgggctccgtcccgatgcacaccgacctcgagctggacttcagcctgccctccagctccaagtacacctacaagcgccacctcaccaaccccgtgaacgaccagcagagcgtgtccctgcacatcgagatcgagagccaggggatcggcgccgacgtccaccacctggggcactggtacgacgcgcgcctcaacctgaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctcgaccagctgaagcccgtgggcaccgccttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctcgccaccatcgacagcttccagtccttcaacaccagcaacatccacttcacggacgagcggatcgagtggcgcgacccggacggcatgctgcgggaccacatcaacatcgtgatctccaaggacatcgacttcgagaacctggcggagaacccctgcaaggtcgggctccaggccgccaacatcgagggcgcctggggcagcggggtgggcttcaccctgacctgccaggtgtccctgaccgagtgccccacgttcctcaccagcatcaaggcctgcgacatggcgatctgctacggggccgagtccgtcaccctgagccgcggccagaacaccgtgaagatcacggggaagggcggccactccgggagctccttcaagtgctgccacggcaaggagtgcagctccaccgggctgcaggccagcgcgccccacctcgacaaggtgaacggcatctccgagctggagaacgagaaggtctacgacgacggcgccccggagtgcggggtgacctgctggttcaagaagtccggcgagtgggtgatggggatcatcaacggcaactgggtcgtgctgatcgtgctctgcctgctgctcctgttcagcctgatcctcctgagcatcctgtgccccatccggaagcacaagaagtcctga

SEQ ID NO: 11837 - RNA, 3402 nt, synthetic construct
  misc_feature 1..3402: note = derived and/or modified CDS sequence (opt1) from SEOV(B1)__AB457792.1__GP
  source 1..3402: mol_type = other RNA
atgtggagcctgctcctgatggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcagaagaaggccaaccaggagtccgccaaccagaacagcttcgaggtggtcgagtccgaggtgagcttcaagggcctgtgcatgctgaagcaccggatggtggaggagtcctaccgcaaccggcgcagcgtcatctgctacgacctcgcctgcaactccaccttctgcaagcccaccgtgtacatgatcgtgccgatccacgcgtgcaacatgatgaagtcctgcctgatcgggctgggcccctaccggatccaggtcgcctacgagcgcacgtactgcaccaccggcatcctcaccgaggggaagtgcttcgtgcccgacaaggccgtggtcagcgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccggccggggaggacttccgcgccatggaggtgttctccggcatcatcaccagcccccacggggaggaccacgacctgcccggcgaggagatcgccacctaccagatctccggccagatcgaggccaagatcccccacacggtgagctccaagaacctccggctgaccgcgttcgccgggatcccgagctactccagcacctccatcctggccgccagcaaggacggccgcttcatcttctcccccgggctgttccccaacctgaaccagagcgtctgcgacaacaacgccctgcccctcatctggcggggcctgatcgacctgaccgggtactacgaggcggtgcacccgtgcaacgtgttctgcgtcctctccggccccggcgccagctgcgaggccttctccgagggcgggatcttcaacatcacgagccccatgtgcctggtgtccaagcagaaccgcttccgggccgccgagcagcagatcagcttcgtctgccagcgcgtggacatggacatcatcgtgtactgcaacgggcagaagaagaccatcctgaccaagaccctcgtcatcggccagtgcatctacacgatcacctccctgttcagcctgctccccggggtggcgcacagcatcgccatcgagctgtgcgtgccgggcttccacggctgggccaccgccgcgctgctcatcaccttctgcttcgggtggatcctgatccccgcctgcacgctggccatcctcctggtcctgaagttcttcgccaacatcctccacacctccaaccaggagaaccggttcaaggccatcctgcgcaagatcaaggaggagttcgagaagaccaagggcagcatggtgtgcgagatctgcaagtacgagtgcgagaccctgaaggagctcaaggcgcacaacctgtcctgcgtgcagggggagtgcccctactgcttcacgcactgcgagcccaccgagaccgccatccaggcccactacaagatctgccaggccacccaccggttccgcgaggacctgaagaagacggtcaccccgcagaacatcggccccgggtgctaccggaccctcaacctgttccgctacaagagccggtgctacatcctgaccatgtggaccctgctcctgatcatcgagtccatcctgtgggccgcgagcgccgccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcgcgcctgaacctcaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctggaccagctcaagcccgtgggcaccgccttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtgatctccaaggacatcgacttcgagaacctggcggagaacccctgcaaggtcgggctgcaggccgccaacatcgagggcgcctggggcagcggggtgggcttcaccctgacctgccaggtgtccctgaccgagtgccccacgttcctgaccagcatcaaggcctgcgacatggcgatctgctacggggccgagtccgtcaccctcagccgcggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcctcctgctcctcttcagcctgatcctgctcagcatcctgtgccccatccggaagcacaagaagtcctga

SEQ ID NO: 11838 - RNA, 3402 nt, synthetic construct
  misc_feature 1..3402: note = derived and/or modified CDS sequence (opt1) from SEOV(B1)__AB457793.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcagaagaaggccaaccaggagtccgccaaccagaacagcttcgaggtggtcgagtccgaggtgagcttcaagggcctgtgcatgctcaagcaccggatggtggaggagtcctaccgcaaccggcgcagcgtcatctgctacgacctggcctgcaactccaccttctgcaagcccaccgtgtacatgatcgtgccgatccacgcgtgcaacatgatgaagtcctgcctgatcgggctcggcccctaccggatccaggtcgcctacgagcgcacgtactgcaccaccggcatcctgaccgaggggaagtgcttcgtgcccgacaaggccgtggtcagcgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccggccggggaggacttccgcgccatggaggtgttctccggcatcatcaccagcccccacggggaggaccacgacctccccggcgaggagatcgccacctaccagatctccggccagatcgaggccaagatcccccacacggtgagctccaagaacctgcggctgaccgcgttcgccgggatcccgagctactccagcacctccatcctcgccgccagcaaggacggccacttcatcttctcccccgggctgttccccaacctgaaccagagcgtctgcgacaacaacgccctccccctgatctggcgcggcctgatcgacctcaccgggtactacgaggcggtgcacccgtgcaacgtgttctgcgtcctgtccggccccggcgccagctgcgaggccttctccgagggcgggatcttcaacatcacgagccccatgtgcctggtgtccaagcagaaccggttccgcgccgccgagcagcagatcagcttcgtctgccagcgggtggacatggacatcatcgtgtactgcaacgggcagaagaagaccatcctcaccaagaccctggtcatcggccagtgcatctacacgatcacctccctgttcagcctcctgcccggggtggcgcacagcatcgccatcgagctgtgcgtgccgggcttccacggctgggccaccgccgcgctcctgatcaccttctgcttcgggtggatcctgatccccgcctgcacgctcgccatcctgctggtcctcaagttcttcgccaacatcctgcacacctccaaccaggagaaccgcttcaaggccatcctgcggaagatcaaggaggagttcgagaagaccaagggcagcatggtgtgcgagatctgcaagtacgagtgcgagaccctcaaggagctgaaggcgcacaacctgtcctgcgtgcagggggagtgcccctactgcttcacgcactgcgagcccaccgagaccgccatccaggcccactacaagatctgccaggccacccaccgcttccgggaggacctcaagaagacggtcaccccgcagaacatcggccccgggtgctaccgcaccctgaacctgttccggtacaagagccgctgctacatcctgaccatgtggaccctcctgctgatcatcgagtccatcctctgggccgcgagcgccgccgagatccccctggtgcccctgtggacggacaacgcccacggcgtgggctccgtcccgatgcacaccgacctcgagctggacttcagcctgccctccagctccaagtacacctacaagcggcacctcaccaaccccgtgaacgaccagcagagcgtgtccctgcacatcgagatcgagagccaggggatcggcgccgacgtccaccacctggggcactggtacgacgcgcgcctcaacctgaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctcgaccagctgaagcccgtgggcaccgccttcaagatcatctccgtccgctacagccggaaggtgtgcgtgcagttcggggaggagtacctgtgcaagaccatcgacatgaacgactgcttcgtcacccgccacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctcgccaccatcgacagcttccagtccttcaacaccagcaacatccacttcacggacgagcgcatcgagtggcgggacccggacggcatgctgcgcgaccacatcaacatcgtgatctccaaggacatcgacttcgagaacctggcggagaacccctgcaaggtcgggctccaggccgccaacatcgagggcgcctggggcagcggggtgggcttcaccctgacctgccaggtgtccctgaccgagtgccccacgttcctcaccagcatcaaggcctgcgacatggcgatctgctacggggccgagtccgtcaccctgagccggggccagaacaccgtgaagatcacggggaagggcggccactccgggagctccttcaagtgctgccacggcaaggagtgcagctccaccgggctgcaggccagcgcgccccacctcgacaaggtgaacggcatctccgagctggagaacgagaaggtctacgacgacggcgccccggagtgcggggtgacctgctggttcaagaagtccggcgagtgggtgatggggatcatcaacggcaactgggtcgtgctgatcgtgctctgcctgctgctcctgttcagcctgatcctcctgagcatcctgtgccccatccgcaagcacaagaagtcctga

SEQ ID NO: 11839 - RNA, 3402 nt, synthetic construct
  misc_feature 1..3402: note = derived and/or modified CDS sequence (opt1) from SEOV(B1)__AB457794.1__GP
  source 1..3402: mol_type = other RNA
atgtggagcctgctcctgatggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcagaagaaggccaaccaggagtccgccaaccagaacagcttcgaggtggtcgagtccgaggtgagcttcaagggcctgtgcatgctgaagcaccggatggtggaggagtcctaccgcaaccggcgcagcgtcatctgctacgacctcgcctgcaactccaccttctgcaagcccaccgtgtacatgatcgtgccgatccacgcgtgcaacatgatgaagtcctgcctgatcgggctgggcccctaccggatccaggtcgcctacgagcgcacgtactgcaccaccggcatcctcaccgaggggaagtgcttcgtgcccgacaaggccgtggtcagcgccctgaagcggggcatgtacgcgatcgccagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgcgccggccggggaggacttccgcgccatggaggtgttctccggcatcatcaccagcccccacggggaggaccacgacctgcccggcgaggagatcgccacctaccagatctccggccagatcgaggccaagatcccccacacggtgagctccaagaacctccggctgaccgcgttcgccgggatcccgagctactccagcacctccatcctggccgccagcaaggacggccacttcatcttctcccccgggctgttccccaacctgaaccagagcgtctgcgacaacaacgccctgcccctcatctggcgcggcctgatcgacctgaccgggtactacgaggcggtgcacccgtgcaacgtgttctgcgtcctctccggccccggcgccagctgcgaggccttctccgagggcgggatcttcaacatcacgagccccatgtgcctggtgtccaagcagaaccggttccgcgccgccgagcagcagatcagcttcgtctgccagcgggtggacatggacatcatcgtgtactgcaacgggcagaagaagaccatcctgaccaagaccctcgtcatcggccagtgcatctacacgatcacctccctgttcagcctgctccccggggtggcgcacagcatcgccatcgagctgtgcgtgccgggcttccacggctgggccaccgccgcgctgctcatcaccttctgcttcgggtggatcctgatccccgcctgcacgctggccatcctcctggtcctgaagttcttcgccaacatcctccacacctccaaccaggagaaccgcttcaaggccatcctgcggaagatcaaggaggagttcgagaagaccaagggcagcatggtgtgcgagatctgcaagtacgagtgcgagaccctgaaggagctcaaggcgcacaacctgtcctgcgtgcagggggagtgcccctactgcttcacgcactgcgagcccaccgagaccgccatccaggcccactacaagatctgccaggccacccaccgcttccgggaggacctgaagaagacggtcaccccgcagaacatcggccccgggtgctaccgcaccctcaacctgttccggtacaagagccgctgctacatcctgaccatgtggaccctgctcctgatcatcgagtccatcctgtgggccgcgagcgccgccgagatccccctcgtgcccctgtggacggacaacgcccacggcgtgggctccgtcccgatgcacaccgacctggagctcgacttcagcctgccctccagctccaagtacacctacaagcggcacctgaccaaccccgtgaacgaccagcagagcgtgtccctccacatcgagatcgagagccaggggatcggcgccgacgtccaccacctggggcactggtacgacgcgcgcctgaacctcaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctggaccagctcaagcccgtgggcaccgccttcaagatcatctccgtccgctacagccggaaggtgtgcgtgcagttcggggaggagtacctgtgcaagaccatcgacatgaacgactgcttcgtcacccgccacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacaccagcaacatccacttcacggacgagcgcatcgagtggcgggacccggacggcatgctccgcgaccacatcaacatcgtgatctccaaggacatcgacttcgagaacctggcggagaacccctgcaaggtcgggctgcaggccgccaacatcgagggcgcctggggcagcggggtgggcttcaccctgacctgccaggtgtccctgaccgagtgccccacgttcctgaccagcatcaaggcctgcgacatggcgatctgctacggggccgagtccgtcaccctcagccggggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcctcctgctcctcttcagcctgatcctgctcagcatcctgtgccccatccgcaagcacaagaagtcctga

SEQ ID NO: 11840 - RNA, 3402 nt, synthetic construct
  misc_feature 1..3402: note = derived and/or modified CDS sequence (opt1) from SEOV(B-1)__X53861.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctactacgacctggccgggaactccaccttctgcaagcccaccgtgtacatgatcgtgccgatccacgcgtgcaacatgatgaagtcctgcctgatcggcctcggcccctaccgcatccaggtcgtgtacgagcggacgtactgcaccaccgggatcctgaccgagggcaagtgcttcgtgcccgacaaggccgtcgtgagcgccctgaagcgcgggatgtacgccatcgcgagcatcgagacgatctgcttcttcatccaccagaagtggaacaagtacaagatcgtgaccgccatcacctccgccatgggcagcaagtgcaacaacaccgacacgaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccacatctccggccagatcgaggccaagatcccccacaccgtcagctccaagaacctgcgcctggccgcgttcgccgggatcccgagctactccagcacgtccatcctcgccgccagcgaggacggccggttcatcttctcccccgggctgttccccaacctgaaccagagcgtgtgcgacaacaacgccctccccctgatctggcgcggcctgatcgacctcaccgggtactacgaggcggtgcacccgtgcaacgtcttctgcgtgctgtccggccccggcgccagctgcgaggccttctccgagggcgggatcttcaacatcaccagccccatgtgcctggtctccaagcagaaccggttccgcgccgccgagcagcagatcagcttcgtgtgccagcgggtggacatggacatcatcgtctactgcaacgggcagaagaagaccatcctcacgaagaccctggtgatcggccagtgcatctacaccatcacctccctgttcagcctcctgcccggggtggcgcacagcatcgccatcgagctgtgcgtcccgggcttccacggctgggccacggccgcgctcctgatcaccttctgcttcgggtgggtgctgatccccgcctgcaccctcgccatcctgctggtgctcaagttcttcgccaacatcctgcacacctccaaccaggagaaccgcttcaaggccatcctgcggaagatcaaggaggagttcgagaagcgcaagggcagcatggtctgcgagatctgcaagtacgagtgcgagacgctcaaggagctgaaggcgcacaacctgtcctgcgtgcagggggagtgcccctactgcttcacccactgcgagcccaccgagaccgccatccaggcccactacaaggtgtgccaggccacgcaccggttccgcgaggacctcaagaagaccgtcaccccgcagaacatcggccccgggtgctaccggaccctgaacctgttccgctacaagagccgctgctacatcctgacgatgtggaccctcctgctgatcatcgagtccatcctctgggccgcgagcgccgccgagatccccctggtgcccctgtggaccgacaacgcccacggcgtgggctccgtcccgatgcacaccgacctcgagctggacttcagcctgccctccagctccaagtacacctacaagcggcacctcacgaaccccgtgaacgaccagcagagcgtgtccctgcacatcgagatcgagagccaggggatcggcgccgacgtccaccacctggggcactggtacgacgcgcgcctcaacctgaagacctccttccactgctacggcgcctgcaccaagtaccagtacccgtggcacaccgccaagtgccacttcgagaaggactacgagtacgagaacagctgggcctgcaacccgcccgactgccccggcgtggggacgggctgcaccgcgtgcgggctgtacctcgaccagctgaagcccgtgggcaccgccttcaagatcatctccgtccggtacagccgcaaggtgtgcgtgcagttcggggaggagcacctgtgcaagaccatcgacatgaacgactgcttcgtcacgcggcacgccaagatctgcatcatcggcaccgtgagcaagttctcccagggcgacaccctcctgttcctggggcccatggagggcgggggcatcatcttcaagcactggtgcaccagcacgtgccacttcggggacccccgcgacgtgatgggccccaaggacaagccgttcatctgccccgagttccccggccagttccggaagaagtgcaacttcgccaccacccccgtctgcgagtacgacgggaacatcatctccggctacaagaaggtgctcgccaccatcgacagcttccagtccttcaacacgagcaacatccacttcaccgacgagcgcatcgagtggcgggacccggacgggatgctgcgcgaccacatcaacatcgtgatctccaaggacatcgacttcgagaacctggcggagaacccctgcaaggtcggcctccaggccgccaacatcgagggggcctggggcagcggcgtggggttcaccctgacctgccaggtgtccctgacggagtgccccaccttcctcaccagcatcaaggcctgcgacatggcgatctgctacggcgccgagtccgtcaccctgagccgggggcagaacacggtgaagatcaccggcaagggcgggcactccggcagctccttcaagtgctgccacgggaaggagtgcagctccaccggcctgcaggccagcgcgccccacctcgacaaggtgaacgggatctccgagctggagaacgagaaggtctacgacgacggcgccccggagtgcggcgtgacctgctggttcaagaagtccggggagtgggtgatgggcatcatcaacgggaactgggtcgtgctgatcgtgctctgcgtcctgctcctgttcagcctgatcctgctcagcatcctgtgccccgtgcgcaagcacaagaagtcctga

SEQ ID NO: 11841 - RNA, 3402 nt, synthetic construct
  misc_feature 1..3402: note = derived and/or modified CDS sequence (opt1) from SEOV(BjHD01)__DQ133505.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctgcccggcgaggaggtcgccacctaccagatctccggccagatcgaggccaagatcccccacacggtgagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtccacccgtgcaacgtgttctgcgtcctctccggccccggcgcgagctgcgaggccttctccgagggcgggatcttcaacatcacgagccccatgtgcctggtgtccaagcagaaccgcttccgggccgccgagcagcagatcagcttcgtgtgccagcgcgtcgacatggacatcatcgtgtactgcaacgggcagaagaagaccatcctgaccaagaccctcgtgatcggccagtgcatctacacgatcacctccctgttcagcctgctccccggggtcgcccacagcatcgcgatcgagctgtgcgtgccgggcttccacggctgggccaccgccgccctgctcatcaccttctgcttcgggtgggtgctgatccccgcgtgcacgctggccatcctcctggtcctgaagttcttcgccaacatcctccacacctccaaccaggagaaccggttcaaggccatcctgcgcaagatcaaggaggagttcgagaagaccaagggcagcatggtgtgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtctgccaggccacccaccggttccgcgaggacctgaagaagacggtgaccccgcagaacatcggccccgggtgctaccggaccctcaacctgttccgctacaagagccggtgctacatcctgaccatgtggaccctgctcctgatcatcgagtccatcctgtgggccgccagcgcggccgagatccccctcgtgcccctgtggacggacaacgcccacggcgtcggctccgtgccgatgcacaccgacctggagctcgacttcagcctgccctccagctccaagtacacctacaagcgccacctgaccaaccccgtgaacgaccagcagagcgtctccctccacatcgagatcgagagccaggggatcggcgccgacgtgcaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtcggcaccgcgttcaagatcatctccgtgcggtacagccgcaaggtgtgcgtccagttcggggaggagtacctgtgcaagaccatcgacatgaacgactgcttcgtgacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtcatgggccccaaggacaagccgttcatctgccccgagttccccgggcagttccgcaagaagtgcaacttcgccaccacccccgtgtgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtcatctccaaggacatcgacttcgagaacctggccgagaacccctgcaaggtggggctgcaggcggccaacatcgagggcgcctggggcagcggggtgggcttcaccctgacctgccaggtctccctgaccgagtgccccacgttcctgaccagcatcaaggcctgcgacatggccatctgctacggggcggagtccgtgaccctcagccgcggccagaacaccgtgaagatcacggggaagggcggccactccgggagctccttcaagtgctgccacggcgaggagtgcagctccaccgggctgcaggccagcgcgccccacctggacaaggtcaacggcatctccgagctcgagaacgagaaggtgtacgacgacggcgccccggagtgcggggtgacctgctggttcaagaagtccggcgagtgggtcatggggatcatcaacggcaactgggtggtgctgatcgtcctgtgcgtgctcctgctgttcagcctcatcctgctgagcatcctctgccccgtgcggaagcacaagaagtcctga

SEQ ID NO: 11842 - RNA, 3402 nt, synthetic construct
  misc_feature 1..3402: note = derived and/or modified CDS sequence (opt1) from SEOV(Cherwell)__KM948593.1__GP
  source 1..3402: mol_type = other RNA
atgtggagcctgctcctgctggccgccctcgtgggccaggggagcgcgctgaagaacgtcttcgacatgcgcatccagtgcccccacagcgtgaacttcggcgagacctccgtgagcgggtacaccgagctgccgcccctctccctgcaggaggccgagcagctggtccccgagagctcctgcaacatggacaaccaccagagcctctccacgatcaacaagctgaccaaggtgatctggcggaagaaggccaaccaggagagcgccaaccagaactccttcgaggtggtcgagagcgaggtgtccttcaagggcctgtgcatgctcaagcaccgcatggtggaggagagctaccggaaccgccggtccgtcatctgctacgacctggcctgcaacagcaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgtccatcgagacgatctgcttcttcatccaccagaaggggaacacctacaagatcgtgaccgccatcaccagcgccatgggcagcaagtgcaacaacacggacaccaaggtccaggggtactacatctgcatcatcggcggcaactccgcccccgtgtacgccccggcgggggaggacttccgggccatggaggtgttcagcggcatcatcaccagcccccacggggaggaccacgacctccccggcgaggagatcgccacctaccagatcagcggccagatcgaggccaagatcccccacacggtctccagcaagaacctgaagctgaccgccttcgcggggatcccgtcctacagctccaccagcatcctcgccgcctccgaggacggccgcttcatcttcagccccgggctgttccccaacctgaaccagtccgtgtgcgacaacaacgccctccccctgatctggcggggcctgatcgacctcaccgggtactacgaggccgtgcacccgtgcaacgtcttctgcgtgctgagcggccccggcgcgtcctgcgaggccttcagcgagggcgggatcttcaacatcacgtcccccatgtgcctggtcagcaagcagaaccgcttccgggccgccgagcagcagatctccttcgtgtgccagcgcgtggacatggacatcatcgtctactgcaacgggcagaagaagaccatcctcaccaagaccctggtgatcggccagtgcatctacacgatcaccagcctgttcagcctcctgcccggggtggcccactccatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacaccagcaaccaggagaaccggttcaaggccatcctgcgcaagatcaaggaggagttcgagaagaccaagggctccatggtctgcgagatctgcaagtacgagtgcgagaccctcaaggagctgaaggcccacaacctgagctgcgtgcagggggagtgcccctactgcttcacgcactgcgagcccaccgagaccgcgatccaggcccactacaaggtgtgccaggccacccaccggttccgcgaggacctcaagaagacggtcaccccgcccaacatcggccccgggtgctaccggaccctgaacctgttccgctacaagtcccggtgctacatcctgaccatgtggaccctcctgctgatcatcgagagcatcctctgggccgcctccgcggccgagatccccctggtgccgctgtggacggacaacgcccacggcgtgggcagcgtccccatgcacaccgacctcgagctggacttctccctgcccagctccagcaagtacacctacaagcgccacctcaccaacccggtgaacgaccagcagtccgtgagcctgcacatcgagatcgagtcccaggggatcggcgccgacgtccaccacctggggcactggtacgacgcccgcctcaacctgaagacgagcttccactgctacggcgcgtgcaccaagtaccagtacccctggcacaccgccaagtgccacttcgagaaggactacgagtacgagaactcctgggcctgcaacccgcccgactgccccggcgtggggaccggctgcacggcctgcggggtgtacctggaccagctcaagcccgtcggcaccgcgttcaagatcgtgagcgtgcggtacagccgcaaggtctgcgtgcagttcggggaggagtacctgtgcaagaccatcgacatgaacgactgcttcgtgacccggcacgccaagatctgcatcatcggcacggtctccaagttcagccagggcgacaccctcctcttcctggggcccatggagggcgggggcatcatcttcaagcactggtgcacctccacgtgccacttcggggaccccggcgacgtgatgggcccgaaggacaagcccttcatctgccccgagttccccgggcagttccgcaagaagtgcaacttcgccaccaccccggtgtgcgagtacgacggcaacatcatcagcgggtacaagaaggtcctggccaccatcgactccttccagagcttcaacacctccaacatccacttcacggacgagcggatcgagtggcgcgaccccgacggcatgctccgggaccacatcaacatcgtgatcagcaaggacatcgacttcgagaacctggccgagaacccctgcaaggtggggctgcaggcggccaacatcgagggcgcctggggctccggggtcggcttcaccctgacctgccaggtgagcctgaccgagtgccccacgttcctgacctccatcaaggcctgcgacatggccatctgctacggggcggagagcgtgaccctctcccgcggccagaacaccgtcaagatcacggggaagggcggccacagcgggtccagcttcaagtgctgccacggcaaggagtgctccagcaccgggctgcaggcctccgccccgcacctggacaaggtgaacggcatcagcgagctcgagaacgagaaggtgtacgacgacggcgcccccgagtgcggggtgacctgctggttcaagaagtcctccgagtgggtcatgggcatcatcaacgggaactgggtggtcctgatcgtgctgtgcgtgctcctgctgttcagcctcatcctgctgtccatcctctgccccgtccggaagcacaagaagtcctga

SEQ ID NO: 11843 - RNA, 3402 nt, synthetic construct
  misc_feature 1..3402: note = derived and/or modified CDS sequence (opt1) from SEOV(HaixingRn40)__GU592924.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctgcccggcgaggagatcgccacctaccagatctccggccagatcgaggccaagatcccccacacggtcagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtgcacccgtgcaacgtcttctgcgtgctctccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctgacccggaccctcgtgatcggccagtgcatctacacgatcacctccctgttcagcctgctccccggggtggcccacagcatcgcgatcgagctgtgcgtcccgggcttccacggctgggccaccgccgccctgctcatcaccttctgcttcgggtgggtgctgatccccgcgtgcacgctggccatcctcctggtgctgaagttcttcgccaacatcctccacacctccaaccaggagaaccgcttcaaggccatcctgcggaagatcaaggaggagttcgagaagaccaagggcagcatggtctgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtgtgccaggccacccaccgcttccgggaggacctgaagaagacggtcaccccgcagaacatcggccccgggtgctaccgcaccctcaacctgttccggtacaagagccgctgctacatcctgaccatgtggaccctgctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccggctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccgctacagccggaaggtgtgcgtgcagttcggggaggagtacctgtgcaagaccatcgacatgaacgactgcttcgtcacccgccacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacaccagcaacatccacttcacggacgagcgcatcgagtggcgggacccggacggcatgctccgcgaccacatcaacatcgtgatctccaaggacatcgacttcgagaacctggggcagaacccctgcaaggtcggcctgcaggccgcgaacatcgagggcgcctgggggagcggcgtggggttcaccctgacctgccaggtgtccctgaccgagtgccccacgttcctgaccagcatcaaggcctgcgacatggccatctgctacggcgccgagtccgtcaccctcagccgggggcagaacaccgtgaagatcacgggcaagggcgggcactccggcagctccttcaagtgctgccacgggaaggagtgcagctccaccggcctgcaggcgagcgcgccccacctggacaaggtgaacggcatctccgacctcgagaacgagaaggtctacgacgacggggccccggagtgcggcgtgacctgctggttcaagaagtccggggagtgggtgatgggcatcatcaacgggaactgggtcgtgctgatcgtgctgtgcgtcctcctgctgttcagcctcatcctgctgagcatcctctgccccgtgcgcaagcacaagaagtcctga

SEQ ID NO: 11844 - RNA, 3402 nt, synthetic construct
  misc_feature 1..3402: note = derived and/or modified CDS sequence (opt1) from SEOV(HBQ17)__KM233655.1__GP
  source 1..3402: mol_type = other RNA
atgtggagcctcctcttcgtggccgccctgatcggccaggggttcgcgctggagaacgccttcgacatgcgcatccggtgcccccactccgtccacttcggcgagaccagcgtgtccgggtacaccgagctcccgcccctgagcctgcaggaggccgagcagctcgtgcccgagtccagctgcaacatggacaaccaccagtccctgagcacgatcaacaagctgaccaaggtcatctggcgcaagaaggccaaccaggagtccgccaaccagaacagcttcgaggtggtggagtccgcgctcaagatcaagggcctgtgcatgctgaagcaccggatggtcgaggagagctaccgcaaccggcgctccgtgatctgctacgacctcgcctgcaacagcaccttctgcaagcccaccgtgtacatgatcgtcccgatccacgcctgcaacatgatgaagtcctgcctgatcgggctgggcccctaccggatccaggtggtgtacgagcgcacgtactgcaccaccggcatcctcaccgaggggaagtgcttcgtccccgacaaggccgtggtgagcgcgctgaagcggggcatgtacgccatcgcctccatcgagacgatctgcttcttcatccaccagaaggggaacacctacaagatcgtcaccgccatcaccagcgccatgggctccaagtgcaacaacacggacaccaaggtgcaggggtactacatctgcatcatcggcggcaacagcgcgcccgtgtacgccccggccggggaggacttccgcgccatggaggtcttcagcggcatcatcaccagcccccacggggaggaccacgacctgcccggcgaggagatcgccacctaccagatctccggccagatcgaggcgaagatcccccacacggtgtccagcaagaacctcaagctgaccgccttcgccgggatcccgtcctacagctccaccagcatcctggccgcctccgaggacggccggttcatcttcagccccgggctgttccccaacctgaaccagtccgtgtgcgacaacaacgcgctgcccctcatctggcgcggcctgatcgacctgaccgggtactacgaggccgtccacccgtgcaacgtgttctgcgtgctcagcggccccggcgcctcctgcgaggccttcagcgagggcgggatcttcaacatcacgtcccccatgtgcctggtcagcaagcagaaccggttccgcgccgcggagcagcagatctccttcgtgtgccagcgggtcgacatggacatcatcgtgtactgcaacgggcagaagaagaccatcctgaccaagaccctcgtgatcggccagtgcatctacacgatcaccagcctgttctccctgctccccggggtcgcccacagcatcgccatcgagctgtgcgtgccgggcttccacggctgggccaccgcggccctgctcatcaccttctgcttcgggtgggtgctgatccccgcctgcacgctggccatcctcctggtcctgaagttcttcgccaacatcctccacaccagcaaccaggagaaccgcttcaaggcgatcctgcggaagatcaaggaggagttcgagaagaccaagggctccatggtgtgcgagatctgcaagtacgagtgcgagaccctgaaggagctcaaggcccacaacctgagctgcgtgcagggggagtgcccctactgcttcacgcactgcgagcccaccgagaccgccatccaggcccactacaaggtctgccaggccacccaccgcttccgggaggacctgaagaagacggtgaccccgcagaacatcggccccgggtgctaccgcaccctcaacctgttccggtacaagtcccgctgctacatcctgaccatgtggaccctgctcctgatcatcgagagcatcctgtgggcggcctccgccgccgagatccccctcgtgcccctgtggacggacaacgcccacggcgtcggcagcgtgccgatgcacaccgacctggagctcgacttctccctgcccagctccagcaagtacacctacaagcgccacctgaccaaccccgtgaacgaccagcagtccgtcagcctccacatcgagatcgagtcccaggggatcggcgcggacgtgcaccacctggggcactggtacgacgcccggctgaacctcaagacgagcttccactgctacggcgcctgcaccaagtaccagtacccgtggcacaccgccaagtgccacttcgagaaggactacgagtacgagaactcctgggcgtgcaacccgcccgactgccccggcgtggggaccggctgcacggcctgcgggctgtacctggaccagctcaagcccgtcggcaccgccttcaagatcatcagcgtgcgctactcccggaaggtgtgcgtccagttcggggaggagtacctgtgcaagaccatcgacatgaacgactgcttcgtgacccgccacgccaagatctgcatcatcggcacggtgagcaagttcagccagggcgacaccctcctcttcctggggcccatggagggcgggggcatcatcttcaagcactggtgcacctccacgtgccacttcggggaccccggcgacgtcatgggccccaaggacaagccgttcatctgccccgagttccccgggcagttccggaagaagtgcaacttcgccaccacccccgtgtgcgagtacgacggcaacatcatcagcgggtacaagaaggtgctggcgaccatcgactccttccagagcttcaacacctccaacatccacttcacggacgagcgcatcgagtggcgggacccggacggcatgctccgcgaccacatcaacatcgtcatcagcaaggacatcgacttcgagaacctggccgagaacccctgcaaggtggggctgcaggccgccaacatcgagggcgcctggggctccggggtgggcttcaccctgacctgccaggtcagcctgaccgagtgccccacgttcctgacctccatcaaggcgtgcgacatggccatctgctacggggccgagagcgtgaccctctcccggggccagaacaccgtgaagatcacggggaagggcggccacagcgggtccagcttcaagtgctgccacggcaaggagtgctccagcaccgggctgcaggcctccgcgccccacctggacaaggtcaacggcatcagcgagctcgagaacgagaaggtgtacgacgacggcgccccggagtgcggggtgacctgctggttcaagaagtccggcgagtgggtcatggggatcatcaacggcaactgggtggtgctgatcgtcctgtgcgtgctcctgctgttcagcctcatcctgctgagcatcctctgccccgtgcgcaagcacaagaagtcctga

SEQ ID NO: 11845 - RNA, 3402 nt, synthetic construct
  misc_feature 1..3402: note = derived and/or modified CDS sequence (opt1) from SEOV(HBQ20)__KM233656.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgtcatcacctccgccatgggcagcaagtgcaacaacacggacaccaaggtgcaggggtactacatctgcatcatcggcggcaacagcgcccccgtgtacgccccggccggggaggacttccgggcgatggaggtcttctccggcatcatcaccagcccccacggggaggaccacgacctgcccggcgaggagatcgccacctaccagatctccggccagatcgaggccaagatcccccacacggtgagctccaagaacctcaagctgaccgccttcgccgggatcccgagctactccagcacctccatcctggcggccagcgaggacggccgcttcatcttctcccccgggctgttccccaacctgaaccagagcgtgtgcgacaacaacgccctgcccctcatctggcggggcctgatcgacctgaccgggtactacgaggccgtccacccgtgcaacgtgttctgcgtcctctccggccccggcgccagctgcgaggcgttctccgagggcgggatcttcaacatcacgagccccatgtgcctggtgtccaagcagaaccgcttccgggccgccgagcagcagatcagcttcgtgtgccagcgcgtcgacatggacatcatcgtgtactgcaacgggcagaagaagaccatcctgaccaagaccctcgtgatcggccagtgcatctacacgatcacctccctgttcagcctgctccccggggtcgcccacagcatcgccatcgagctgtgcgtgccgggcttccacggctgggcgaccgccgccctgctcatcaccttctgcttcgggtgggtgctgatccccgcctgcacgctggcgatcctcctggtcctgaagttcttcgccaacatcctccacacctccaaccaggagaaccggttcaaggccatcctgcgcaagatcaaggaggagttcgagaagaccaagggcagcatggtgtgcgagatctgcaagtacgagtgcgagaccctgaaggagctcaaggcccacaacctgtcctgcgtgcagggggagtgcccctactgcttcacgcactgcgagcccaccgagaccgccatccaggcgcactacaaggtctgccaggccacccaccggttccgcgaggacctgaagaagacggtgaccccgcagaacatcggccccgggtgctaccggaccctcaacctgttccgctacaagagccggtgctacatcctgaccatgtggaccctgctcctgatcatcgagtccatcctgtgggccgccagcgccgcggagatccccctcgtgcccctgtggacggacaacgcccacggcgtcggctccgtgccgatgcacaccgacctggagctcgacttcagcctgccctccagctccaagtacacctacaagcgccacctgaccaaccccgtgaacgaccagcagagcgtctccctccacatcgagatcgagagccaggggatcggcgccgacgtgcaccacctggggcactggtacgacgcccgcctgaacctcaagacgtccttccactgctacggcgcctgcaccaagtaccagtacccgtggcacaccgcgaagtgccacttcgagaaggactacgagtacgagaacagctgggcctgcaacccgcccgactgccccggcgtggggaccggctgcacggcctgcgggctgtacctggaccagctcaagcccgtcggcaccgccttcaagatcatctccgtgcggtacagccgcaaggtgtgcgtccagttcggggaggagtacctgtgcaagaccatcgacatgaacgactgcttcgtgacccggcacgcgaagatctgcatcatcggcacggtgagcaagttctcccagggcgacaccctcctcttcctggggcccatggagggcgggggcatcatcttcaagcactggtgcaccagcacgtgccacttcggggaccccggcgacgtcatgggccccaaggacaagccgttcatctgccccgagttccccgggcagttccgcaagaagtgcaacttcgccaccacccccgtgtgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtcatctccaaggacaccgacttcgagaacctggccgagaacccctgcaaggtggggctgcaggccgcgaacatcgagggcgcctggggcagcggggtgggcttcaccctgacctgccaggtctccctgacggagtgccccaccttcctgaccagcatcaaggcctgcgacatggccatctgctacggggccgagtccgtgaccctcagccgcggccagaacacggtgaagatcaccgggaagggcggccactccgggagctccttcaagtgctgccacggcaaggagtgcagctccaccgggctgcaggcgagcgcgccccacctggacaaggtcaacggcatctccgagctcgagaacgagaaggtgtacgacgacggcgccccggagtgcggggtgacctgctggttcaagaagtccggcgagtgggtcatggggatcatcaacggcaactgggtggtgctgatcgtcctgtgcgtgctcctgctgttcagcctcatcctgctgagcatcctctgccccgtgcggaagcacaagaagtcctga

SEQ ID NO: 11846 - RNA, 3402 nt, synthetic construct
  misc_feature 1..3402: note = derived and/or modified CDS sequence (opt1) from SEOV(HBQ43)__KM233657.1__GP
  source 1..3402: mol_type = other RNA
atgtggagcctcctcttcctggccgccctggtgggccagggggtcgccctcaagaacgtgttcgacatgcgcatccagtgcccccacagcgtgaacttcggcgagaccagcgtctccgggtacaccgagctgccgcccctgagcctccaggaggccgagcagctggtgcccgagtccagctgcaacatggacaaccaccagtccctgagcacgatcaacaagctcaccaaggtgatctggcggaagaaggccaaccaggagtccgccaaccagaacagcttcgaggtcgtggagtccgaggtgagcttcaagggcctgtgcatgctgaagcaccgcatggtcgaggagtcctaccggaaccgccggagcgtgatctgctacgacctcgcctgcaactccaccttctgcaagcccaccgtgtacatgatcgtcccgatccacgcgtgcaacatgatgaagtcctgcctgatcgggctgggcccctaccgcatccaggtggtgtacgagcggacgtactgcaccaccggcatcctcaccgaggggaagtgcttcgtccccgacaaggccgtggtgagcgccctgaagcgcggcatgtacgccatcgcgagcatcgagacgatctgcttcttcatccaccagaaggggaacacctacaagatcgtcaccgccatcacctccgccatgggcagcaagtgcaacaacacggacaccaaggtgcaggggtactacatctgcatcatcggcggcaacagcgcccccgtgtacgccccggcgggggaggacttccgggccatggaggtcttctccggcatcatcaccagcccccacggggaggaccacgacctgcccggcgaggagatcgccacctaccagatctccggccagatcgaggccaagatcccccacacggtgagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtccacccgtgcaacgtgttctgcgtcctctccggccccggcgcgagctgcgaggccttctccgagggcgggatcttcaacatcacgagccccatgtgcctggtgtccaagcagaaccgcttccgggccgccgagcagcagatcagcttcgtgtgccagcgcgtcgacatggacatcatcgtgtactgcaacgggcagaagaagaccatcctgaccaagaccctcgtgatcggccagtgcatctacacgatcacctccctgttcagcctgctccccggggtcgcccacagcatcgcgatcgagctgtgcgtgccgggcttccacggctgggccaccgccgccctgctcatcaccttctgcttcgggtgggtgctgatccccgcgtgcacgctggccatcctcctggtcctgaagttcttcgccaacatcctccacacctccaaccaggagaaccggttcaaggccatcctgcgcaagatcaaggaggagttcgagaagaccaagggcagcatggtgtgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtctgccaggccacccaccggttccgcgaggacctgaagaagacggtgaccccgcagaacatcggccccgggtgctaccggaccctcaacctgttccgctacaagagccggtgctacatcctgaccatgtggaccctgctcctgatcatcgagtccatcctgtgggccgccagcgcggccgagatccccctcgtgcccctgtggacggacaacgcccacggcgtcggctccgtgccgatgcacaccgacctggagctcgacttcagcctgccctccagctccaagtacacctacaagcgccacctgaccaaccccgtgaacgaccagcagagcgtctccctccacatcgagatcgagagccaggggatcggcgccgacgtgcaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtcggcaccgcgttcaagatcatctccgtgcggtacagccgcaaggtgtgcgtccagttcggggaggagtacctgtgcaagaccatcgacatgaacgactgcttcgtgacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtcatgggccccaaggacaagccgttcatctgccccgagttccccgggcagttccgcaagaagtgcaacttcgccaccacccccgtgtgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtcatctccaaggacatcgacttcgagaacctggccgagaacccctgcaaggtggggctgcaggcggccaacatcgagggcgcctggggcagcggggtgggcttcaccctgacctgccaggtctccctgaccgagtgccccacgttcctgaccagcatcaaggcctgcgacatggccatctgctacggggcggagtccgtgaccctcagccgcggccagaacaccgtgaagatcacggggaagggcggccactccgggagctccttcaagtgctgccacggcaaggagtgcagctccaccgggctgcaggccagcgcgccccacctggacaaggtcaacggcttctccgagctcgagaacgagaaggtgtacgacgacggcgccccggagtgcggggtgacctgctggttcaagaagtccggcgagtgggtcatggggatcatcaacggcaactgggtggtgctgatcgtcctgtgcatcctcctgctgttcagcctcatcctgctgagcatcctctgccccgtgcggaagcacaagaagtcctga

SEQ ID NO: 11847 - RNA, 3402 nt, synthetic construct
  misc_feature 1..3402: note = derived and/or modified CDS sequence (opt1) from SEOV(HBQ5)__KM233653.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctgcccggcgaggagatcgccacctaccagatctccggccagatcgaggccaagatcccccacacggtcagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtgcacccgtgcaacgtcttctgcgtgctctccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctgaccaagaccctcgtgatcggccagtgcatctacacgatcacctccctgttcagcctgctccccggggtggcccacagcatcgcgatcgagctgtgcgtcccgggcttccacggctgggccaccgccgccctgctcatcaccttctgcttcgggtgggtgctgatccccgcgtgcacgctggccatcctcctggtgctgaagttcttcgccaacatcctccacacctccaaccaggagaaccggttcaaggccatcctgcgcaagatcaaggaggagttcgagaagaccaagggcagcatggtctgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtgtgccaggccacccaccggttccgcgaggacctgaagaagacggtcaccccgcagaacatcggccccgggtgctaccggaccctcaacctgttccgctacaagagccggtgctacatcctgaccatgtggaccctgctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgaccgagtgccccacgttcctgaccagcatcaaggcctgcgacatggccatctgctacggggcggagtccgtcaccctcagccgcggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcgtcctcctgctgttcagcctcatcctgctgagcatcctctgccccgtgcggaagcacaagaagtcctga

SEQ ID NO: 11848 - RNA, 3402 nt, synthetic construct
  misc_feature 1..3402: note = derived and/or modified CDS sequence (opt1) from SEOV(HBT14)__KM233658.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccggcctgccgcccctgagcctccaggaggccgagcagctggtccccgagtccagctgcaacatggacaaccaccagtccctgagcatcatcaacaagctcacgaaggtgatctggcggaagaaggccaaccaggagtccgccaaccagaacagcttcgaggtggtcgagtccgaggtgagcttcaaggggctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcggcctgggcccctaccgcatccaggtcgtgtacgagcggacctactgcacgaccgggatcctcaccgagggcaagtgcttcgtgcccgacaaggccgtcgtgagcgccctgaagcgcgggatgtacgccatcgcgagcatcgagaccatctgcttcttcatccaccagaagggcaacacgtacaagatcgtgaccgccatcacctccgccatggggagcaagtgcaacaacaccgacacgaaggtccagggctactacatctgcatcatcggcgggaacagcgcccccgtgtacgccccggcgggcgaggacttccgggccatggaggtgttctccgggatcatcaccagcccccacggcgaggaccacgacctgcccggcgaggagatcgccacctaccagatctccgggcagatcgaggccaagatcccccacaccgtcagctccaagaacctcaagctgacggccttcgcgggcatcccgagctactccagcacctccatcctggccgccagcgaggacgggcgcttcatcttctcccccggcctcttccccaacctgaaccagagcgtgtgcgacaacaacgccctgcccctcatctggcgggggctgatcgacctgaccggctactacgaggccgtgcacccgtgcaacgtcttctgcgtgctctccggccccggggcgagctgcgaggccttctccgagggcgggatcttcaacatcaccagccccatgtgcctggtctccaagcagaaccgcttccgggccgccgagcagcagatcagcttcgtgtgccagcgcgtggacatggacatcatcgtctactgcaacggccagaagaagacgatcctgaccaagaccctcgtgatcgggcagtgcatctacaccatcacgtccctgttcagcctgctccccggcgtggcccacagcatcgcgatcgagctgtgcgtcccgggcttccacgggtgggccaccgccgccctgctcatcaccttctgcttcggctgggtgctgatccccgcgtgcaccctggccatcctcctggtgctgaagttcttcgccaacatcctccacacgtccaaccaggagaaccggttcaaggccatcctgcgcaagatcaaggaggagttcgagaagaccaaggggagcatggtctgcgagatctgcaagtacgagtgcgagaccctgaaggagctcaaggcccacaacctgtcctgcgtgcagggcgagtgcccctactgcttcacccactgcgagcccacggagaccgcgatccaggcccactacaaggtgtgccaggccacccaccggttccgcgaggacctgaagaagaccgtcacgccgcagaacatcgggcccggctgctaccggaccctcaacctgttccgctacaagagccggtgctacatcctgaccatgtggaccctgctcctgatcatcgagtccatcctgtgggccgccagcgcggccgagatccccctcgtgcccctgtggaccgacaacgcccacggcgtggggtccgtcccgatgcacacggacctggagctcgacttcagcctgccctccagctccaagtacacctacaagcgccacctgaccaaccccgtgaacgaccagcagagcgtgtccctccacatcgagatcgagagccagggcatcggggccgacgtccaccacctgggccactggtacgacgcccgcctgaacctcaagacctccttccactgctacggcgcgtgcacgaagtaccagtacccgtggcacaccgccaagtgccacttcgagaaggactacgagtacgagaacagctgggcctgcaacccgcccgactgccccggggtgggcaccgggtgcaccgcctgcggcctgtacctggaccagctcaagcccgtggggacggcgttcaagatcatctccgtccggtacagccgcaaggtgtgcgtgcagttcggcgaggagtacctgtgcaagaccatcgacatgaacgactgcttcgtcacccggcacgccaagatctgcatcatcggcaccgtgagcaagttctcccagggggacacgctcctgttcctgggccccatggagggcggcgggatcatcttcaagcactggtgcaccagcacgtgccacttcggggaccccggcgacgtgatggggcccaaggacaagccgttcatctgccccgagttccccggccagttccgcaagaagtgcaacttcgccaccacccccgtctgcgagtacgacgggaacatcatctccggctacaagaaggtgctggccaccatcgacagcttccagtccttcaacaccagcaacatccacttcaccgacgagcggatcgagtggcgcgacccggacgggatgctccgggaccacatcaacatcgtgatctccaaggacatcgacttcgagaacctggccgagaacccctgcaaggtcggcctgcaggcggccaacatcgagggcgcctgggggagcggcgtggggttcacgctgacctgccaggtgtccctgaccgagtgccccaccttcctgacgagcatcaaggcctgcgacatggccatctgctacggcgcggagtccgtcaccctcagccgcgggcagaacaccgtgaagatcaccggcaagggcgggcactccggcagctccttcaagtgctgccacgggaaggagtgcagctccacgggcctgcaggccagcgcgccccacctggacaaggtgaacggcatctccgagctcgagaacgagaaggtctacgacgacggggccccggagtgcggcgtgacctgctggttcaagaagtccggggagtgggtgatgggcatcatcaacgggaactgggtcgtgctgatcgtgctgtgcgtcctcctgctgttcagcctcatcctgctgagcatcctctgccccgtgcggaagcacaagaagtcctga

SEQ ID NO: 11849 - RNA, 3402 nt, synthetic construct
  misc_feature 1..3402: note = derived and/or modified CDS sequence (opt1) from SEOV(HBT-3)__KM233661.1__GP
  source 1..3402: mol_type = other RNA
atgtggagcctcctcttcctggccgccctggtgggccaggggttcgcgctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcccctgcaactccaccttctgcaagccgaccgtgtacatgatcgtgcccatccacgcctgcaacatgatgaagtcctgcctgatcgggctgggcccctaccgcatccaggtcgtgtacgagcggacgtactgcaccaccggcatcctcaccgaggggaagtgcttcgtgcccgacaaggcggtcgtgagcgccctgaagcgcggcatgtacgccatcgccagcatcgagacgatctgcttcttcatccaccagaaggggaacacctacaagatcgtgaccgcgatcacctccgccatgggcagcaagtgcaacaacacggacaccaaggtccaggggtactacatctgcatcatcggcggcaacagcgccccggtgtacgcccccgccggggaggacttccgggcgatggaggtgttctccggcatcatcaccagcccccacggggaggaccacgacctgcccggcgaggagatcgccacctaccagatctccggccagatcgaggccaagatcccgcacacggtcagctccaagaacctcaagctgaccgccttcgccgggatccccagctactccagcacctccatcctggcggccagcgaggacggccgcttcatcttctcccccgggctgttccccaacctgaaccagagcgtgtgcgacaacaacgccctgccgctcatctggcggggcctgatcgacctgaccgggtactacgaggccgtgcacccctgcaacgtcttctgcgtgctctccggccccggcgccagctgcgaggcgttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctgaccaagaccctcgtgatcggccagtgcatctacacgatcacctccctgttcagcctgctcccgggggtggcccacagcatcgccatcgagctgtgcgtccccggcttccacggctgggcgaccgccgccctgctcatcaccttctgcttcgggtgggtgctgatccccgcctgcacgctggcgatcctcctggtgctgaagttcttcgccaacatcctccacacctccaaccaggagaaccggttcaaggccatcctgcgcaagatcaaggaggagttcgagaagaccaagggcagcatggtctgcgagatctgcaagtacgagtgcgagaccttcaaggagctgaaggcccacaacctctcctgcgtgcagggggagtgcccctactgcttcacgcactgcgagccgaccgagaccgccatccaggcgcactacaaggtgtgccaggccacccaccggttccgcgaggacctgaagaagacggtcacgccccagaacatcggccccgggtgctaccggaccctgaacctcttccgctacaagagccggtgctacatcctgaccatgtggaccctgctgctcatcatcgagtccatcctgtgggccgccagcgccgcggagatccccctggtgccgctctggaccgacaacgcccacggcgtgggctccgtccccatgcacaccgacctggagctggacttcagcctcccctccagctccaagtacacctacaagcgccacctgaccaacccggtgaacgaccagcagagcgtgtccctgcacatcgagatcgagagccaggggatcggcgccgacgtccaccacctcgggcactggtacgacgcccgcctgaacctgaagacgtccttccactgctacggcgcctgcaccaagtaccagtacccctggcacaccgcgaagtgccacttcgagaaggactacgagtacgagaacagctgggcctgcaacccgcccgactgccccggcgtggggaccggctgcacggcctgcgggctctacctggaccagctgaagcccgtgggcaccgccttcaagatcatctccgtccggtacagccgcaaggtgtgcgtgcagttcggggaggagtacctctgcaagaccatcgacatgaacgactgcttcgtcacccggcacgcgaagatctgcatcatcggcacggtgagcaagttctcccagggcgacaccctgctgttcctcgggcccatggagggcgggggcatcatcttcaagcactggtgcaccagcacgtgccacttcggggaccccggcgacgtgatgggcccgaaggacaagcccttcatctgccccgagttccccgggcagttccgcaagaagtgcaacttcgccaccaccccggtctgcgagtacgacggcaacatcatctccgggtacaagaaggtgctggccaccatcgacagcttccagtccttcaacaccagcaacatccacttcacggacgagcggatcgagtggcgcgaccccgacggcatgctgcgggaccacatcaacatcgtgatctccaaggacatcgacttcgagaacctcgccgagaacccctgcaaggtcgggctgcaggccgcgaacatcgagggcgcctggggcagcggggtgggcttcaccctgacctgccaggtgtccctcaccgagtgccccacgttcctgaccagcatcaaggcctgcgacatggccatctgctacggggccgagtccgtcaccctgagccgcggccagaacaccgtgaagatcacggggaagggcggccactccgggagctccttcaagtgctgccacggcaaggagtgcagctccaccgggctccaggcgagcgccccgcacctggacaaggtgaacggcatctccgagctggagaacgagaaggtctacgacgacggcgcccccgagtgcggggtgacctgctggttcaagaagtccggcgagtgggtgatggggatcatcaacggcaactgggtcgtgctcatcgtgctgtgcgtcctgctcctgttcagcctgatcctcctgagcatcctgtgccccgtgcggaagcacaagaagtcctga

SEQ ID NO: 11850 - RNA, 3402 nt, synthetic construct
  misc_feature 1..3402: note = derived and/or modified CDS sequence (opt1) from SEOV(HBT49)__KM233659.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctgcccggcgaggagatcgccacctaccagatctccggccagatcgaggccaagatcccccacacggtcagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtgcacccgtgcaacgtcttctgcgtgctctccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctgaccaagaccctcgtgatcggccagtgcatctacacgatcacctccctgttcagcctgctccccggggtggcccacagcatcgcgatcgagctgtgcgtcccgggcttccacggctgggccaccgccgccctgctcatcaccttctgcttcgggtgggtgctgatccccgcgtgcacgctggccatcctcctggtgctgaagttcttcgccaacatcctccacacctccaaccaggagaaccggttcaaggccatcctgcgcaagatcaaggaggagttcgagaagaccaagggcagcatggtctgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtgtgccaggccacccaccggttccgcgaggacctgaagaagacggtcaccccgcagaacatcggccccgggtgctaccggaccctcaacctgttccgctacaagagccggtgctacatcctgaccatgtggaccctgctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtctaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgaccgagtgccccacgttcctgaccagcatcaaggcctgcgacatggccatctgctacggggcggagtccgtcaccctcagccgcggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcgtcctcctgctgttcagcctcatcctgctgagcatcctctgccccgtgcggaagcacaagaagtcctga

SEQ ID NO: 11851 - RNA, 3402 nt, synthetic construct
  misc_feature 1..3402: note = derived and/or modified CDS sequence (opt1) from SEOV(HBT50)__KM233660.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggaagaaggccaaccaggagtccgccaaccagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgcctgatcgggctgggcccctaccgcatccaggtcgtgtacgagcggacgtactgcaccaccggcatcctcaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctgcccggcgaggagatcgccacctaccagatctccggccagatcgaggccaagatcccccacacggtcagctccaagaacctcaagctgaccgccttcgcggggatcccgagctactccagcacctccatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtgcacccgtgcaacgtcttctgcgtgctctccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctgaccaagaccctcgtgatcggccagtgcatctacacgatcacctccctgttcagcctgctccccggggtggcccacagcatcgcgatcgagctgtgcgtcccgggcttccacggctgggccaccgccgccctgctcatcaccttctgcttcgggtgggtgctgatccccgcgtgcacgctggccatcctcctggtgctgaagttcttcgccaacatcctccacacctccaaccaggagaaccggttcaaggccatcctgcgcaagatcaaggaggagttcgagaagaccaagggcagcatggtctgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtgtgccaggccacccaccggttccgcgaggacctgaagaagacggtcaccccgcagaacatcggccccgggtgctaccggaccctcaacctgttccgctacaagagccggtgctacatcctgaccatgtggaccctgctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctcttcctggggcccatggagggcgggggcatcatcttccgccactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacaccagcaacatccacttcacggacgagcgcatcgagtggcgggacccggacggcatgctccgcgaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgaccgagtgccccacgttcctgaccagcatcaaggcctgcgacatggccatctgctacggggcggagtccgtcaccctcagccggggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcgtcctcctgctgttcagcctcatcctgctgagcatcctctgccccgtgcgcaagcacaagaagtcctga

SEQ ID NO: 11852 - RNA, 3402 nt, synthetic construct
  misc_feature 1..3402: note = derived and/or modified CDS sequence (opt1) from SEOV(HuludaoRn101)__GU592923.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagtccgccaaccagaacagcttcgaggtcgtggagtccgaggtgagcttcaagggcctgtgcatgctcaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctgatcgggctcggcccctaccgcatccaggtggtgtacgagcggacgtactgcaccaccggcatcctgaccgaggggaagtgcttcgtccccgacaaggccgtggtgagcgccctgaagcgcggcatgtacgccatcgcgagcatcgagacgatctgcttcttcatccaccagaaggggaacacctacaagatcgtcaccgccatcacctccgccatgggcagcaagtgcaacaacacggacaccaaggtgcaggggtactacatctgcatcatcggcggcaacagcgcccccgtgtacgccccggcgggggaggacttccgggccatggaggtcttctccggcatcatcaccagcccccacggggaggaccacgacctccccggcgaggagatcgccacctaccagatctccggccagatcgaggccaagatcccccacacggtgagctccaagaacctgaagctgatcgccttcgcggggatcccgagctactccagcacctccatcctcgccgccagcgaggactcccgcttcatcttcagccccggcctgttccccaacctgaaccagtccgtgtgcgacaacaacgccctccccctgatctggcgggggctgatcgacctcaccggctactacgagaccgtccacccgtgcaacgtgttctgcgtcctgagcgggcccggcgcctcctgcgaggcgttcagcgagggcgggatcttcaacatcacgtcccccatgtgcctggtgagcaagcagaaccgcttccgggccgccgagcagcagatctccttcatctgccagcgcgtggacatggacatcatcgtctactgcaacggccagaagaagaccatcctcaccaagaccctggtgatcgggcagtgcatctacacgatcaccagcctgttcagcctcctgcccggcgtggcccactccatcgccatcgagctgtgcgtcccggggttccacggctgggcgaccgccgccctcctgatcaccttctgcttcggctgggtgctgatccccgcctgcacgctcgcgatcctgctggtgctcaagttcttcgccaacatcctgcacaccagcaaccaggagaaccggttcaaggccatcctgcgcaagatcaaggaggagttcgagaagaccaaggggtccatggtctgcgagatctgcaagtacgagtgcgagaccctcaaggagctgaaggcccacaacctgagctgcgtgcagggcgagtgcccctactgcttcacgcactgcgagcccaccgagaccgccatccaggcgcactacaaggtgtgccaggccacccaccggttccgcgaggacctcaagaagacggtcaccccgcagaacatcgggcccggctgctaccggaccctgaacctgttccgctacaagtcccggtgctacatcctgaccatgtggaccctcctgctgatcatcgagagcatcctctgggccgcctccgccgcggagatccccctggtgcccctgtggacggacaacgcccacggggtgggcagcatcccgatgcacaccgacctcgagctggacttctccctgcccagctccagcaagtacacctacaagcgccacctcaccaaccccgtcaacgaccagcagtccgtgagcctgcacatcgagatcgagtcccagggcatcggggccgacgtgcaccacctgggccactggtacgacgcccgcctcaacctgaagacgagcttccactgctacggggcctgcaccaagtaccagtacccgtggcacaccgcgaagtgccacttcgagaaggactacgagtacgagaactcctgggcctgcaacccgcccgactgccccggcgtcggcaccgggtgcacggcctgcggcctgtacctcgaccagctgaagcccgtggggaccgccttcaagatcatcagcgtgcggtacagccgcaaggtctgcgtgcagttcggcgaggagtacctgtgcaagaccatcgacatgaacgactgcttcgtgacccggcacgcgaagatctgcatcatcgggacggtctccaagttcagccagggcgacaccctcctgttcctgggccccatggagggcggcgggatcatcttcaagcactggtgcacctccacgtgccacttcggggaccccggggacgtgatgggccccaaggacaagccgttcatctgccccgagttccccggccagttccgcaagaagtgcaacttcgccaccacccccatctgcgagtacgacgggaacatcatcagcggctacaagaaggtgctcgccaccatcgactccttccagagcttcaacacctccaacatccacttcacggacgagcggatcgagtggcgcgacccggacgggatgctgcgggaccacatcaacgtcgtgatcagcaaggacatcgacttcgagaacctggccgagaacccctgcaaggtgggcctccaggccgcgaacatcgagggggcctggggctccggcgtcgggttcaccctgacctgccaggtgagcctgaccgagtgccccacgttcctcacctccatcaaggcctgcgacatggccatctgctacggcgccgagagcgtgaccctgtcccgcgggcagaacaccgtccggatcacgggcaagggcgggcacagcggctccagcttcaagtgctgccacgggaaggagtgctccagcaccggcctgcaggcgtccgcgccccacctcgacaaggtgaacgggatcagcgagctggagaacgagaaggtgtacgacgacggcgccccggagtgcggcgtgacctgctggttcaagaagtccggggagtgggtcatgggcatcatcaacgggaactgggtggtcctgatcgtgctctgcgtgctgctcctgttcagcctgatcctgctcagcatcctgtgccccgtccgcaagcacaagaagtcctga

SEQ ID NO: 11853 - RNA, 3402 nt, synthetic construct
  misc_feature 1..3402: note = derived and/or modified CDS sequence (opt1) from SEOV(Humber)__JX879768.1__GP
  source 1..3402: mol_type = other RNA
atgtggagcctgctcctgctggccgccctcgtgggccaggggttcgcgctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgtccgccctgaagcgcggcatgtacgccatcgcgagcatcgagacgatctgcttcttcgtgcaccagaaggggaacacctacaagatcgtcaccgccatcacctccgccatgggcagcaagtgcaacaacacggacaccaaggtgcaggggtactacatctgcatcatcggcggcaacagcgcccccgtgtactccccggccggggaggacttccgggcgatggaggtcttcagcggcatcatcaccagcccccacggggaggaccacgacctccccggcgaggagatcgccacctaccagatcagcggccagatcgaggccaagatcccccacacggtgtccagcaagaacctgaagctgaccgccttcgccgggatcccgtcctacagctccaccagcatcctcgcggcctccgaggacggccgcttcatcttcagccccgggctgttccccaacctgaaccagtccgtgtgcgacaacaacgccctccccctgatctggcggggcctgatcgacctcaccgggtactacgaggccgtccacccgtgcaacgtgttctgcgtcctgagcggccccggcgcctcctgcgaggcgttcagcgagggcgggatcttcaacatcacgtcccccatgtgcctggtgagcaagcagaaccgcttccgggccgccgagcagcagatctccttcatctgccagcgcgtggacatggacatcatcgtctactgcaacgggcagaagaagaccatcctcaccaagaccctggtgatcggccagtgcatctacacgatcaccagcctgttcagcctcctgcccggggtggcccactccatcgccatcgagctgtgcgtcccgggcttccacggctgggcgaccgccgccctcctgatcaccttctgcttcgggtgggtgctgatccccgcctgcacgctcgcggtgctgctggtcctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcccacaacctgagctgcatccagggggagtgcccctactgcttcacgcactgcgagcccaccgagaccgccatccaggcgcactacaaggtgtgccaggccacccaccggttccgcgaggacctcaagaagacggtcaccccgcccaacatcggccccgggtgctaccggaccctgaacctgttccgctacaagtcccggtgctacatcctgaccatgtggaccctcctgctgatcatcgagagcatcctctgggccgcctccgccgcggagatccccctggtgccgctgtggacggacaacgcccacggcgtgggcagcgtccccatgcacaccgacctcgagctggacttctccctgcccagctccagcaagtacacctacaagcgccacctcaccaacccggtgaacgaccagcagtccgtgagcctgcacatcgagatcgagtcccaggggatcggcgccgacgtccaccacctggggcactggtacgacgcccgcctcaacctgaagacgagcttccactgctacggcgcctgcaccaagtaccagtacccctggcacaccgcgaagtgccacttcgagaaggactacgagtacgagaactcctgggcctgcaacccgcccgactgccccggcgtggggaccggctgcacggcctgcgggctgtacctcgaccagctgaagcccgtgggcaccgccttcaagatcatcagcgtccggtacagccgcaaggtgtgcgtgcagttcggggaggagtacctgtgcaagaccatcgacatgaacgactgcttcgtcacccggcacgcgaagatctgcatcatcggcacggtgtccaagttcagccagggcgacaccctcctgttcctggggcccatggagggcgggggcatcatcttcaagcactggtgcacctccacgtgccacttcggggaccccggcgacgtgatgggcccgaaggacaagcccttcatctgccccgagttccccgggcagttccgcaagaagtgcaacttcgccaccaccccggtctgcgagtacgacggcaacatcatcagcgggtacaagaaggtgctcgccaccatcgactccttccagagcttcaacacctccaacatccacttcacggacgagcggatcgagtggcgcgaccccgacggcatgctgcgggaccacatcaacatcatcatcagcaaggacatcgacttcgagaacctggccgagaacccctgcaaggtggggctccaggccgcgaacatcgagggcgcctggggctccggggtcggcttcaccctgacctgccaggtgagcctgaccgagtgccccacgttcctcacctccatcaaggcctgcgacatggccatctgctacggggccgagagcgtgaccctgtcccgcggccagaacaccgtcaagatcacggggaagggcggccacagcgggtccagcttcaagtgctgccacggcaaggagtgctccagcaacgggctgcaggcgtccgccccgcacctcgacaaggtgaacggcatcagcgagctggagaacgagaaggtgtacgacgacggcgcccccgagtgcggggtgacctgctggttcaagaagtccggcgagtgggtcatggggatcatcaacggcaactgggtggtcctgatcgtgctctgcgtgctgctcctgttcagcctgatcctgctcagcatcctgtgccccgtccggaagcacaagaagtcctga

SEQ ID NO: 11854 - RNA, 3402 nt, synthetic construct
  misc_feature 1..3402: note = derived and/or modified CDS sequence (opt1) from SEOV(Humber)__KM948597.1__GP
  source 1..3402: mol_type = other RNA
atgtggagcctgctcctgctggccgccctcgtgggccaggggttcgcgctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgtccgccctgaagcgcggcatgtacgccatcgcgagcatcgagacgatctgcttcttcgtgcaccagaaggggaacacctacaagatcgtcaccgccatcacctccgccatgggcagcaagtgcaacaacacggacaccaaggtgcaggggtactacatctgcatcatcggcggcaacagcgcccccgtgtactccccggccggggaggacttccgggcgatggaggtcttcagcggcatcatcaccagcccccacggggaggaccacgacctccccggcgaggagatcgccacctaccagatcagcggccagatcgaggccaagatcccccacacggtgtccagcaagaacctgaagctgaccgccttcgccgggatcccgtcctacagctccaccagcatcctcgcggcctccgaggacggccgcttcatcttcagccccgggctgttccccaacctgaaccagtccgtgtgcgacaacaacgccctccccctgatctggcggggcctgatcgacctcaccgggtactacgaggccgtccacccgtgcaacgtgttctgcgtcctgagcggccccggcgcctcctgcgaggcgttcagcgagggcgggatcttcaacatcacgtcccccatgtgcctggtgagcaagcagaaccgcttccgggccgccgagcagcagatctccttcatctgccagcgcgtggacatggacatcatcgtctactgcaacgggcagaagaagaccatcctcaccaagaccctggtgatcggccagtgcatctacacgatcaccagcctgttcagcctcctgcccggggtggcccactccatcgccatcgagctgtgcgtcccgggcttccacggctgggcgaccgccgccctcctgatcaccttctgcttcgggtgggtgctgatccccgcctgcacgctcgcggtgctgctggtcctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcccacaacctgagctgcatccagggggagtgcccctactgcttcacgcactgcgagcccaccgagaccgccatccaggcgcactacaaggtgtgccaggccacccaccggttccgcgaggacctcaagaagacggtcaccccgcccaacatcggccccgggtgctaccggaccctgaacctgttccgctacaagtcccggtgctacatcctgaccatgtggaccctcctgctgatcatcgagagcatcctctgggccgcctccgccgcggagatccccctggtgccgctgtggacggacaacgcccacggcgtgggcagcgtccccatgcacaccgacctcgagctggacttctccctgcccagctccagcaagtacacctacaagcgccacctcaccaacccggtgaacgaccagcagtccgtgagcctgcacatcgagatcgagtcccaggggatcggcgccgacgtccaccacctggggcactggtacgacgcccgcctcaacctgaagacgagcttccactgctacggcgcctgcaccaagtaccagtacccctggcacaccgcgaagtgccacttcgagaaggactacgagtacgagaactcctgggcctgcaacccgcccgactgccccggcgtggggaccggctgcacggcctgcgggctgtacctcgaccagctgaagcccgtgggcaccgccttcaagatcatcagcgtccggtacagccgcaaggtgtgcgtgcagttcggggaggagtacctgtgcaagaccatcgacatgaacgactgcttcgtcacccggcacgcgaagatctgcatcatcggcacggtgtccaagttcagccagggcgacaccctcctgttcctggggcccatggagggcgggggcatcatcttcaagcactggtgcacctccacgtgccacttcggggaccccggcgacgtgatgggcccgaaggacaagcccttcatctgccccgagttccccgggcagttccgcaagaagtgcaacttcgccaccaccccggtctgcgagtacgacggcaacatcatcagcgggtacaagaaggtgctcgccaccatcgactccttccagagcttcaacacctccaacatccacttcacggacgagcggatcgagtggcgcgaccccgacggcatgctgcgggaccacatcaacatcatcatcagcaaggacatcgacttcgagaacctggccgagaacccctgcaaggtggggctccaggccgcgaacatcgagggcgcctggggctccggggtcggcttcaccctgacctgccaggtgagcctgaccgagtgccccacgttcctcacctccatcaaggcctgcgacatggccatctgctacggggccgagagcgtgaccctgctgcgcggccagaacaccgtcaagatcacggggaagggcggccactccgggagctccttcaagtgctgccacggcaaggagtgcagctccaacgggctccaggcgagcgccccgcacctggacaaggtgaacggcatctccgagctggagaacgagaaggtgtacgacgacggcgcccccgagtgcggggtgacctgctggttcaagaagtccggcgagtgggtcatggggatcatcaacggcaactgggtggtcctcatcgtgctgtgcgtgctgctcctgttcagcctgatcctcctgagcatcctgtgccccgtccggaagcacaagaagtcctga

SEQ ID NO: 11855 - RNA, 3402 nt, synthetic construct
  misc_feature 1..3402: note = derived and/or modified CDS sequence (opt1) from SEOV(K24-e7)__AF288652.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagtccgccaaccagaacagcttcgaggtcgtggagtccgaggtgagcttcaagggcctgtgcatgctcaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctgatcgggctcggcccctaccgcatccaggtggtgtacgagcggacgtactgcaccaccggcatcctgaccgaggggaagtgcttcgtccccggcaaggccgtggtgagcgccctgaagcgcgggatgtacgccatcgcgagcatcgagacgatctgcttcttcatccaccagaagggcaacacctacaagatcgtcaccgccatcacctccgccatggggagcaagtgcaacaacacggacaccaaggtgcagggctactacatctgcatcatcggcgggaacagcgcccccgtgtacgccccggcgggcgaggacttccgggccatggaggtcttctccgggatcatcaccagcccccacggcgaggaccacgacctccccggcgaggagatcgccacctaccagatctccgggcagatcgaggccaagatcccccacacggtgagctccaagaacctgaagctgatcgccttcgcgggcatcccgagctactccagcacctccatcctcgccgccagcgaggacgggcgcttcatcttctcccccggcctgttccccaacctgaaccagagcgtgtgcgacaacaacgccctccccctgatctggcgggggctgatcgacctcaccggctactacgaggccgtccacccgtgcaacgtgttccgcgtcctgtccggccccggggcgagctgcgaggccttctccgagggcgggatcttcaacatcaccagccccatgtgcctggtgtccaagcagaaccggttccgcgccgccgagcagcagatcagcttcatctgccagcgggtggacatggacatcatcgtctactgcaacggccagaagaagacgatcctcaccaagaccctggtgatcgggcagtgcatctacaccatcacgtccctgttcagcctcctgcccggcgtggcccacagcatcgcgatcgagctgtgcgtcccgggcttccacgggtgggccaccgccgccctcctgatcaccttctgcttcggctgggtgctgatccccgcgtgcaccctcgccatcctgctggtgctcaagttcttcgccaacatcctgcacacgtccaaccaggagaaccgcttcaaggccatcctgcggaagatcaaggaggagttcgagaagaccaaggggagcatggtctgcgagatctgcaagtacgagtgcgagaccctcaaggagctgaaggcccacaacctgtcctgcgtgcagggcgagtgcccctactgcttcacccactgcgagcccacggagaccgcgatccaggcccactacaaggtgtgccaggccacccaccgcttccgggaggacctcaagaagaccgtcacgccgcagaacatcgggcccggctgctaccgcaccctgaacctgttccggtacaagagccgctgctacatcctgaccatgtggaccctcctgctgatcatcgagtccatcctctgggccgccagcgcggccgagatccccctggtgcccctgtggaccgacaacgcccacggcgtggggtccgtcccgatgcacacggacctcgagctggacttcagcctgccctccagctccaagtacacctacaagcgccacctcaccaaccccgtgaacgaccagcagagcgtgtccctgcacatcgagatcgagagccagggcatcggggccgacgtccaccacctgggccactggtacgacgcccggctcaacctgaagacctccttccactgctacggcgcgtgcacgaagtaccagtacccgtggcacaccgccaagtgccacttcgagaaggactacgagtacgagaacagctgggcctgcaacccgcccgactgccccggggtgggcaccgggtgcaccgcctgcggcctgtacctcgaccagctgaagcccgtggggacggcgttcaagatcatctccgtccgctacagccggaaggtgtgcatgcagttcggcgaggagtacctgtgcaagaccatcgacatgaacgactgcttcgtgacccgccacgccaagatctgcatcatcggcaccgtcagcaagttctcccagggggacacgctcctgttcctgggccccatggagggcggcgggatcatcttcaagcactggtgcaccagcacgtgccacttcggggaccccggcgacgtgatggggcccaaggacaagccgttcatctgccccgagttccccggccagttccggaagaagtgcaacttcgccaccacccccatctgcgagtacgacgggaacatcatctccggctacaagaaggtgctcgccaccatcgacagcttccagtccttcaacaccagcaacatccacttcaccgacgagcgcatcgagtggcgggacccggacgggatgctgcgcgaccacatcaacatcgtcatctccaaggacatcgacttcgagaacctggccgagaacccctgcaaggtgggcctccaggcggccaacatcgagggcgcctgggggagcggcgtggggttcacgctgacctgccaggtctccctgaccgagtgccccaccttcctcacgagcatcaaggcctgcgacatggccatctgctacggcgcggagtccgtgaccctgagccgggggcagaacaccgtgcgcatcaccggccggggcgggcactccggcagctccttcaagtgctgccacgggaaggagtgcagctccacgggcctgcaggccagcgcgccccacctcgacaaggtcaacggcatctccgagctggagaacgagaaggtgtacgacgacggggccccggagtgcggcgtgacctgctggttcaagaagtccggggagtgggtcatgggcatcatcaacgggaactgggtggtgctgatcgtcctctgcgtgctgctcctgttcagcctgatcctgctcagcatcctgtgccccgtgcgcaagcacaagaagtcctga

SEQ ID NO: 11856 - RNA, 3402 nt, synthetic construct
  misc_feature 1..3402: note = derived and/or modified CDS sequence (opt1) from SEOV(K24-v2)__AF288654.1__GP
  source 1..3402: mol_type = other RNA
atgtggagcctgctcctgctggccgccctcgtgggccaggggttcgcgctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagtccgccaaccagaacagcttcgaggtcgtggagtccgaggtgagcttcaagggcctgtgcatgctcaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctgatcgggctcggcccctaccgcatccaggtggtgtacgagcggacgtactgcaccaccggcatcctgaccgaggggaagtgcttcgtccccgacacggccgtggtgagcgccctgaagcgcggcatgtacgccatcgcgagcatcgagaccatctgcttcttcatccaccagaaggggaacacctacaagatcgtcaccgccatcacgtccgccatgggcagcaagtgcaacaacaccgacaccaaggtgcaggggtactacatctgcatcatcggcggcaacagcgcccccgtgtacgccccggcgggggaggacttccgggccatggaggtcttctccggcatcatcaccagcccccacggggacgaccacgacctccccggcgaggagatcgccccctaccagatctccggccagatcgaggccaagatcccgcacacggtgagctccaagaacctgaagctgatcgccttcgcggggatccccagctactccagcacctccatcctcgccgccagcgaggacggccgcttcatcttctcccccgggctgttccccaacctgaaccagagcgtgtgcgacaacaacgccctcccgctgatctggcggggcctgatcgacctcaccgggtactacgaggccgtccacccctgcaacgtgttctgcgtcctgtccggccccggcgcgagctgcgaggccttctccgagggcgggatcttcaacatcaccagccccatgtgcctggtgtccaagcagaaccgcttccgggccgccgagcagcagatcagcttcatctgccagcgcgtggacatggacatcatcgtctactgcaacgaccagaagaagacgatcctcaccaagaccctggtgatcgggcagtgcatctacaccatcacgtccctgttcagcctcctgccgggcgtggcccacagcatcgcgatcgagctgtgcgtccccgggttccacggctgggccaccgccgccctcctgatcaccttctgcttcggctgggtgctgatccccgcgtgcaccctcgccatcctgctggtgctcaagttcttcgccaacatcctgcacacgtccaaccaggagaaccggttcaaggccatcctgcgcaagatcaaggaggagttcgagaagaccaaggggagcatggtctgcgagatctgcaagtacgagtgcgagaccctcaaggagctgaaggcccacaacctgtcctgcgtgcagggcgagtgcccctactgcttcacccactgcgagccgacggagaccgcgatccaggcccactacaaggtgtgccaggccacccaccggttccgcgaggacctcaagaagaccgtcacgccccagaacatcgggcccggctgctaccggaccctgaacctgttccgctacaagagccggtgctacatcctgaccatgtggaccctcctgctgatcatcgagtccatcctctgggccgccagcgcggccgagatccccctggtgccgctgtggaccgacaacgcccacggggtgggctccgtccccatgcacacggacctcgagctggacttcagcctgccctccagctccaagtacacctacaagcgccacctcaccaacccggtgaacgaccagcagagcgtgtccctgcacatcgagatcgagagccagggcatcggggccgacgtccaccacctgggccactggtacggggcccgcctcaacctgaagacctccttccactgctacggcgcgtgcacgaagtaccagtacccctggcacaccgccaagtgccacttcgagaaggactacgagtacgagaacagctgggcctgcaacccgcccgactgccccggcgtggggaccggctgcaccgcctgcgggctgtacctcgaccagctgaagcccgtgggcacggcgttcaagatcatctccgtccggtacagccgcaaggtgtgcatgcagttcggggaggagtacctgtgcaagaccatcgacatgaacgactgcttcgtgacccggcacgccaagatctgcatcatcggcaccgtcagcaagttctcccagggcgacacgctcctgttcctggggcccatggagggcgggggcatcatcttcaagcactggtgcaccagcacgtgccacttcggggaccccggcgacgtgatgggcccgaaggacaagcccttcatctgccccgagttccccgggcagttccgcaagaagtgcaacttcgccaccaccccgatctgcgagtacgacggcaacatcatctccgggtacaagaaggtgctcgccaccatcgacagcttccagtccttcaacaccagcaacatccacttcaccgacgagcggatcgagtggcgcgaccccgacggcatgctgcgggaccacatcaacatcgtcatctccaaggacatcgacttcgagaacctggccgagaacccctgcaaggtggggctccaggcggccaacatcgagggcgcctggggcagcggggtgggcttcacgctgacctgccaggtctccctgaccgagtgccccaccttcctcacgagcatcaaggcctgcgacatggccatctgctacggggcggagtccgtgaccctgagccgcggccagaacaccgtgcggatcaccgggaagggcggccactccgggagctccttcaagtgctgccacggcaaggagtgcagctccacggggctgcaggccagcgccccgcacctcgacaaggtcaacggcatctccgagctggagaacgagaaggtgtacgacgacggcgcccccgagtgcggggtgacctgctggttcaagaagtccggcgagtgggtcatggggatcatcaacggcaactgggtggtgctgatcgtcctctgcgtgctgctcctgttcagcctgatcctgctcagcatcctgtgccccgtgcgcaagcacaagaagtcctga

SEQ ID NO: 11857 - RNA, 3402 nt, synthetic construct
  misc_feature 1..3402: note = derived and/or modified CDS sequence (opt1) from SEOV(KI-83-262)__D17592.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgagcctgttccgctacaagtcccggtgctacatcctgaccatgtggaccctcctgctgatcatcgagagcatcctctgggccgcctccgcggccgagatccccctggtgcccctgtggacggacaacgcccacggcgtgggcagcgtcccgatgcacaccgacctcgagctggacttctccctgcccagctccagcaagtacacctacaagcgccacctcaccaaccccgtgaacgaccagcagtccgtgagcctgcacatcgagatcgagtcccaggggatcggcgccgacgtccaccacctggggcactggtacgacgcccgcctcaacctgaagacgagcttccactgctacggcgcgtgcaccaagtaccagtacccgtggcacaccgccaagtgccacttcgagaaggactacgagtacgagaactcctgggcctgcaacccgcccgactgccccggcgtggggaccggctgcacggcctgcgggctgtacctcgaccagctgaagcccgtgggcaccgcgttcaagatcatcagcgtccggtacagccgcaaggtgtgcgtgcagttcggggaggagtacctgtgcaagaccatcgacatgaacgactgcttcgtcacccggcacgccaagatctgcatcatcggcacggtgtccaagttcagccagggcgacaccctcctgttcctggggcccatggagggcgggggcatcatcttcaagcactggtgcacctccacgtgccacttcggggaccccggcgacgtgatgggccccaaggacaagccgttcatctgccccgagttccccgggcagttccgcaagaagtgcaacttcgccaccacccccgtctgcgagtacgacggcaacatcatcagcgggtacaagaaggtgctcgccaccatcgactccttccagagcttcaacacctccaacatccacttcacggacgagcggatcgagtggcgcgacccggacggcatgctgcgggaccacatcaacatcgtgatcagcaaggacatcgacttcgagaacctggccgagaacccctgcaaggtcgggctccaggcggccaacatcgagggcgcctggggctccggggtgggcttcaccctgacctgccaggtgagcctgaccgagtgccccacgttcctcacctccatcaaggcctgcgacatggccatctgctacggggcggagagcgtcaccctgtcccgcggccagaacaccgtgaagatcacggggaagggcggccacagcgggtccagcttcaagtgctgccacggcaaggagtgctccagcaccgggctgcaggcctccgcgccccacctcgacaaggtgaacggcatcagcgagctggagaacgagaaggtctacgacgacggcgccccggagtgcgggatcacgtgctggttcaagaagtccggcgagtgggtgatggggatcatcaacggcaactgggtggtcctgatcgtgctctgcgtgctgctcctgttcagcctgatcctgctcagcatcctgtgccccgtccggaagcacaagaagtcctga

SEQ ID NO: 11858 - RNA, 3402 nt, synthetic construct
  misc_feature 1..3402: note = derived and/or modified CDS sequence (opt1) from SEOV(KI-85-1)__D17593.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtgcccctgtggacggacaacgcccacggcgtgggctccgtcccgatgcacaccgacctcgagctggacttcagcctgccctccagctccaagtacacctacaagcgccacctcaccaaccccgtgaacgaccagcagagcgtgtccctgcacatcgagatcgagagccaggggatcggcgccgacgtccaccacctggggcactggtacgacgcccgcctcaacctgaagacgtccttccactgctacggcgcgtgcgccaagtaccagtacccgtggcacaccgccaagtgccacttcgagaaggactacgagtacgagaacagctgggcctgcaacccgcccgactgccccggcgtggggaccggctgcaccgcgtgcgggctgtacctcgaccagctgaagcccgtgggcacggccttcaagatcatctccgtccggtacagccgcaaggtgtgcgtgcagttcggggaggagtacctgtgcaagaccatcgacatgaacgactgcttcgtcacccggcacgccaagatctgcatcatcggcaccgtgagcaagttctcccagggcgacacgctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctcgccaccatcgacagcttccagtccttcaacaccagcaacatccacttcaccgacgagcggatcgagtggcgcgacccggacggcatgctgcgggaccacatcaacatcgtgatctccaaggacatcgacttcgagaacctggcggagaacccctgcaaggtcgggctccaggccgccaacatcgagggcgcctggggcagcggggtgggcttcacgctgacctgccaggtgtccctgaccgagtgccccaccttcctcacgagcatcaaggcctgcgacatggcgatctgctacggggccgagtccgtcaccctgagccgcggccagaacaccgtgaagatcaccgggaagggcggccactccgggagctccttcaagtgctgccacggcaaggagtgcagctccacggggctgcaggccagcgcgccccacctcgacaaggtgaacggcatctccgagctggagaacgagaaggtctacgacgacggcgccccggagtgcgggatcacgtgctggttcaagaagtccggcgagtgggtgatggggatcatcaacggcaactgggtggtcctgatcgtgctctgcgtgctgctcctgttcagcttcatcctgctgagcatcctctgccccgtccggaagcacaagaagtcctga

SEQ ID NO: 11859 - RNA, 3402 nt, synthetic construct
  misc_feature 1..3402: note = derived and/or modified CDS sequence (opt1) from SEOV(KI-88-15)__D17594.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgagatcgtggagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgccccggcgggggaggacttccgggccatggaggtgttctccggcatcatcaccagcccccacggggaggaccacgacctccccggcgaggagatcgccacctaccagatctccggccagatcgaggccaagatcccccacacggtgagctccaagaacctgaagctgaccgccttcgcggggatcccgagctactccagcacctccatcctcgccgccagcgaggacggccgcttcatcttctcccccgggctgttccccaacctgaaccagagcgtctgcgacaacaacgccctccccctgatctggcggggcctgatcgacctcaccgggtactacgaggccgtgcacccgtgcaacgtgttctgcgtcctgtccggccccggcgcgagctgcgaggccttctccgagggcgggatcttcaacatcacgagccccatgtgcctggtgtccaagcagaaccgcttccgggccgccgagcagcagatcagcttcgtctgccagcgcgtggacatggacatcatcgtgtactgcaacgggcagaagaagaccatcctcaccaagaccctggtcatcggccagtgcatctacacgatcacctccctgttcagcctcctgcccggggtggcccacagcatcgcgatcgagctgtgcgtgccgggcttccacggctgggccaccgccgccctcctgatcaccttctgcttcgggtgggtcctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacgcactgcgagcccaccgagaccgcgatccaggcccactacaaggtgtgccaggccacccaccggttccgcgaggacctcaagaagacggtgaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggacggacaacgcccacggcgtgggctccgtgccgatgcacaccgacctcgagctggacttcagcctgccctccagctccaagtacacctacaagcgccacctcaccaaccccgtcaacgaccagcagagcgtgtccctgcacatcgagatcgagagccaggggatcggcgccgacgtgcaccacctggggcactggtacgacgcccgcctcaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtcgggaccggctgcacggcctgcgggctgtacctcgaccagctgaagcccgtgggcaccgcgttcaagatcatctccgtgcggtacagccgcaaggtctgcgtgcagttcggggaggagtacctgtgcaagaccatcgacatgaacgactgcttcgtgacccggcacgccaagatctgcatcatcggcacggtcagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatctccgggtacaagaaggtcctcgccaccatcgacagcttccagtccttcaacaccagcaacatccacttcacggacgagcggatcgagtggcgcgacccggacggcatgctgcgggaccacatcaacatcgtgatctccaaggacatcgacttcgagaacctggccgagaacccctgcaaggtggggctccaggcggccaacatcgagggcgcctggggcagcggggtcggcttcaccctgacctgccaggtgtccctgaccgagtgccccacgttcctcaccagcatcaaggcctgcgacatggccatctgctacggggcggagtccgtgaccctgagccgcggccagaacaccgtcaagatcacggggaagggcggccactccgggagctccttcaagtgctgccacggcaaggagtgcagctccaccgggctgcaggccagcgcgccccacctcgacaaggtgaacggcatctccgagctgaagaacgagaaggtgtacgacgacggcgccccggagtgcgggatcacgtgctggttcaagaagtccggcgagtgggtcatggggatcatcaacggcaactgggtggtgctgatcgtcctctgcgtgctgctcctgttcagcttcatcctgctgagcatcctctgccccgtgcggaagcacaagaagtcctga

SEQ ID NO: 11860 - RNA, 3402 nt, synthetic construct
  misc_feature 1..3402: note = derived and/or modified CDS sequence (opt1) from SEOV(LongwanRn581)__GU592930.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtgcccctgtggacggacaacgcccacggcgtgggctccgtcccgatgcacaccgacctcgagctggacttcagcctgccctccagctccaagtacacctacaagcgccacctcaccaaccccgtgaacgaccagcagagcgtgtccctgcacatcgagatcgagagccaggggatcggcgccgacgtccaccacctggggcactggtacgacgcccgcctcaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctcgaccagctgaagcccgtgggcaccgcgttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctcgccaccatcgacagcttccagtccttcaacaccagcaacatccacttcacggacgagcggatcgagtggcgcgacccggacggcatgctgcgggaccacatcaacatcgtgatctccaaggacatcgacttcgagaacctggccgagaacccctgcaaggtcgggctccaggcggccaacatcgagggcgcctggggcagcggggtgggcttcaccctgacctgccaggtgtccctgaccgagtgccccacgttcctcaccagcatcaaggcctgcgacatggccatctgctacggggcggagtccgtcaccctgagccgcggccagaacaccgtgaagatcacggggaagggcggccactccgggagctccttcaagtgctgccacggcaaggagtgcagctccaccgggctgcaggccaacgcgccccacctcgacaaggtgaacggcatcagcgagctggagaacgagaaggtctacgacgacggcgccccggagtgcggggtgacctgctggttcaagaagtccggcgagtgggtgatggggatcatcaacggcaactgggtcgtgctgatcgtgctctgcgtcctgctcctgttcagcctgatcctgctcagcatcctgtgccccgtgcggaagcacaagaagtcctga

SEQ ID NO: 11861 - RNA, 3402 nt, synthetic construct
  misc_feature 1..3402: note = derived and/or modified CDS sequence (opt1) from SEOV(RuianRn180)__GU592931.1__GP
  source 1..3402: mol_type = other RNA
atgtggagcctgctcatcgtggccgccctggtcggccaggggttcgccctgaagaacgtgttcgacatgcgcatccagtgcccccacagcgtgaacttcggcgagaccagcgtctccgggtacaccgagctcccgcccctgagcctgcaggaggccgagcagctcgtgcccgagtccagctgcaacatggacaaccaccagtccctgagcacgatcaacaagctgaccaaggtgatctggcggaagaaggccaaccaggagtccgccaaccagaacagcttcgaggtcgtggagtccgaggtgagcttcaagggcctctgcatgctgaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctcatcgggctgggcccctaccgcatccaggtggtgtacgagcggacgtactgcaccaccggcatcctgaccgaggggaagtgcttcgtccccgacaaggccgtggtgagcgccctcaagcgcggcatgtacgccatcgcgagcatcgagacgatctgcttcttcatccaccagaaggggaacacctacaagatcgtcaccgccatcacctccgccatgggcagcaagtgcaacaacacggacaccaaggtgcaggggtactacatctgcatcatcggcggcaacagcgcccccgtgtacgccccggcgggggaggacttccgggccatggaggtcttctccggcatcatcaccagcccccacggggaggaccacgacctgcccggcgaggagatcgccacctaccagatctccggccagatcgaggccaagatcccccacacggtgagctccaagaacctgaagctcaccgccttcgcggggatcccgagctactccagcacctccatcctggccgccagcgaggacggccgcttcatcttctcccccgggctgttccccaacctcaaccagagcgtgtgcgacaacaacgccctgcccctgatctggcggggcctcatcgacctgaccgggtactacgaggccgtccacccgtgcaacgtgttctgcgtcctgtccggccccggcgcgagctgcgaggccttctccgagggcgggatcttcaacatcacgagccccatgtgcctcgtgtccaagcagaaccgcttccgggccgccgagcagcagatcagcttcatctgccagcgcgtggacatggacatcatcgtctactgcaacgggcagaagaagaccatcctgaccaagaccctggtgatcggccagtgcatctacacgatcacctccctcttcagcctgctgcccggggtggcccacagcatcgcgatcgagctctgcgtcccgggcttccacggctgggccaccgccgccctgctgatcaccttctgcttcgggtgggtgctcatccccgcgtgcacgctggccatcctgctcgtgctgaagttcttcgccaacatcctgcacacctccaaccaggagaaccggttcaaggccatcctccgcaagatcaaggaggagttcgagaagaccaagggcagcatggtctgcgagatctgcaagtacgagtgcgagaccctgaaggagctgaaggcccacaacctctcctgcgtgcagggggagtgcccctactgcttcacgcactgcgagcccaccgagaccgcgatccaggcccactacaaggtgtgccaggccacccaccggttccgcgaggacctgaagaagacggtcaccccgcagaacatcggccccgggtgctaccggaccctgaacctcttccgctacaagagccggtgctacatcctgaccatgtggaccctgctgctcatcatcgagtccatcctgtgggccgccagcgcggccgagatccccctggtgcccctctggacggacaacgcccacggcgtgggctccgtcccgatgcacaccgacctggagctggacttcagcctcccctccagctccaagtacacctacaagcgccacctgaccaaccccgtgaacgaccagcagagcgtgtccctgcacatcgagatcgagagccaggggatcggcgccgacgtccaccacctcgggcactggtacgacgcccgcctgaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctctacctggaccagctgaagcccgtgggcaccgcgttcaagatcatctccgtccggtacagccgcaaggtgtgcgtgcagttcggggaggagtacctctgcaagaccatcgacatgaacgactgcttcgtcacccggcacgccaagatctgcatcatcggcacggtgagcaagttctcccagggcgacaccctgctgttcctcgggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacaccagcaacatccacttcacggacgagcggatcgagtggcgcgacccggacggcatgctgcgggaccacatcaacatcgtgatctccaaggacatcgacttcgagaacctcgccgagaacccctgcaaggtcgggctgcaggcggccaacatcgagggcgcctggggcagcggggtgggcttcaccctgacctgccaggtgtccctcaccgagtgccccacgttcctgaccagcatcaaggcctgcgacatggccatctgctacggggcggagtccgtcaccctgagccgcggccagaacaccgtgaagatcacggggaagggcggccactccgggagctccttcaagtgctgccacggcaaggagtgcagctccaccgggctccaggccagcgcgccccacctggacaaggtgaacggcatctccgagctggagaacgagaaggtctacgacgacggcgccccggagtgcggggtgacctgctggttcaagaagtccggcgagtgggtgatggggatcatcaacggcaactgggtcgtgctcatcgtgctgtgcgtcctgctcctgttcagcctgatcctcctgagcatcctgtgccccgtgcggaagcacaagaagtcctga

SEQ ID NO: 11862 - RNA, 3402 nt, synthetic construct
  misc_feature 1..3402: note = derived and/or modified CDS sequence (opt1) from SEOV(ShuangyangRn470)__GU592925.1__GP
  source 1..3402: mol_type = other RNA
atgtggagcctcctcttcctggccgccctggtgggccaggggttcgccctcaagaacgtcttcgacatgcgcatccagtgcccccactccgtgaacttcggcgagaccagcgtgtccgggtacaccgagctgccgcccctgagcctccaggagtccgagcagctggtccccgagagctcctgcaacatggacaaccaccagagcctgtccacgatcaacaagctcaccaaggtgatctggcggaagaaggccaaccaggagagcgccaaccagaactccttcgaggtggtcgagagcgaggtgtccttcaagggcctgtgcatgctgaagcaccgcatggtggaggagagctaccggaaccgccggtccgtcatctgctacgacctcgcctgcaacagcaccttctgcaagcccaccgtgtacatgatcgtgccgatccacgcctgcaacatgatgaagtcctgcctgatcgggctgggcccctaccgcatccaggtcgtgtacgagcggacgtactgcaccaccggcatcctcaccgaggggaagtgcttcgtgcccgacaaggcggtcgtgagcgccctgaagcgcggcatgtacgccatcgcctccatcgagacgatctgcttcttcatccaccagaaggggaacacctacaagatcgtgaccgcgatcaccagcgccatgggcagcaagtgcaacaacacggacaccaaggtccaggggtactacatctgcatcatcggcggcaactccgcccccgtgtacgccccggccggggaggacttccgggcgatggaggtgttcagcggcatcatcaccagcccccacggggaggaccacgacctgcccggcgaggagatcgccacctaccagatcagcggccagatcgaggccaagatcccccacacggtctccagcaagaacctcaagctgaccgccttcgccgggatcccgtcctacagctccaccagcatcctggcggcctccgaggacggccgcttcatcttcagccccgggctgttccccaacctgaaccagtccgtgtgcaacaacaacgccctgcccctcatctggcggggcctgatcgacctgaccgggtactacgaggccgtgcacccgtgcaacgtcttctgcgtgctcagcggccccggcgcctcctgcgaggcgttcagcgagggcgggatcttcaacatcacgtcccccatgtgcctggtcagcaagcagaaccgcttccgggccgccgagcagcagatctccttcgtgtgccagcgcgtggacatggacatcatcgtctactgcaacgggcagaagaagaccatcctgaccaagaccctcgtgatcggccagtgcatctacacgatcaccagcctgttcagcctgctccccggggtggcccactccatcgccatcgagctgtgcgtcccgggcttccacggctgggcgaccgccgccctgctcatcaccttctgcttcgggtgggtgctgatccccgcctgcacgctggcgatcctcctggtgctgaagttcttcgccaacatcctccacaccagcaaccaggagaaccggttcaaggccatcctgcgcaagatcaaggaggagttcgagaagaccaagggctccatggtctgcgagatctgcaagtacgagtgcgagaccctgaaggagctcaaggcccacaacctgagctgcgtgcagggggagtgcccctactgcttcacgcactgcgagcccaccgagaccgccatccaggcgcactacaaggtgtgccaggccacccaccggttccgcgaggacctgaagaagacggtcaccccgcagaacatcggccccgggtgctaccggaccctcaacctgttccgctacaagtcccggtgctacatcctgaccatgtggaccctgctcctgatcgtggagagcatcctgtgggccgcctccgccgcggagatccccctcgtgcccctgtggacggacaacgcccacggcgtcggcagcgtgccgatgcacaccgacctggagctcgacttctccctgcccagctccagcaagtacacctacaagcgccacctgaccaaccccgtgaacgaccagcagtccgtcagcctccacatcgagatcgagtcccaggggatcggcgccgacgtgcaccacctggggcactggtacgacgcccgcctgaacctcaagacgagcttccactgctacggcgcctgcaccaagtaccagtacccgtggcacaccgcgaagtgccacttcgagaaggactacgagtacgagaactcctgggcctgcaacccgcccgactgccccggcgtggggaccggctgcacggcctgcgggctgtacctggaccagctcaagcccgtcggcaccgccttcaagatcatcagcgtgcggtacagccgcaaggtgtgcgtccagttcggggaggagtacctgtgcaagaccatcgacatgaacgactgcttcgtgacccggcacgcgaagatctgcatcatcggcacggtgtccaagttcagccagggcgacaccctcctcttcctggggcccatggagggcgggggcatcatcttcaagcactggtgcacctccacgtgccacttcggggaccccggcgacgtcatgggccccaaggacaagccgttcatctgccccgagttccccgggcagttccgcaagacctgcaacttcgccaccacccccgtgtgcgagtacgacggcaacatcatcagcgggtacaagaaggtgctggccaccatcgactccttccagagcttcaacacgtccaacatccacttcaccgacgagcggatcgagtggcgcgacccggacggcatgctccgggaccacatcaacatcgtcatcagcaaggacatcgacttcgagaacctggccgagaacccctgcaaggtggggctgcaggccgcgaacatcgagggcgcctggggctccggggtgggcttcaccctgacctgccaggtcagcctgacggagtgccccaccttcctgacctccatcaaggcctgcgacatggccatctgctacggggccgagagcgtgaccctctcccgcggccagaacacggtgaagatcaccgggaagggcggccacagcgggtccagcttcaagtgctgccacggcaaggagtgctccagcaccgggctgcaggcgtccgcgccccacctggacaaggtcaacggcatcagcgagctcgagaacgagaaggtgtacgacgacggcgccccggagtgcggggtgacctgctggttcaagaagtccggcgagtgggtcatggggatcatcaacggcaactgggtggtgctgatcgtcctgtgcgtgctcctgctgttctccctcatcctgctgagcatcctctgccccgtgcggaagcacaagaagtcctga

SEQ ID NO: 11863 - RNA, 3402 nt, synthetic construct
  misc_feature 1..3402: note = derived and/or modified CDS sequence (opt1) from SEOV(WuhanMm13)__JQ665886.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagacgctcaaggagctgaaggcccacaacctgtcctgcgtgcagggggagtgcccctactgcttcacccactgcgagcccaccgagaccgcgatccaggcccactacaaggtgtgccaggccacgcaccggttccgcgaggacctcaagaagaccgtcaccccgcagaacatcggccccgggtgctaccggaccctgaacctgttccgctacaagagccggtgctacatcctgaccatgtggacgatcctcctgatcatcgagtccatcctgtgggccgccagcgcggccgagatccccctcgtgcccctgtggaccgacaacgcccacggcgtgggctccgtcccgatgcacaccgacctggagctcgacttcagcctgccctccagctccaagtacacctacaagcgccacctgacgaaccccgtgaacgaccagcagagcgtgtccctccacatcgagatcgagagccaggggatcggcgccgacgtccaccacctggggcactggtacgacgcccgcctgaacctcaagacctccttccactgctacggcgcgtgcaccaagtaccagtacccgtggcacaccgccaagtgccacttcgagaaggactacgagtacgagaacagctgggcctgcaacccgcccgactgccccggcgtggggacgggctgcaccgcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacgcggcacgccaagatctgcatcatcggcaccgtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacacgagcaacatccacttcaccgacgagcggatcgagtggcgcgacccggacggcatgctccgggaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgacggagtgccccaccttcctgaccagcatcaaggcctgcgacatggccatctgctacggggcggagtccgtcaccctcagccgcggccagaacacggtgaagatcaccgggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcgggatcacgtgctggttcaagaagtccggcgagtgggtgatggggatcatcaacggcaactgggtggtcctgatcgccctgtgcgtgctcctgctgttcagcctcatcctgctgagcatcctctgccccgtgcggaagcacaagaagtcctga

SEQ ID NO: 11864 - RNA, 3402 nt, synthetic construct
  misc_feature 1..3402: note = derived and/or modified CDS sequence (opt1) from SEOV(WuhanMm24)__JQ665887.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatggagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtgcaggggtactacatctgcatcatcggcggcaacagcgcccccgtctacgccccggcgggggaggacttccgggccatggaggtgttctccggcatcatcaccagcccccacggggaggaccacgacctccccggcgaggagatcgccacctaccagatctccggccagatcgaggccaagatcccccacacggtgagctccaagaacctgaagctgaccgccttcgcggggatcccgagctactccagcacctccatcctcgccgccagcgaggacggccgcttcatcttctcccccgggctgttccccaacctgaaccagagcgtctgcgacaacaacgccctccccctgatctggcggggcctgatcgacctcaccgggtactacgaggccgtgcacccgtgcaacgtgttctgcgtcctgtccggccccggcgcgagctgcgaggccttctccgagggcgggatcttcaacatcacgagccccatgtgcctggtgtccaagcagaaccgcttccgggccgccgagcagcagatcagcttcgtctgccagcgcgtggacatggacatcatcgtgtactgcaacgggcagaagaagaccatcctcaccaagaccctggtcatcggccagtgcatctacacgatcacctccctgttcagcctcctgcccggggtggcccacagcatcgcgatcgagctgtgcgtgccgggcttccacggctgggccaccgccgccctcctgatcaccttctgcttcgggtgggtcctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacgcactgcgagcccaccgagaccgcgatccaggcccactacaaggtgtgccaggccacccaccggttccgcgaggacctcaagaagacggtgaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggacggacaacgcccacggcgtgggctccgtgccgatgcacaccgacctcgagctggacttcagcctgccctccagctcccgctacacctacaagcgccacctcaccaaccccgtcaacgaccagcagagcgtgtccctgcacatcgagatcgagagccaggggatcggcgccgacgtgcaccacctggggcactggtacgacgcccggctcaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtcgggaccggctgcacggcctgcgggctgtacctcgaccagctgaagcccgtgggcaccgcgttcaagatcatctccgtgcgctacagccggaaggtctgcgtgcagttcggggaggagtacctgtgcaagaccatcgacatgaacgactgcttcgtgacccgccacgccaagatctgcatcatcggcacggtcagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccacctcccccgtgtgcgagtacgacggcaacatcatcagcgggtacaagaaggtcctcgccaccatcgactccttccagagcttcaacacctccaacatccacttcaccgacgagcgcatcgagtggcgggacccggacggcatgctgcgcgaccacatcaacatcgtgatcagcaaggacatcgacttcgagaacctggccgagaacccctgcaaggtggggctccaggcggccaacatcgagggcgcctggggctccggggtcggcttcacgctgacctgccaggtgagcctgaccgagtgccccaccttcctcacgtccatcaaggcctgcgacatggccatctgctacggggcggagagcgtgaccctgtcccggggccagaacaccgtcaagatcaccgggaagggcggccacagcgggtccagcttcaagtgctgccacggcaaggagtgctccctgacggggctccaggccagcgcgccccacctggacaaggtgaacggcatctccgagctggagaacgagaaggtgtacgacgacggcgccccggagtgcgggatcacgtgctggttcaagaagtccggcgagtgggtcatggggatcatcaacggcaactgggtggtgctcatcgccctgtgcgtcctgctcctgttcagcctgatcctcctgagcatcctgtgccccgtgcgcaagcacaagaagtcctga

SEQ ID NO: 11865 - RNA, 3402 nt, synthetic construct
  misc_feature 1..3402: note = derived and/or modified CDS sequence (opt1) from SEOV(WuhanRf02)__JQ665888.1__GP
  source 1..3402: mol_type = other RNA
atgtggagcctgctcctgctggccgccctcgtgggccaggggttcgcgctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcgcatcagcttcgtgtgccagcgggtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccgcttcaaggccatcctgcggaagatcaaggaggagttcgagaagaccaagggcagcgtcgtgtgcgagatctgcaagtacgagtgcgagacgctcaaggagctgaaggcccacaacctgtcctgcgtgcagggggagtgcccctactgcttcacccactgcgagcccaccgagaccgcgatccaggcccactacaaggtctgccaggccacgcaccgcttccgggaggacctcaagaagaccgtgaccccgcagaacatcggccccgggtgctaccgcaccctgaacctgttccggtacaacagccgccccgacggcctgaccatgtggacgctcctgctgatcatcgagtccatcctctgggccgccagcgcggccgagatccccctggtgccgctgtgggccgacaacgcccacggcgtcgggtccgtgcccatgcacaccgacctcgagctggacttcagcctgccctccagctccaagtacacctacaagcgccacctcaccaacccggtgaacgaccagcagagcgtctccctgcacatcgagatcgagagccagggcatcggggccgacgtgcaccacctgggccactggtacgacgcgcggctcaacctgaagacgtccttccactgctacggcgcctgcaccaagtaccagtacccctggcacaccgccaagtgccacttcgagaaggactacgagtacgagaacagctgggcctgcaacccgcccgactgccccggggtgggcaccgggtgcacggcgtgcggcctgtacctcgaccagctgaagcccgtcgggaccgccttcaagatcatctccgtgcgctacagccggaaggtgtgcgtccagttcggcgaggagtacctgtgcaagaccatcgacatgaacgactgcttcgtgacccgccacgccaagatctgcatcatcggcacggtgcccaagttcagccagggggacaccctcctgttcctgggccccatggagggcggcgggatcatcttcaagcactggtgcacctccacgtgccacttcggggacccgggcgacgtcatggggcccaaggacaagcccttcatccggcccgagttcccgggccagttccgcaagaagtgcaacttcgccaccacccccgtgtgcgggtacgacggcaacatcatcagcgggtacaagaaggtgctcgccaccatcgactccttccagagcttcaacacctccaacatccacttcacggacgagcggatcgagtggcgcgaccccgacggcatgctgcgggaccacatcaacatcgtcatcagcaaggacatcgacttcgagaacctggcggagaacccctgcaaggtgggcctccaggccgccaacatcgagggggcctggggctccggggtgggcttcaccctgacctgccaggtcagcctgaccgagtgcccgacgttcctcacctccatcaaggcctgcgacatggcgatctgctacggggccgagagcgtgaccctgtcccgcggccagaacaccgtgaagatcacgggcaagggcgggcacagcgggtccagcttcaagtgctgccacggcaaggagtgctccagcaccggcctgcaggcctccgcgccccacctcgacaaggtcaacgggatcagcgagctggagaacgagaaggtgtacgacgacggcgcccccgagtgcgggatcacgtgctggttcaagaagtccggcgagtgggtgatggggatcatcaacggcaactgggtcgtgctgatcgccctctgcgtgctgctcctgttcagcctgatcctgctcagcatcctgtgccccgtccggaagcacaagaagtcctga

SEQ ID NO: 11866 - RNA, 3402 nt, synthetic construct
  misc_feature 1..3402: note = derived and/or modified CDS sequence (opt1) from SEOV(WuhanRf07)__JQ665889.1__GP
  source 1..3402: mol_type = other RNA
atgtggagcctgctcctgctggccgccctcgtgggccaggggttcgcgctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagacgctcaaggagctgaaggcccacaacctgtcctgcgtgcagggggagtgcccctactgcttcacccactgcgagcccaccgagaccgcgatccaggcccactacaaggtgtgccaggccacgcaccggttccgcgaggacctcaagaagaccgtcaccccgcagaacatcggccccgggtgctaccggaccctgaacctgttccgctacaagagccggccctacatcctgaccatgtggacgatcctcctgatcatcgagtccatcctgtgggccgccagcgcggccgagatccccctcgtgccgctgtggaccgacaacgcccacggcgtgggctccgtccccatgcacaccgacctggagctcgacttcagcctgccctccagctccaagtacacctacaagcgccacctgacgaacccggtgaacgaccagcagagcgtgtccctccacatcgagatcgagagccaggggatcggcgccgacgtccaccacctggggcactggtacgacgcccgcctgaacctcaagacctccttccactgctacggcgcgtgcaccaagtaccagtacccctggcacaccgccaagtgccacttcgagaaggactacgagtacgagaacagctgggcctgcaacccgcccgactgccccggcgtggggacgggctgcaccgcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacgcggcacgccaagatctgcatcatcggcaccgtgagcaagttctcccagggcgacaccctcctcttcctggggcccatggagggcgggggcatcatcttcaagcactggtgcaccagcacgtgccacttcggggaccccggcgacgtgatgggcccgaaggacaagcccttcatctgccccgagttccccgggcagttccgcaagaagtgcaacttcgccaccaccccggtctgcgagtacgacggcaacatcatctccgggtacaagaaggtgctggccaccatcgacagcttccagtccttcaacacgagcaacatccacttcaccgacgagcggatcgagtggcgcgaccccgacggcatgctccgggaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgacggagtgccccaccttcctgaccagcatcaaggcctgcgacatggccatctgctacggggcggagtccgtcaccctcagccgcggccagaacacggtgaagatcaccgggaagggcggccactccgggagctccttcaagtgctgccacggcaaggagtgcagctccaccgggctgcaggccagcgccccgcacctggacaaggtgaacggcatctccgagctcgagaacgagaaggtctacgacgacggcgcccccgagtgcgggatcacgtgctggttcaagaagtccggcgagtgggtgatggggatcatcaacggcaactgggtggtcctgatcgccctgtgcgtgctcctgctgttcagcctcatcctgctgagcatcctctgccccgtgcggaagcacaagaagtcctga

SEQ ID NO: 11867 - RNA, 3402 nt, synthetic construct
  misc_feature 1..3402: note = derived and/or modified CDS sequence (opt1) from SEOV(WuhanRf18)__JQ665893.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcgcatcagcttcgtgtgccagcgggtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccgcttcaaggccatcctgcggaagatcaaggaggagttcgagaagaccaagggcagcatggtctgcgagatctgcaagtacgagtgcgagacgctcaaggagctgaaggcccacaacctgtcctgcgtgcagggggagtgcccctactgcttcacccactgcgagcccaccgagaccgcgatccaggcccactacaaggtgtgccaggccacgcaccgcttccgggaggacctcaagaagaccgtcaccccgcagaacatcggccccgggtgctaccgcaccctgaacctgttccggtacaagagccgctgctacatcctgaccatgtggacgatcctcctgatcatcgagtccatcctgtgggccgccagcgcggccgagatccccctcgtgcccctgtggaccgacaacgcccacggcgtgggctccgtcccgatgcacaccgacctggagctcgacttcagcctgccctccagctccaagtacacctacaagcgccacctgacgaaccccgtgaacgaccagcagagcgtgtccctccacatcgagatcgagagccaggggatcggcgccgacgtccaccacctggggcactggtacgacgcccggctgaacctcaagacctccttccactgctacggcgcgtgcaccaagtaccagtacccgtggcacaccgccaagtgccacttcgagaaggactacgagtacgagaacagctgggcctgcaacccgcccgactgccccggcgtggggacgggctgcaccgcctgcgggctgtacctggaccagctcaagcccgtgggcaccgcgttcaagatcatctccgtccgctacagccggaaggtgtgcgtgcagttcggggaggagtacctgtgcaagaccatcgacatgaacgactgcttcgtcacgcgccacgccaagatctgcatcatcggcaccgtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacacgagcaacatccacttcaccgacgagcgcatcgagtggcgggacccggacggcatgctccgcgaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgacggagtgccccaccttcctgaccagcatcaaggcctgcgacatggccatctgctacggggcggagtccgtcaccctcagccggggccagaacacggtgaagatcaccgggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcgggatcacgtgctggttcaagaagtccggcgagtgggtgatggggatcatcaacggcaactgggtggtcctgatcgccctgtgcgtgctcctgctgttcagcctcatcctgctgagcatcctctgccccgtgcgcaagcacaagaagtcctga

SEQ ID NO: 11868 - RNA, 3402 nt, synthetic construct
  misc_feature 1..3402: note = derived and/or modified CDS sequence (opt1) from SEOV(WuhanRn10)__JQ665896.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccggttcaaggccatcctgcgcaagatcaaggaggagttcgagaagaacaagggcagcgtcgtgtgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtctgccaggccacccaccggttccgcgaggacctcaagaagacggtgaccccgcagaacatcggccccgggtgctaccggaccctgaacctgttccgctacaagagccggtgctacatcctgaccatgtggaccatcctcctgatcatcgagtccatcctgtgggccgccagcgcggccgagatccccctcgtgcccctgtggacggacaacgcccacggcgtcggctccgtgccgatgcacaccgacctggagctcgacttcagcctgccctccagctccaagtacacctacaagcgccacctgaccaaccccgtgaacgaccagcagagcgtctccctccacatcgagatcgagagccaggggatcggcgccgacgtgcaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtcggcaccgcgttcaagatcatctccgtgcggtacagccgcaaggtgtgcgtccagttcggggaggagtacctgtgcaagaccatcgacatgaacgactgcttcgtgacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtcatgggccccaaggacaagccgttcatctgccccgagttccccgggcagttccgcaagaagtgcaacttcgccaccacccccgtgtgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtcatctccaaggacatcgacttcgagaacctggccgagaacccctgcaaggtggggctgcaggcggccaacatcgagggcgcctggggcagcggggtgggcttcaccctgacctgccaggtctccctgaccgagtgccccacgttcctgaccagcatcaaggcctgcgacatggccatctgctacggggcggagtccgtgaccctcagccgcggccagaacaccgtgaagatcacggggaagggcggccactccgggagctccttcaagtgctgccacggcaaggagtgcagctccaccgggctgcaggccagcgcgccccacctggacaaggtcaacggcatctccgagctcgagaacgagaaggtgtacgacgacggcgccccggagtgcgggatcacgtgctggttcaagaagtccggcgagtgggtgatggggatcatcaacggcaactgggtcgtgctgatcgccctgtgcgtgctcctgctgttcagcctcatcctgctgagcatcctctgccccgtccggaagcacaagaagtcctga

SEQ ID NO: 11869 - RNA, 3402 nt, synthetic construct
  misc_feature 1..3402: note = derived and/or modified CDS sequence (opt1) from SEOV(WuhanRn25)__JQ665897.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtgatcgagtccgaggtcagcttcaagggcctgtgcatgctcaagcaccgcatggtggaggagtcctaccggaaccgccggagcgtgatctgctacgacctggcctgcaactccaccttctgcaagcccaccgtctacatgatcgtgccgatccacgcgtgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgccgtggcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgaccacgttctgcttcgggtgggtgctgatccccgcgtgcaccctcgccatcctgctggtgctcaagttcttcgccaacatcctgcacacctccaaccaggagaaccggttcaaggccatcctgcgcaagatcaaggaggagttcgagaagaacaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccatcctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccgcctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccggtacagccgcaaggtgtgcgtgcagttcggggaggagtacctgtgcaagaccatcgacatgaacgactgcttcgtcacccggcacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctggccaccatcgacagcttccagtccttcaacaccagcaacatccacttcacggacgagcggatcgagtggcgcgacccggacggcatgctccgggaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgaccgagtgccccacgttcctgaccagcatcaaggcctgcgacatggccatctgctacggggcggagtccgtcaccctcagccgcggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcgggatcacgtgctggttcaagaagtccggcgagtgggtgatggggatcatcaacggcaactgggtggtcctgatcgccctgtgcgtgctcctgctgttcagcctcatcctgctgagcatcctctgccccgtgcggaagcacaagaagtcctga

SEQ ID NO: 11870 - RNA, 3402 nt, synthetic construct
  misc_feature 1..3402: note = derived and/or modified CDS sequence (opt1) from SEOV(XiaotangshanRn7)__GU592929.1__GP
  source 1..3402: mol_type = other RNA
atgtggagcctcctcttcctggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggccgagcagctggtccccgagtccagctgcaacatggacaaccaccagtccctgagcacgatcaacaagctcaccaaggtgatctggcggcgcaaggccaaccaggagtccgccaaccagaacagcttcgaggtggtcgagtccgaggtgagcttcaagggcctgtgcatgctgaagcaccggatggtggaggagtcctaccgcaaccggcgcagcgtcatctgctacgacctcgcctgcaactccaccttctgcaagcccaccgtgtacatgatcgtgccgatccacgcgtgcaacatgatgaagtcctgcctgatcgggctgggcccctaccggatccaggtcgtgtacgagcgcacgtactgcaccaccggcatcctcaccgaggggaagtgcttcgtgcccgacaaggccgtcgtgagcgccctgaagcggggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgcgccatggaggtgttctccggcatcatcaccagcccccacggggaggaccacgacctgcccggcgaggagatcgccacctaccagatctccggccagatcgaggccaagatcccccacacggtcagctccaagaacctcaagctgaccgccttcgcggggatcccgagctactccagcacctccatcctggccgccagcgaggacggccggttcatcttctcccccgggctgttccccaacctgaaccagagcgtgtgcgacaacaacgccctgcccctcatctggcgcggcctgatcgacctgaccgggtactacgaggccgtgcacccgtgcaacgtcttctgcgtgctctccggccccggcgcgagctgcgaggccttctccgagggcgggatcttcaacatcacgagccccatgtgcctggtctccaagcagaaccggttccgcgccgccgagcagcagatcagcttcgtgtgccagcgggtggacatggacatcatcgtctactgcaacgggcagaagaagaccatcctgaccaagaccctcgtgatcggccagtgcatctacacgatcacctccctgttcagcctgctccccggggtggcccacagcatcgcgatcgagctgtgcgtcccgggcttccacggctgggccaccgccgccctgctcatcaccttctgcttcgggtgggtgctgatccccgcgtgcacgctggccatcctcctggtgctgaagttcttcgccaacatcctccacacctccaaccaggagaaccgcttcaaggccatcctgcggaagatcaaggaggagttcgagaagaccaagggcagcatggtctgcgagatctgcaagtacgagtgcgagaccctgaaggagctcaaggcccacaacctgtcctgcgtgcagggggagtgcccctactgcttcacgcactgcgagcccaccgagaccgcgatccaggcccactacaaggtgtgccaggccacccaccgcttccgggaggacctgaagaagacggtcaccccgcagaacatcggccccgggtgctaccgcaccctcaacctgttccggtacaagagccgctgctacatcctgaccatgtggaccctgctcctgatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgacgtccaccacctggggcactggtacgacgcccggctgaacctcaagacgtccttccactgctacggcgcgtgcaccaagtaccagtacccgtggcacaccgccaagtgccacttcgagaaggactacgagtacgagaacagctgggcctgcaacccgcccgactgccccggcgtggggaccggctgcacggcctgcgggctgtacctggaccagctcaagcccgtgggcaccgcgttcaagatcatctccgtccgctacagccggaaggtgtgcgtgcagttcggggaggagtacctgtgcaagaccatcgacatgaacgactgcttcgtcacccgccacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctggccaccatcgacagcttccagtccttcaacaccagcaacatccacttcacggacgagcgcatcgagtggcgggacccggacggcatgctccgcgaccacatcaacatcgtgatctccaaggacatcgacttcgagaacctggccgagaacccctgcaaggtcgggctgcaggcggccaacatcgagggcgcctggggcagcggggtgggcttcaccctgacctgccaggtgtccctgaccgagtgccccacgttcctgaccagcatcaaggcctgcgacatggccatctgctacggggcggagtccgtcaccctcagccggggccagaacaccgtgaagatcacggggaagggcggccactccgggagctccttcaagtgctgccacggcaaggagtgcagctccaccgggctgcaggccagcgcgccccacctggacaaggtgaacggcatctccgagctcgagaacgagaaggtctacgacgacggcgccccggagtgcggggtgacctgctggttcaagaagtccggcgagtgggtgatggggatcatcaacggcaactgggtcgtgctgatcgtgctgtgcgtcctcctgctgttcagcctcatcctgctgagcatcctctgccccgtgcgcaagcacaagaagtcctga

SEQ ID NO: 11871 - RNA, 3402 nt, synthetic construct
  misc_feature 1..3402: note = derived and/or modified CDS sequence (opt1) from SEOV(YongjiaRf45)__GU592926.1__GP
  source 1..3402: mol_type = other RNA
atgtggggcctgctcctgctggccgccatggtggggcagggcagcgccctcaagaacgtcttcgacatgaagatccagtgcccccactccgtgaacttcggggagaccagcgtgtccggctacaccgagctgccgcccctgcccctccaggaggccgagcagctggtccccgagagctcctgcaacatggacaaccaccagagcctgtccaccatcaacaagctcaccaaggtgatctggcgcaagaaggccaaccaggagagcgcctcccagaacagcttcgaggtggtcgagtccgaggtgagcttcaaggggctgtgcatgctgaagcaccggatggtggaggagtcctaccgcaaccggcgcagcgtcatctgctacgacctcgcctgcaacaccaccttctgcaagccgacggtgtacatgatcgtgcccatccacgcgtgcaacatgatgaagtcctgcctgatcggcctgggcccctaccggatccaggtcatctacgagcgcacctactgcagcaccgggatcctcaccgagggcaagtgcttcgtgcacgacaagacggtggtctccgccctgaagcgggggatgtacgccatcgccagcatcgagaccgtgtgcttcttcgtgcaccagaagggcaacacctacaagatcgtcaccgcgatcacgtccgccatggggagcaagtgcaacaacaccgacagcaaggtgcagggctactacatctgcatcatcggcgggaactccgcccccgtgtacgccccggccggcgaggacttccgcgcgatggaggtcttcagcgggatcatcaccagcccccacggcgaggaccacgacctgcccggcgaggaggtggccacctaccagatcagcgggcagatcgaggccaagatcccccacacggtgtccagcaagaacctcaagctgaccgccttcgccggcatcccgtcctacagctccaccagcctgctcgcggcctccgaggacgggcggttcatcttcagccccggcctgttccccaacctgaaccagtccgtctgcgacaacaacgccctccccctgatctggcgcgggctgatcgacctcaccggctactacgaggccgtgcacccgtgcaacgtcttctgcgtgctgagcggccccggggcctcctgcgaggcgttcagcgagggcgggatcttcaacatcacgtcccccatgtgcctggtgagcaagcagaaccggttccgcgccgccgagcagcagatctccttcatctgccagcgggtcgacatggacatcatcgtgtactgcaacggccagaagaagaccatcctcaccaagaccctggtgatcgggcagtgcatctacacgatcaccagcctgttcagcctcctgcccggcgtcgcccactccatcgccatcgagctgtgcgtgccgggcttccacgggtgggcgaccgccgccctcctgatcaccttctgcttcggctgggtgctgatccccgcctgcacgctcgcggtcctgctgttcctcaagttcttcgccaacatcctgcacaccagcaaccaggagaaccgcttcaaggccatcctgcggaagatcaaggaggagttcgagaagaccaaggggtccatggtgtgcgagatctgcaagtacgagtgcgagaccctcaaggagctgaaggcccacaacctgagctgcgtgcagggcgagtgcccctactgcttcacgcactgcgagcccaccgagaccgccatccaggcgcactacaaggtctgccaggccacccaccgcttccgggaggacctcaagaagacggtgaccccgcagaacatcgggcccggctgctaccgcaccctgaacctgttccggtacaagtcccgctgctacatcctgaccatgtggatcctcctgctggtgatcgagagcatcctctgggccgcctccgccgcggagatccccctggtccccctgtggaccgacaacgcccacggcgtggggagcgtgccgatgcacacggacctcgagctggacttctccctgcccagctccagcaagtacacctacaagcggcacctcaccaaccccgtcaacgaccagcagtccgtgagcctgcacatcgagatcgagtcccagggcatcggggccgacgtgcaccacctgggccactggtacgacgcccgcctcaacctgaagaccagcttccactgctacggcgcctgcacgaagtaccagtacccgtggcacaccgcgaagtgctacttcgagaaggactacgagtacgagaactcctgggcctgcaacccgcccgactgccccggggtcggcatcgggtgcaccgcctgcggcctgtacctcgaccagctgaagcccgtggggaccgccttcaagatcatcagcgtgcgctacagccggaaggtctgcgtgcagttcggcgaggagtacctgtgcaagacgatcgacatgaacgactgcttcgtgacccgccacgcgaagatctgcatcatcggcaccgtctccaagttcagccagggggacaccctcctgttcctgggccccatggagggcggcgggatcatcttcaagcactggtgcacgtccacgtgccacttcggggaccccggcgacgtgatggggcccaaggacaagccgttcatctgccccgagttccccggccagttccggaagaagtgcaacttcgccaccacccccgtgtgcgagtacgacgggaacgtcttcagcggctaccgcaagttcctcgccaccatcgactccttccagagcttcaacacctccaacgtgcacttcaccgacgagcggatcgagtggcgcgacccggacgggatgctgcgggaccacatcaacatcgtgatcagcaaggacatcgacttcgagaacctggccgacaacccctgcaaggtcggcctccaggccgcgaacatcgagggcgcctgggggtccggcgtggggttcaccctgacgtgccaggtgagcctgaccgagtgccccaccttcctcacctccatcaaggcctgcgacatggccatctgctacggcgccgagagcgtcacgctgtcccgcgggcagaacaccgtgaagatcaccggcaagggcgggcacagcggctccagcttcaagtgctgccacgggaaggagtgctccagcaacggcctgcaggcgtccgcgccccacctcgacaaggtgaacggcatcagcgagctggagaacgagaaggtctacgacgacggggccccggagtgcggcatcacgtgctggttcaagaagtccggggagtgggtgatgggcatcatcaacgggaactggatcgtgctgatcgtcctctgcgtgctgctcctgttctccctgatcctgctcagcatcctgtgccccgtgcggaagcacaagaagtcctga

SEQ ID NO: 11872 - RNA, 3402 nt, synthetic construct
  misc_feature 1..3402: note = derived and/or modified CDS sequence (opt1) from SEOV(YongjiaRn14)__GU592927.1__GP
  source 1..3402: mol_type = other RNA
atgtggggcctgctcctgctggccgccatggtggggcagggcagcgcgctcaagaacgtcttcgacatgaagatccagtgcccccacagcgtgaacttcggggagaccagcgtgtccggctacaccgagctgccgcccctgcccctccaggaggccgagcagctggtccccgagagctcctgcaacatggacaaccaccagagcctgtccacgatcaacaagctcaccaaggtgatctggcgcaagaaggccaaccaggagagcgcctcccagaacagcttcgaggtggtcgagtccgaggtgagcttcaaggggctgtgcatgctgaagcaccggatggtggaggagtcctaccgcaaccggcgcagcgtcatctgctacgacctcgcctgcaacaccaccttctgcaagccgacggtgtacatgatcgtgcccatccacgcgtgcaacatgatgaagtcctgcctgatcggcctgggcccctaccggatccaggtcatctacgagcgcacctactgcaccaccgggatcctcacggagggcaagtgcttcgtgcccgacaaggccgtggtcagcgccctgaagcgggggatgtacgccatcgcgtccatcgagaccgtgtgcttcttcgtgcaccagaagggcaacacctacaagatcgtcaccgccatcacgagcgccatggggtccaagtgcaacaacaccgacagcaaggtgcagggctactacatctgcatcatcggcgggaacagcgccccggtgtacgcccccgcgggcgaggacttccgcgccatggaggtcttctccgggatcatcaccagcccccacggcgaggaccacgacctgcccggcgaggaggtggccacctaccagatctccgggcagatcgaggccaagatcccgcacacggtgagctccaagaacctcaagctgaccgccttcgcgggcatccccagctactccagcacctccctgctcgccgccagcgaggacgggcggttcatcttctcccccggcctgttccccaacctgaaccagagcgtctgcgacaacaacgccctcccgctgatctggcgcgggctgatcgacctcaccggctactacgaggccgtgcacccctgcaacgtcttctgcgtgctgtccggccccggggcgagctgcgaggccttctccgagggcgggatcttcaacatcacgagccccatgtgcctggtgtccaagcagaaccggttccgcgccgccgagcagcagatcagcttcatctgccagcgggtcgacatggacatcatcgtgtactgcaacggccagaagaagaccatcctcaccaagaccctggtgatcgggcagtgcatctacacgatcacctccctgttcagcctcctgccgggcgtcgcccacagcatcgcgatcgagctgtgcgtgcccggcttccacgggtgggccaccgccgccctcctgatcaccttctgcttcggctgggtgctgatccccgcgtgcacgctcgccgtcctgctgttcctcaagttcttcgccaacatcctgcacacctccaaccaggagaaccgcttcaaggccatcctgcggaagatcaaggaggagttcgagaagaccaaggggagcatggtgtgcgagatctgcaagtacgagtgcgagaccctcaaggagctgaaggcccacaacctgtcctgcgtgcagggcgagtgcccctactgcttcacgcactgcgagccgaccgagaccgcgatccaggcccactacaaggtctgccaggccacccaccgcttccgggaggacctcaagaagacggtgacgccccagaacatcgggcccggctgctaccgcaccctgaacctgttccggtacaagagccgctgctacatcctgaccatgtggatcctcctgctggtgatcgagtccatcctctgggccgccagcgcggccgagatccccctggtcccgctgtggaccgacaacgcccacggcgtggggtccgtgcccatgcacaccgacctcgagctggacttcagcctgccctccagctccaagtacacctacaagcggcacctcaccaacccggtcaacgaccagcagagcgtgtccctgcacatcgagatcgagagccagggcatcggggccgacgtgcaccacctgggccactggtacgacgcccgcctcaacctgaagacctccttccactgctacggcgcgtgcacgaagtaccagtacccctggcacaccgccaagtgccacttcgagaaggactacgagtacgagaacagctgggcctgcaacccgcccgactgccccggggtcggcaccgggtgcaccgcctgcggcctgtacctcgaccagctgaagcccgtggggacggcgttcaagatcatctccgtgcgctacagccggaaggtctgcgtgcagttcggcgaggagtacctgtgcaagaccatcgacatgaacgactgcttcgtgacccgccacgccaagatctgcatcatcggcaccgtcagcaagttctcccagggggacacgctcctgttcctgggccccatggagggcggcgggatcatcttcaagcactggtgcaccagcacgtgccacttcggggaccccggcgacgtgatggggccgaaggacaagcccttcatctgccccgagttccccggccagttccggaagaagtgcaacttcgccaccaccccggtgtgcgagtacgacgggaacgtcatctccggctaccgcaaggtgctcgccaccatcgacagcttccagtccttcaacaccagcaacgtgcacttcaccgacgagcggatcgagtggcgcgaccccgacgggatgctgcgggaccacatcaacatcgtcatctccaaggacatcgacttcgagaacctggccgagaacccctgcaaggtgggcctccaggcggccaacatcgagggcgcctgggggagcggcgtggggttcacgctgacctgccaggtctccctgaccgagtgccccaccttcctcacgagcatcaaggcctgcgacatggccatctgctacggcgcggagtccgtgaccctgagccgcgggcagaacaccgtgaagatcaccggcaagggcgggcactccggcagctccttcaagtgctgccacgggaaggagtgcagctccaacggcctgcaggccagcgccccgcacctcgacaaggtcaacggcatctccgagctggagaacgagaaggtgtacgacgacggggcccccgagtgcggcatcacgtgctggttcaagaagtccggggagtgggtgatgggcatcatcaacgggaactggatcgtcctgatcgtgctctgcgtgctgctcctgttcagcctgatcctgctcagcatcctgtgccccgtccggaagcacaagaagtcctga

SEQ ID NO: 11873 - RNA, 3402 nt, synthetic construct
  misc_feature 1..3402: note = derived and/or modified CDS sequence (opt1) from SEOV(ZT10)__DQ159911.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacaagtacaagatcgtgaccgccatcacctccgccatgggcagcaagtgcaacaacaccgacacgaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacaccgtcagctccaagaacctgaagctgacggccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcaccagccccatgtgcctggtctccaagcagatccgcttccgggccgccgagcagcagatcagcttcatctgccagcgcgtggacatggacatcatcgtgtactgcaacgggcagaagaagacgatcctcaccaagaccctggtcatcggccagtgcatctacaccatcacgtccctgttcagcctcctgcccggggtggcccacagcatcgcgatcgagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgtccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacccactgcgagcccacggagaccgcgatccaggcccactacaaggtgtgccaggccacccaccggttccgcgaggacctcaagaagaccgtgacgccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggaccgacaacgcccacggcgtgggctccgtgccgatgcacacggacctcgagctggacttcagcctgccctccagctccaagtacacctacaagcgccacctcaccaaccccgtcaacgaccagcagagcgtgtccctgcacatcgagatcgagagccaggggatcggcgccgacgtgcaccacctggggcactgctacgacgcccgcctcaacctgaagacctccttccactgctacggcgcgtgcacgaagtaccagtacccgtggcacaccgccaagtgccacttcgagaaggactacgagtacgagaacagctgggcctgcaacccgcccgactgccccggcgtcgggaccggctgcaccgcctgcgggctgtacctcgaccagctgaagcccgtgggcacggcgttcaagatcatctccgtgcggtacagccgcaaggtctgcgtgcagttcggggaggagtacctgtgcaagaccatcgacatgaacgactgcttcgtgacccggcacgccaagatctgcatcatcggcaccgtcagcaagttctcccagggcgacacgctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatctccgggtacaagaaggtcctcgccaccatcgacagcttccagtccttcaacaccagcaacatccacttcaccgacgagcggatcgagtggcgcgacccggacggcatgctgcgggaccacatcaacatcgtgatctccaaggacatcgacttcgagaacctggccgagaacccctgcaaggtggggctccaggcggccaacatcgagggcgcctggggcctgggggtcggcttcacgctgacctgccaggtgagcctcaccgagtgccccaccttcctgacgtccatcaaggcctgcgacatggccatctgctacggggcggagagcgtgaccctgtcccgcggccagaacaccgtcaagatcaccgggaagggcggccacagcgggtccagcttcaagtgctgccacggcaaggagtgctccagcacggggctccaggcctccgcgccccacctggacaaggtgaacggcatcagcgagctggagaacgagaaggtgtacgacgacggcgccccggagtgcgggatcacgtgctggttcaagaagtccggcgagtgggtcatggggatcatcaacggcaactgggtggtgctcatcgtcctgtgcgtgctgctcctgttcagcctgatcctcctgagcatcctgtgccccgtgcggaagcacaagaagtcctga

SEQ ID NO: 11874 - RNA, 3402 nt, synthetic construct
  misc_feature 1..3402: note = derived and/or modified CDS sequence (opt1) from SEOV(ZT71)__EF117248.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctggccgaggggaagtgcttcgtgcccgacaaggccgtcgtgagcgccctgaagcgcggcatgtacgcgatcgccagcatcgagaccatctgcttcttcatccaccagaaggggaacaagtacaagatcgtgacggccatcacctccgccatgggcagcaagtgcaacaacaccgacaccaaggtccaggggtactacatctgcatcatcggcggcaacagcgcccccgtgtacgcgccggccggggaggacttccgggccatggaggtgttctccggcatcatcacgagcccccacggggaggaccacgacctccccggcgaggagatcgccacctaccagatctccggccagatcgaggccaagatcccccacaccgtcagctccaagaacctgaagctgaccgcgttcgccgggatcccgagctactccagcacgtccatcctcgccgccagcgaggacggccgcttcatcttctcccccgggctgttccccaacctgaaccagagcgtgtgcgacaacaacgccctccccctgatctggcggggcctgatcgacctcaccgggtactacgaggcggtgcacccgtgcaacgtcttctgcgtgctgtccggccccggcgccagctgcgaggccttctccgagggcgggatcttcaacatcaccagccccatgtgcctggtctccaagcagaaccgcttccgggccgccgagcagcagatcagcttcatctgccagcgcgtggacatggacatcatcgtgtactgcaacgggcagaagaagaccatcctcacgaagaccctggtcatcggccagtgcatctacaccatcacctccctgttcagcctcctgcccggggtggcgcacagcatcgccatcgagctgtgcgtgccgggcttccacggctgggccacggccgcgctcctgatcaccttctgcttcgggtgggtcctgatccccgcctgcaccctcgccatcctgctggtgctcaagttcttcgccaacatcctgcacacctccaaccaggagaaccggttcaaggccatcctgcgcaagatcaaggaggagttcgagaagacgaagggcagcatggtgtgcgagatctgcaagtacgagtgcgagaccctcaaggagctgaaggcgcacaacctgtcctgcgtccagggggagtgcccctactgcttcacccactgcgagcccaccgagacggccatccaggcccactacaaggtgtgccaggccacccaccggttccgcgaggacctcaagaagaccgtgaccccgcagaacatcggccccgggtgctaccggacgctgaacctgttccgctacaagagccggtgctacatcctgaccatgtggaccctcctgctgatcatcgagtccatcctctgggccgcgagcgccgccgagatccccctggtccccctgtggaccgacaacgcccacggcgtgggctccgtgccgatgcacaccgacctcgagctggacttcagcctgccctccagctccaagtacacgtacaagcgccacctcaccaaccccgtcaacgaccagcagagcgtgtccctgcacatcgagatcgagagccaggggatcggcgccgacgtgcaccacctggggcactggtacgacgcgggcctcaacctgaagacctccttccactgctacggcgcctgcaccaagtaccagtacccgtggcacacggccaagtgccacttcgagaaggactacgagtacgagaacagctgggcctgcaacccgcccgactgccccggggtcggcaccgggtgcaccgcgtgcggcctgtacctcgaccagctgaagcccgtggggaccgccttcaagatcatctccgtgcgctacagccggaaggtctgcgtgcagttcggcgaggagtacctgtgcaagacgatcgacatgaacgactgcttcgtgacccgccacgccaagatctgcatcatcggcaccgtcagcaagttctcccagggggacaccctcctgttcctgggccccatggagggcggcgggatcatcttcaagcactggtgcacgagcacgtgccacttcggggaccccggcgacgtgatggggcccaaggacaagccgttcatctgccccgagttccccggccagttccggaagaagtgcaacttcgccaccacccccgtgtgcgagtacgacgggaacatcatctccggctacaagaaggtcctcgccaccatcgacagcttccagtccttcaacaccagcaacatccacttcaccgacgagcgcatcgagtggcgggacccggacgggatgctgcgcgaccacatcaacatcgtgatctccaaggacatcgacttcgagaccctggcggagaacccctgcaaggtgggcctccaggccgccaacatcgagggcgcctgggggagcggcgtcgggttcacgctgacctgccaggtgtccctgaccgagtgccccaccttcctcacgagcatcaaggcctgcgacatggcgatctgctacggcgccgagtccgtgaccctgagccgggggcagaacaccgtcaagatcaccggcaagggcgggcactccggcagctccttcaagtgctgccacgggaaggagtgcagctccacgggcctgcaggccagcgcgccccacctcgacaaggtgaacggcatctccgagctggagaacgagaaggtgtacgacgacggggccccggagtgcggcatcacgtgctggttcaagaagtccggggagtgggtcatgggcatcatcaacgggaactgggtggtgctgatcgtcctctgcgtgctgctcctgttcagcctgatcctgctcagcatcctgtgccccgtgcgcaagcacaagaagtcctga

SEQ ID NO: 11875 - RNA, 3402 nt, synthetic construct
  misc_feature 1..3402: note = derived and/or modified CDS sequence (opt1) from SEOV(DN2)__KX289953.1__GP
  source 1..3402: mol_type = other RNA
atgtggagcctgctcctgctggccgccctcgccggccaggggttcgccctgaagaacgtgttcgacatgcgcatccagtgcccccactccgtcaacttcggcgagaccagcgtgtccgggtacaccgagctgccgcccctcagcctgcaggaggccgagcagctggtgcccgagtccagctgcaacatggacaaccaccagtccctcagcaccatcaacaagctgaccaaggtcatctggcggaagaaggccaaccaggagtccgccagccagaactccttcgaggtggtggagagcgaggtctccttcaagggcctgtgcatgctcaagcaccgcatggtggaggagagctaccggaaccgccggtccgtgatctgctacgacctggcgtgcaacagcaccttctgcaagcccaccgtctacatgatcgtgccgatccacgcctgcaacatgatgaagtcctgcctgatcgggctcggcccctaccgcatccaggtggtctacgagcggacgtactgcaccaccggcatcctgaccgaggggaagtgcttcgtgcccgacaaggccgtggtcagcgccctgaagcgcggcatgtacgcgatcgcctccatcgagacgatctgcttcttcatccaccagaaggggaacacctacaagatcgtgaccgccatcaccagcgccatgggcagcaagtgcaacaacacggacaccaaggtgcaggggtactacatctgcatcatcggcggcaactccgcccccgtctacgcgccggccggggaggacttccgggccatggaggtgttcagcggcatcatcaccagcccccacggggaggaccacgacctccccggcgaggagatcgccacctaccagatcagcggccagatcgaggccaagatcccccacacggtgtccagcaagaacctgaagctgaccgcgttcgccgggatcccgtcctacagctccaccagcatcctcgccgcctccgaggacggccgcttcatcttcagccccgggctgttccccaacctgaaccagtccgtctgcgacaacaacgccctccccctgatctggcggggcctgatcgacctcaccgggtactacgaggcggtgcacccgtgcaacgtgttctgcgtcctgagcggccccggcgcctcctgcgaggccttcagcgagggcgggatcttcaacatcacgtcccccatgtgcctggtgagcaagcagaaccgcttccgggccgccgagcagcagatctccttcgtctgccagcgcatcgacatggacatcatcgtgtactgcaacgggcagaagaagaccatcctcaccaagaccctggtgatcggccagtgcatctacacgatcaccagcctgttcagcctcctgcccggggtcgcgcactccatcgccatcgagctgtgcgtgccgggcttccacggctgggccaccgccgcgctcctgatcaccttctgcttcgggtgggtgctgatccccgcctgcacgctcgccatcctgctggtcctcaagttcttcgccaacatcctgcacaccagcaaccaggagaaccggttcaaggccatcctgcgcaagatcaaggaggagttcgagaagaccaagggctccatggtgtgcgagatctgcaagtacgagtgcgagaccctcaaggagctgaaggcgcacaacctgagctgcgtgcagggggagtgcccctactgcttcacgcactgcgagcccaccgagaccgccatccaggcccactacaaggtctgccaggccacccaccggttccgcgaggacctcaagaagacggtgaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctgatccccctgtggacggacaacgcccacggcgtgggcagcgtcccgatgcacaccgacctcgagctggacttctccctgcccagctccagcaagtacacctacaagcgccacctcaccaaccccgtgaacgaccagcagtccgtgagcctgcacatcgagatcgagtcccaggggatcggcgccgacgtccaccacctggggcactggtacgacgcgcgcctcaacctgaagacgagcttccactgctacggcgcctgcaccaagtaccagtacccgtggcacaccgccaagtgccacttcgagaaggactacgagtacgagaactcctgggcctgcaacccgcccgactgccccggcgtggggaccggctgcacggcgtgcgggctgtacctcgaccagctgcggcccgtgggcaccgccttcaagatcatcagcgtccgctacagccggaaggtgtgcgtgcagttcggggaggagtacctgtgcaagaccatcgacatgaacgactgcttcgtcacccgccacgccaagatctgcatcatcggcacggtgtccaagttcagccagggcgacaccctcctgttcctggggcccatggagggcgggggcatcatcttcaagcactggtgcacctccacgtgccacttcggggaccccggcgacgtgatgggccccaaggacaagccgttcatctgccccgagttccccgggcagttccggaagaagtgcaacttcgccaccacccccgtctgcgagtacgacggcaacaccatcagcgggtacaagaaggtgctcgccaccatcgactccttccagagcttcaacacgtccaacatccacttcaccgacgagcgcatcgagtggcgggacccggacggcatgctgcgcgaccacatcaacatcgtgatcagcaaggacatcgacttcgagaacctggcggagaacccctgcaaggtcgggctccaggccgccaacatcgagggcgcctggggctccggggtgggcttcaccctgacctgccaggtgagcctgacggagtgccccaccttcctcacctccatcaaggcctgcgacatggcgatctgctacggggccgagagcgtcaccctgtcccggggccagaacacggtgaagatcaccgggaagggcggccacagcgggtccagcttcaagtgctgccacggcaaggagtgctccagcaccgggctgcaggcctccgcgccccacctcgacaaggtgaacggcatcagcgagctggagaacgagaaggtctacgacgacggcgccccggagtgcgggatcacgtgctggttcaagaagtccggcgagtgggtgatggggatcatcaacggcaactgggtggtcctgatcgtgctctgcgtgctgctcctgttctccctgatcctgctcagcatcctgtgccccgtccgcaagcacaagaagtcctga

SEQ ID NO: 11876 - RNA, 3402 nt, synthetic construct
  misc_feature 1..3402: note = derived and/or modified CDS sequence (opt1) from SEOV(IR162)__KX079475.1__GP
  source 1..3402: mol_type = other RNA
atgtggagcctgctcctgctggccgccctcgtgggccgcgggttcaccctgaagaacgtcttcgacatgcggatccagtgcccccacagcgtgaacttcggcgagaccagcgtgtccgggtacacggagctgccgcccctcagcctgcaggaggcggagcagctggtccccgagtccagctgcaacatggacaaccaccagtccctcagcaccatcaacaagctgaccaaggtgatctggcgcaagaaggccaaccaggagtccgccaaccagaacagcttcgaggtggtcgagtccgaggtgagcttcaagggcctgtgcatgctcaagcaccggatggtggaggagtcctaccgcaaccggcgcagcgtcatctgctacgacctggcctgcaactccaccttctgcaagcccacggtgtacatgatcgtgccgatccacgcctgcaacatgatgaagtcctgcctgatcgggctcggcccctaccggatccaggtcgtgtacgagcgcacctactgcaccaccggcatcctgacggaggggaagtgcttcgtgcccgacaaggcggtcgtgagcgccctgaagcggggcatgtacgccatcgccagcatcgagaccatctgcttcttcatccaccagaaggggaacacctacaagatcgtgaccgcgatcacgtccgccatgggcagcaagtgcaacaacaccgacaccaaggtccaggggtactacatctgcatcatcggcggcaacagcgcccccgtgtacgccccggccggggaggacttccgcgcgatggaggtgttctccggcatcatcaccagcccccacggggaggaccacgacctccccggcgaggagatcgccacgtaccagatctccggccagatcgaggccaagatcccccacaccgtcagctccaagaacctgaagctgaccgccttcgccgggatcccgagctactccagcacctccgtgctcatcgcgagcgaggacggccggttcatcttctcccccgggctgttccccaacctgaaccagagcgtgtgcgacaacaacgccctccccctgatctggcgcggcctgatcgacctcacggggtactacgaggccgtccacccgtgcaacgtgttctgcgtcctgtccggccccggcgccagctgcgaggccttctccgagggcgggatcttcaacatcaccagccccatgtgcctggtgtccaagcagaaccggttccgcgcggccgagcagcagatcagcttcgtgtgccagcgggtcgacatggacatcatcgtgtactgcaacgggcagaagaagaccatcctcaccaagacgctggtgatcggccagtgcatctacaccatcacctccctgttcagcctcctgcccggggtcgcccacagcatcgccatcgagctgtgcgtgccgggcttccacggctgggccaccgcggccctcctgatcacgttctgcttcgggtgggtgctgatccccgcctgcaccctcgccatcctgctggtcctcaagttcttcgcgaacatcctgcacacctccaaccaggagaaccgcttcaaggccatcctgcggaagatcaaggaggagttcgagaagaccaagggcagcatggtgtgcgagatctgcaagtacgagtgcgagacgctcaaggagctgaaggcccacaacctgtcctgcgtgcagggggagtgcccctactgcttcacccactgcgagcccaccgagaccgccatccaggcccactacaaggtctgccaggcgacgcaccgcttccgggaggacctcaagaagaccgtgaccccgcagaacatcggccccgggtgctaccgcaccctgaacctgttccggtacaagagccgctgctacatcctgaccatgtggacgctcctgctgatcatcgagtccatcctctgggccgccagcgccaccgagatccccctggtgcccctgtggaccgacaacgcccacggcgtcggctccgtgccgatgcacaccgacctcgagctggacttcagcctgccctccagctccaagtacacgtacaagcgccacctcaccaaccccgtgaacgaccagcagagcgtctccctgcacatcgagatcgagagccaggggatcggcgcggacgtgcaccacctggggcactggtacgacgcccggctcaacctgaagacctccttccactgctacggcgcctgcaccaagtaccagtacccgtggcacacggccaagtgccacttcgagaaggactacgagtacgagaacagctgggcctgcaacccgcccgactgccccggcatcgggaccggctgcaccgcgtgcgggctgtacctcgaccagctgaagcccgtgggcaccgccttcaagatcatctccgtccgctacagccggaaggtgtgcgtgcagttcggggaggagtacctgtgcaagacgatcgacatgaacgactgcttcgtcacccgccacgccaagatctgcatcatcggcaccgtgagcaagttctcccagggcgacaccctcctgttcctggggcccatggagggcgggggcatcatcttcaagcactggtgcacgagcacgtgccacttcggggaccccggcgacgtgatgggccccaaggacaagccgttcatctgccccgagttccccgggcagttccggaagaagtgcaacttcgccaccacccccgtctgcgagtacgacggcaacatcatctccgggtacaagaaggtgctcgcgaccatcgacagcttccagtccttcaacaccagcaacatccacttcaccgacgagcgcatcgagtggcgggacccggacggcatgctgcgcgaccacatcaacatcgtgatctccaaggacatcgacttcgagaacctggccgagaacccctgcaaggtcgggctccaggccgccaacatcgagggcgcctggggcagcggggtgggcttcaccctgacgtgccaggtgtccctgaccgagtgccccaccttcctcaccagcatcaaggcgtgcgacatggccatctgctacggggccgagtccgtcacgctgagccggggccagaacaccgtgaagatcaccgggaagggcggccactccgggagctccttcaagtgctgccacggcaaggagtgcagctccaccgggctgcaggccagcgcgccccacctcgacaaggtgaacggcatctccgacctggagaacgagaaggtctacgacgacggcgccccggagtgcgggatcacgtgctggttcaagaagtccggcgagtgggtgatggggatcatcaacggcaactgggtggtcctgatcgtgctctgcgtgctgctcctgttcagcctgatcctgctcagcatcctgtgccccgtccgcaagcacaagaagtcctga

SEQ ID NO: 11877 - RNA, 3402 nt, synthetic construct
  misc_feature 1..3402: note = derived and/or modified CDS sequence (opt1) from SEOV(Gou3)__AF145977.2__GP
  source 1..3402: mol_type = other RNA
atgtggggcctgctcctgctggccgccctcgtggggcagggcctggcgctgaagaacgtcttcgacatgaagatccagtgcccccacagcgtgaacttcggggagaccagcgtgagcggctacaccgagctcccgcccctgcccctgcaggaggccgagcagctcgtccccgagtccagctgcaacatggacaaccaccagtccctgagcaccatcaacaagctgaccaaggtgatctggcgcaagaaggccaaccaggagtccgccagccagaactccttcgaggtggtcgagaacgaggtgagcttcaaggggctctgcatgctgaagcaccggatggtggaggagtcctaccgcaaccggcgcagcgtcatctgctacgacctggcctgcaacaccaccttctgcaagccgacggtgtacatgatcgtgcccatccacgcgtgcaacatgatgaagtcctgcctcatcggcctgggcccctaccggatccaggtcatctacgagcgcacctactgcaccaccgggatcctgacggagggcaagtgcttcgtgcccgacaaggccgtggtcagcgccctcaagcgggggatgtacgccatcgcgtccatcgagaccatctgcttcttcgtgcacaagaagggcaacacctacaagatcgtgagcgccatcaccctggccatggggtccaagtgcaacaacacggacagcaaggtccagggctactacatctgcatcatcggcgggaactccgccccggtgtacgcccccgcgggcgaggacttccgcgccatggaggtgttcagcgggatcatcaccagcccccacggcgaggaccacgacctgcccggcgaggagatcgccacctaccagatctccgggcagatcgaggccaagatcccgcacaccgtcagctccaagaacctcaagctgacggccttcgcgggcatccccagctactccagcacctccatcctggccgccagcgaggacgggcggttcatcttctcccccggcctcttccccaacctgaaccagagcgtgtgcgacaacaacgccctgccgctcatctggcgcgggctgatcgacctgaccggctactacgaggccatccacccctgcaacgtgttctgcgtcctctccggccccggggcgagctgcgaggccttctccgagggcgggatcttcaacatcaccagccccatgtgcctggtgtccaagcagaaccggttccgcgccgccgagcagcagatcagcttcatctgccagcgggtcgacatggacatcgtggtgtactgcaacggccagaagaagacgatcctgaccaagaccctcgtcatcgggcagtgcatctacaccatcacgtccctgttcagcctgctcccgggcgtggcccactccatcgcgatcgagctgtgcgtgcccggcttccacgggtgggccaccgccgccctgctcgtcaccttctgcttcggctgggtgctgatccccgcgtgcaccctggccgtgctcctgttcctgaagttcttcgccaacatcctccacacgagcaaccaggagaaccgcttcaaggccatcctgcggaagatcaaggaggagttcgagaagaccaaggggagcatggtctgcgagatctgcaagtacgagtgcgagaccctgaaggagctcaaggcccacaacctgtcctgcgtgcagggcgagtgcccctactgcttcacccactgcgagccgacggagaccgcgatccaggcccactacaaggtgtgccaggccacccaccgcttccgggaggacctgaagaagaccgtcacgccccagaacatcgggcccggctgctaccgcaccctgaacctcttccggtacaagagccgctgctacatcctgaccatgtggatcctgctcctggtgatcgagtccatcctgtgggccgccagcgcggccgagatccccctcgtgccgctgtggaccgacaacgcccacggcgtcgggtccgtgcccatgcacaccgacctggagctcgacttcagcctgccctccagctccaagtacacgtacaagcggcacctgaccaacccggtgaacgaccagcagagcgtctccctccacatcgagatcgagagccagggcatcggggccgacgtgcaccacctgggccactggtacgacgcccgcctgaacctcaagacctccttccactgctacggcgcgtgcaccaagtaccagtacccctggcacacggccaagtgccacttcgagaaggactacgagtacgagaacagctgggcctgcaacccgcccgactgccccggggtgggcgccgggtgcaccgcgtgcggcctgtacctggaccagctcaagcccgtcgggaccgccttcaagatcatctccgtgcgctacagccggaaggtgtgcgtccagttcggcgaggagtacctgtgcaagaccatcgacatgaacgactgcttcgtgacgcgccacgccaagatctgcatcatcggcaccgtgtccaagttcagccagggggacaccctcctcttcctgggccccatggagggcggcgggatcatcttcaagcactggtgcaccagcacgtgccacttcggggaccccggcgacgtcatggggccgaaggacaagcccttcatctgccccgagttccccggccagttccggaagaagtgcaacttcgccaccaccccggtgtgcgagtacgacgggaacgtgatctccggctaccgcaaggtcctggccaccatcgacagcttccagtccttcaacacgagcaacgtgcacttcaccgacgagcggatcgagtggaaggaccccgacgggatgctccgcgaccacatcaacatcgtgatctccaaggacatcgacttcgagaacctggcggagaacccctgcaaggtcggcctgcaggccgccaacatcgagggcgcctgggggagcggcgtggggttcaccctgacctgccaggtgtccctgacggagtgccccaccttcctgaccagcatcgaggcctgcgacatggcgatctgctacggcgccgagtccgtcaccctcagccgggggcagaacacgatcaagatcaccggcaagggcgggcactccggcagctccttcaagtgctgccacgggaaggagtgcagcgccaacggcctgcaggcctccgccccgcacctggacaaggtgaacggcatcagcgagctcgagaacgagaaggtgtacgacgacggggcgcccgagtgcggcatcacgtgctggttcaagaagtccggggagtgggtcatgggcatcatcaacgggaactgggtggtgctgatcgtcctgtgcgtgctcctgctgttcagcctcatcctgctgtccatcctctgccccgtgcgcaagcacaagaagtcctga

SEQ ID NO: 11878 - RNA, 3402 nt, synthetic construct
  misc_feature 1..3402: note = derived and/or modified CDS sequence (opt1) from SEOV(HB55)__AF035832.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagtccgccaaccagaacagcttcgaggtcgtggagtccgaggtgagcttcaagggcctgtgcatgctcaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctgatcgggctcggcccctaccgcatccaggtggtgtacgagcggacgtactgcaccaccggcatcctgaccgaggggaagtgcttcgtccccgacaaggccgtggtgggcgccctgaagcgcgggatgtacgccatcgcgtccatcgagacgatctgcttcttcatccaccagaagggcaacaagtacaagatcgtcaccgccatcaccagcgccatggggtccaagtgcaacaacaccgacacgaaggtgcagggctactacatctgcatcatcggcgggaacagcgcccccgtgtacgccccggcgggcgaggacttccgggccatggaggtcttcagcgggatcatcaccagcccccacggcgaggaccacgacctccccggcgaggagatcgccacctaccagatcagcgggcagatcgaggccaagatcccccacaccgtgtccagcaagaacctgaagctgatcgccttcgcgggcatcccgtcctacagctccacgagcatcctcgccgcctccgaggacgggcgcttcatcttcagccccggcctgttccccaacctgaaccagtccgtgtgcgacaacaacgccctccccctgatctggcgggggctgatcgacctcaccggctactacgaggccgtccacccgtgcaacgtgttctgcgtcctgagcggccccggggcgtcctgcgaggccttcagcgagggcgggatcttcaacatcacctcccccatgtgcctggtgagcaagcagaaccgcttccgggccgccgagcagcagatctccttcatctgccagcgcgtggacatggacatcatcgtctactgcaacggccagaagaagaccatcctcacgaagaccctggtgatcgggcagtgcatctacaccatcaccagcctgttctccctcctgcccggcgtggcccacagcatcgcgatcgagctgtgcgtcccgggcttccacgggtgggccacggccgccctcctgatcaccttctgcttcggctgggtgctgatccccgcgtgcaccctcgccatcctgctggtgctcaagttcttcgccaacatcctgcacaccagcaaccaggagaaccggttcaaggccatcctgcgcaagatcaaggaggagttcgagaagacgaaggggtccatggtctgcgagatctgcaagtacgagtgcgagaccctcaaggagctgaaggcccacaacctgagctgcgtgcagggcgagtgcccctactgcttcacccactgcgagcccaccgagacggcgatccaggcccactacaaggtgtgccaggccacccaccggttccgcgaggacctcaagaagaccgtcaccccgcagaacatcgggcccggctgctaccggacgctgaacctgttccgctacaagtcccggtgctacatcctgaccatgtggaccctcctgctgatcatcgagagcatcctctgggccgcctccgcggccgagatccccctggtgcccctgtggaccgacaacgcccacggcgtggggagcgtcccgatgcacaccgacctcgagctggacttctccctgcccagctccagcaagtacacgtacaagcgccacctcaccaaccccgtgaacgaccagcagtccgtgagcctgcacatcgagatcgagtcccagggcatcggggccgacgtccaccacctgggccactggtacgacgcccgcctcaacctgaagaccagcttccactgctacggcgcgtgcaccaagtaccagtacccgtggcacacggccaagtgccacttcgagaaggactacgagtacgagaactcctgggcctgcaacccgcccgactgccccggggtgggcaccgggtgcaccgcctgcggcctgtacctcgaccagctgaagcccgtggggaccgcgttcaagatcatcagcgtccggtactcccgcaaggcctgcgtgcagttcggcgaggagtacctgtgcaagacgatcgacatgaacgactgcttcgtgaccggccacgccaagatctgcatcatcgggaccgtcagcaagttcagccagggcgacaccctcctgttcctggggcccatggagggcgggggcatcatcttcaagcactggtgcacgtccacgtgccacttcggcgaccccggggacgtgatgggccccaaggacaagccgttcatctgccccgagttccccgggcagttccggaagaagtgcaacttcgccaccacccccatctgcgagtacgacggcaacatcatcagcgggtacaagaaggtgctcgccaccatcgactccttccagagcttcaacacctccaacatccacttcaccgacgagcgcatcgagtggcgggacccggacggcatgctgcgcgaccacatcaacatcgtcatcagcaaggacatcgacttcgagaacctggcggagaacccctgcaaggtgggcctccaggccgccaacatcgagggggcctggggctccggggtgggcttcaccctgacgtgccaggtcagcctgaccgagtgccccaccttcctcacctccatcaaggcctgcgacatggcgatctgctacggggccgagagcgtgacgctgtcccggggccagaacaccgtgcgcatcaccggcaagggcgggcacagcgggtccagcttcaagtgctgccacggcaaggagtgctccagcaccggcctgcaggcctccgcgccccacctcgacaaggtcaacgggatcagcgagctggagaacgagaaggtgtacgacgacggcgccccggagtgcggggtgacgtgctggttcaagaagtccggcgagtgggtcatggggatcatcaacggcaactgggtggtgctgatcgtcctctgcgtgctgctcctgttcagcctgatcctgctcagcatcctgtgccccgtgcggaagcacaagaagtcctga

SEQ ID NO: 11879 - RNA, 3402 nt, synthetic construct
  misc_feature 1..3402: note = derived and/or modified CDS sequence (opt1) from SEOV(L99)__AF035833.1__GP
  source 1..3402: mol_type = other RNA
atgtggagcctgctcctgctggccgccctcgtgggccaggggttcgccctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagctggccaaccagaactccttcgaggtcgtggagagcgaggtgtccttcaagggcctctgcatgctgaagcaccgcatggtcgaggagagctaccggaaccgccggtccgtgatctgctacgacctggcctgcaacagcaccttctgcaagcccaccgtgtacatgatcgtcccgatccacgcgtgcaacatgatgaagtcctgcctcatcgggctgggcccctaccgcatccaggtggtgtacgagcggacgtactgcaccaccggcatcctgaccgaggggaagtgcttcgtccccgacaaggccgtggtgagcgccctcaagcgcggcatgtacgccatcgcgtccatcgagacgatctgcttcttcatccaccagaaggggaacacctacaagatcgtcaccgccatcaccagcgccatgggctccaagtgcaacaacacggacaccaaggtgcaggggtactacatctgcatcatcggcggcaacagcgcccccgtgtacgccccggcgggggaggacttccgggccatggaggtcttcagcggcatcatcaccagcccccacggggaggaccacgacctgcccggcgaggagatcgccacctaccagatcagcggccagatcgaggccaagatcccccacacggtgtccagcaagaacctgaagctcatcgccttcgcggggatcccgtcctacagctccaccagcatcctggccgcctccgaggacggccgcttcatcttcagccccgggctgttccccaacctcaaccagtccgtgtgcgacaacaacgccctgcccctgatctggcggggcctcatcgacctgaccgggtactacgaggccgtccacccgtgcaacgtgttctgcgtcctgagcggccccggcgcgtcctgcgaggccttcagcgagggcgggatcttcaacatcacctcccccatgtgcctcgtgagcaagcagaaccgcttccgggccgccgagcagcagatctccttcatctgccagcgcgtggacatggacatcatcgtctactgcaacgggcagaagaagacgatcctgaccaagaccctggtgatcggccagtgcatctacaccatcacgagcctcttctccctgctgcccggggtggcccacagcatcgcgatcgagctctgcgtcccgggcttccacggctgggccaccgccgccctgctgatcaccttctgcttcgggtgggtgctcatccccgcgtgcaccctggccatcctgctcgtgctgaagttcttcgccaacatcctgcacacgagcaaccaggagaaccggttcaaggccatcctccgcaagatcaaggaggagttcgagaagaccaagggctccatggtctgcgagatctgcaagtacgagtgcgagaccctgaaggagctgaaggcccacaacctcagctgcgtgcagggggagtgcccctactgcttcacccactgcgagcccacggagaccgcgatccaggcccactacaaggtgtgccaggccacccaccggttccgcgaggacctgaagaagaccgtcacgccgaagaacatcggccccgggtgctaccggaccctgaacctgttccgctacaagtcccggtgctacatcctcaccatgtggaccctgctgctcatcatcgagagcatcctgtgggccgcctccgcggccgagatccccctggtgcccctctggaccgacaacgcccacggcgtgggcagcgtcccgatgcacacggacctggagctggacttctccctccccagctccagcaagtacacctacaagcgccacctgaccaaccccgtgaacgaccagcagtccgtgagcctgcacatcgagatcgagtcccaggggatcggcgccgacgtccaccacctcgggcactggtacgacgcccgcctgaacctgaagaccagcttccactgctacggcgcgtgcacgaagtaccagtacccgtggcacaccgccaagtgccacttcgagaaggactacgagtacgagaactcctgggcctgcaacccgcccgactgccccggcgtggggaccggctgcaccgcctgcgggctctacctggaccagctgaagcccgtgggcacggcgttcaagatcatcagcgtccggtactcccgcaaggtgtgcgtgcagttcggggaggagtacctctgcaagaccatcgacatgaacgactgcttcgtcacccggcacgccaagatctgcatcatcggcaccgtgagcaagttcagccagggcgacacgctgctgttcctcgggcccatggagggcgggggcatcatcttcaagcactggtgcacctccacgtgccacttcggggaccccggcgacgtgatgggccccaaggacaagccgttcagctgccccgagttccccgggcagttccgcaagaagtgcaacttcgccaccacccccatctgcgagtacgacggcaacatcatctccgggtacaagaaggtcctggccaccatcgacagcttccagtccttcaacaccagcaacatccacttcaccgacgagcggatcgagtggcgcgacccggacggcatgctgcgggaccacatcaacatcgtgatctccaaggacatcgacttcgagaacctcgccgagaacccctgcaaggtggggctgcaggcggccaacatcgagggcgcctggggcagcggggtcggcttcacgctgacctgccaggtgtccctcaccgagtgccccaccttcctgacgagcatcaaggcctgcgacatggccatctgctacggggcggagtccgtgaccctgagccgcggccagaacaccgtccggatcaccgggaagggcggccactccgggagctccttcaagtgctgccacggcaaggagtgcagctccacggggctccaggccagcgcgccccacctggacaaggtgaacggcatctccgagctggagaacgagaaggtgtacgacgacggcgccccggagtgcggggtgacctgctggttcaagaagtccggcgagtgggtcatggggatcatcaacggcaactgggtggtcctcatcgtgctgtgcgtgctgctcctgttcagcctgatcctcctgtccatcctgtgccccgtccgcaagcacaagaagtcctga

SEQ ID NO: 11880 - RNA, 3402 nt, synthetic construct
  misc_feature 1..3402: note = derived and/or modified CDS sequence (opt1) from SEOV(Z37)__AF187081.1__GP
  source 1..3402: mol_type = other RNA
atgtggagcctgctcctgctggccgccctcgtgggccaggggttcgcgctgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacctactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacaagtacaagatcgtgaccgccatcacctccgccatgggcagcaagtgcaacaacaccgacacgaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacaccgtcagctccaagaacctgaagctgacggccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcaccagccccatgtgcctggtctccaagcagatccgcttccgggccgccgagcagcagatcagcttcatctgccagcgcgtggacatggacatcatcgtgtactgcaacgggcagaagaagacgatcctcaccaagaccctggtcatcggccagtgcatctacaccatcacgtccctgttcagcctcctgcccggggtggcccacagcatcgcgatcgagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgtccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacccactgcgagcccacggagaccgcgatccaggcccactacaaggtgtgccaggccacccaccggttccgcgaggacctcaagaagaccgtgacgccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggaccgacaacgcccacggcgtgggctccgtgccgatgcacacggacctcgagctggacttcagcctgccctccagctccaagtacacctacaagcgccacctcaccaaccccgtcaacgaccagcagagcgtgtccctgcacatcgagatcgagagccaggggatcggcgccgacgtgcaccacctggggcactggtacgacgcccgcctcaacctgaagacctccttccactgctacggcgcgtgcacgaagtaccagtacccgtggcacaccgccaagtgccacttcgagaaggactacgagtacgagaacagctgggcctgcaacccgcccgactgccccggcgtcgggaccggctgcaccgcctgcgggctgtacctcgaccagctgaagcccgtgggcacggcgttcaagatcatctccgtgcggtacagccgcaaggtctgcgtgcagttcggggaggagtacctgtgcaagaccatcgacatgaacgactgcttcgtgacccggcacgccaagatctgcatcatcggcaccgtcagcaagttctcccagggcgacacgctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtgtgcgagtacgacggcaacatcatctccgggtacaagaaggtcctcgccaccatcgacagcttccagtccttcaacaccagcaacatccacttcaccgacgagcggatcgagtggcgcgacccggacggcatgctgcgggaccacatcaacatcgtgatctccaaggacatcgacttcgagaacctggccgagaacccctgcaaggtggggctccaggcggccaacatcgagggcgcctggggcagcggggtcggcttcacgctgacctgccaggtgtccctgaccgagtgccccaccttcctcacgagcatcaaggcctgcgacatggccatctgctacggggcggagtccgtgaccctgagccgcggccagaacaccgtcaagatcaccgggaagggcggccactccgggagctccttcaagtgctgccacggcaaggagtgcagctccacggggctgcaggccagcacgccccacctcgacaaggtgaacggcatctccgagctggagaacgagaaggtgtacgacgacggcgccccggagtgcgggatcacgtgctggttcaagaagtccggcgagtgggtcatggggatcatcaacggcaactgggtggtgctgatcgtcctctgcgtgctgctcctgttcagcctgatcctgctcagcatcctgtgccccgtgcggaagcacaagaagtcctga

SEQ ID NO: 11881 - RNA, 3402 nt, synthetic construct
  misc_feature 1..3402: note = derived and/or modified CDS sequence (opt1) from SEOV(Z37)__AF190119.1__GP
  source 1..3402: mol_type = other RNA
atgtggagcctgctcctgctggccgccctcgtgggccaggggttcgccctgaagaacgtcttcgacatgcgcatccagtgcccccactccgtgaacttcggcgagaccagcgtgtccgggtacaccgagctgccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcatctgccagcgcgtggacatggacatcatcgtgtactgcaacgggcagaagaagaccatcctcaccaagaccctggtcatcggccagtgcatctacacgatcacctccctgttcagcctcctgcccggggtggcccacagcatcgcgatcgagctgtgcgtgccgggcttccacggctgggccaccgccgccctcctgatcaccttctgcttcgggtgggtcctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacgcactgcgagcccaccgagaccgcgatccaggcccactacaaggtgtgccaggccacccaccggttccgcgaggacctcaagaagacggtgaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtccccctgtggacggacaacgcccacggcgtgggctccgtgccgatgcacaccgacctcgagctggacttcagcctgccctccagctccaagtacacctacaagcgccacctcaccaaccccgtcaacgaccagcagagcgtgtccctgcacatcgagatcgagagccaggggatcggcgccgacgtgcaccacctggggcactggtacgacgcccgcctcaacctgaagacgtccttccactgctacggcgcgtgcaccaagtaccagtacccgtggcacaccgccaagtgccacttcgagaaggactacgagtacgagaacagctgggcctgcaacccgcccgactgccccggcgtcgggaccggctgcacggcctgcgggctgtacctcgaccagctgaagcccgtgggcaccgcgttcaagatcatctccgtgcggtacagccgcaaggtctgcgtgcagttcggggaggagtacctgtgcaagaccatcgacatgaacgactgcttcgtgacccggcacgccaagatctgcatcatcggcacggtcagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttcgccgggcagttccgcaagaagtgcaacttcgccaccacccccgtgtgcgagtacgacggcaacatcatctccgggtacaagaaggtcctcgagaccatcgacagcttccagtccttcaacaccagcaacatccacttcacggacgagcggatcgagtggcgcgaccccgacggcatgctgcgggaccacatcaacatcgtgatctccaaggacatcgacttcgagaacatggccgagaacccgtgcaaggtggggctgcaggcggccaacatcgagggcgcctggggcagcggggtcggcttcaccctgacctgccaggtgtccctcaccgagtgccccacgagcctgacctccatcaaggcctgcgacatggccatctgctacggggcggagagcgtgaccctctcccgcggccagaacaccgtcaagatcacggggaagggcggccacagcgggtccagcttcaagcggtgccacggcaaggagtgctccagcaccgggctgcaggcctccgcgccccacctggacaaggtgaacggcatcagcgagctcgagaacgagaaggtgtacgacgacggcgcccccgagtgcgggatcacgtgctggttcaagaagtccggcgagtgggtcatggggatcatcaacggcaactgggtggtgctgatcgtcctgtgcgtgctcctgctgttcagcctcatcctgctgagcatcctctgcccggtgcgcaagcacaagaagtcctga

SEQ ID NO: 11882 - RNA, 3402 nt, synthetic construct
  misc_feature 1..3402: note = derived and/or modified CDS sequence (opt1) from SEOV__M34882.1__GP
  source 1..3402: mol_type = other RNA
atgtggagcctgctcctgctggccgccctcgtgggccaggggttcgccctgaagaacgtcttcgacatgcgcatccagctgccccacagcgtgaacttcggcgagaccagcgtgtccgggtacaccgagttcccgcccctcagcctgcaggaggccgagcagctggtccccgagtccagctgcaacatggacaaccaccagtccctcagcaccatcaacaagctgaccaaggtgatctggcggaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggtcgtgtacgagcggacgtactgcaccaccggcatcctgaccgaggggaagtgcttcgtgcccgacaaggccgtcgtgagcgccctgaagcgcggcatgtacgccatcgcgagcatcgagacgatctgcttcttcatccaccagaaggggaacacctacaagatcgtgaccgccatcacctccgccatgggcagcaagtgcaacaacacggacaccaaggtccaggggtactacatctgcatcatcggcggcaacagcgcccccgtgtacgccccggcgggggaggacttccgggccatggaggtgttctccggcatcatcaccagcccccacggggaggaccacgacctccccggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctgctgatcatcgagtccatcctctgggccgccagcgcggccgagatccccctggtgcccctgtggacggacaacgcccacggcgtgggctccgtcccgatgcacaccgacctcgagctggacttcagcctgccctccagctccaagtacacctacaagcgccacctcaccaaccccgtgaacgaccagcagagcgtgtccctgcacatcgagatcgagagccaggggatcggcgccgccgtccaccacctggggcactggtacgacgcgcgcctcaacctgaagacgtccttccactgctacggcgcctgcaccaagtaccagtacccgtggcacaccgccaagtgccacttcgagaaggactacgagtacgagaacagctgggcctgcaacccgcccgactgccccggcgtggggaccggctgcacggcgtgcgggctgtacctcgaccagctgaagcccgtgggcaccgccttcaagatcatctccgtccggtacagccgcaaggtgtgcgtgcagttcggggaggagcacctgtgcaagaccatcgacatgaacgactgcttcgtcacccggcacgccaagatctgcatcatcggcacggtgagcaagttctcccagggcgacaccctcctgttcctggggcccatggagggcgggggcatcatcttcaagcactggtgcaccagcacgtgccacttcggggaccccggcgacgtgatgggccccaaggacaagccgttcatctgccccgagttccccgggcagttccgcaagaagtgcaacttcgccaccacccccgtctgcgagtacgacggcaacatcatctccgggtacaagaaggtgctcgccaccatcgacagcttccagtccttcaacaccagcaacatccacttcacggacgagcggatcgagtggcgcgacccggacggcatgctgcgggaccacatcaacatcgtgatctccaaggacatcgacttcgagaacctggcggagaacccctgcaaggtcgggctccaggccgccaacatcgagggcgcctggggcagcggggtgggcttcaccctgacctgcaaggtgtccctgaccgagtgccccacgttcctcaccagcatcaaggcctgcgacatggcgatctgctacggggccgagtccgtcaccctgagccgcggccagaacaccgtgaagatcacggggaagggcggccactccgggagctccttcaagtgctgccacggcaaggagtgcagctccaccgggctgcaggccagcgcgccccacctcgacaaggtgaacggcatctccgagctggagaacgagaaggtctacgacgacggcgccccggagtgcgggatcacgtgctggttcaagaagtccggcgagtgggtgatggggatcatcaacggcaactgggtggtcctgatcgtgctctgcgtgctgctcctgttcagcctgatcctgctcagcatcctgtgccccgtccggaagcacaagaagtcctga

SEQ ID NO: 11883 - RNA, 3423 nt, synthetic construct
  misc_feature 1..3423: note = derived and/or modified CDS sequence (opt1) from SNV(NM H10)__NC_005215.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagatcacgcccatcctgctcacccaggtcgcggacctgaagatcgagtccagctgcaacttcgacctgcacgtgcccgccaccaccacgcagaagtacaaccaggtggactggaccaagaagtccagcaccaccgagtccacgaacgccggcgccaccaccttcgaggccaagaccaaggagatcaacctcaagggcacgtgcaacatcccgcccaccaccttcgaggcggcctacaagagccggaagaccgtcatctgctacgacctggcctgcaaccagacgcactgcctgcccaccgtgcacctcatcgcccccgtgcagacctgcatgtccgtccgcagctgcatgatcgggctgctgtccagccggatccaggtgatctacgagaagacctactgcgtgacgggccagctcatcgaggggctgtgcttcatccccacccacaccatcgcgctgacccagcccggccacacgtacgacaccatgaccctcccggtgacctgcttcctggtggccaagaagctggggacgcagctcaagctggccgtggagctggagaagctcatcaccggcgtctcctgcaccgagaacagcttccagggctactacatctgcttcatcgggaagcactccgagcccctgttcgtgcccaccatggaggactaccgcagcgccgagctgttcacgcggatggtgctcaacccccgcggcgaggaccacgacccggaccagaacgggcagggcctgatgcggatcgccggccccgtcaccgcgaaggtgccctccaccgagaccaccgagacgatgcaggggatcgccttcgccggcgcccccatgtacagctccttcagcaccctggtgcgcaaggccgacccggagtacgtcttctcccccgggatcatcgcggagagcaaccacagcgtgtgcgacaagaagaccgtccccctcacctggacgggcttcctggccgtgtccggggagatcgagaagatcaccggctgcaccgtgttctgcaccctggccggccccggggccagctgcgaggcctactccgagacgggcatcttcaacatcagctccccgacctgcctcgtcaacaaggtgcagaagttccgggggagcgagcagcgcatcaacttcatgtgccagcgggtggaccaggacgtcgtggtgtactgcaacggccagaagaaggtcatcctgaccaagaccctggtgatcgggcagtgcatctacacgttcacctccctcttcagcctgatccccggcgtggcgcactccctggccgtcgagctctgcgtgcccggcctgcacgggtgggccaccaccgccctgctcatcacgttctgcttcggctggctgctgatccccgccgtgaccctcatcatcctgaagatcctgcgcctcctgaccttcagctgctcccactacagcaccgagtccaagttcaaggtcatcctggagcgggtgaaggtggagtaccagaagacgatggggagcatggtctgcgacatctgccaccacgagtgcgagaccgcgaaggagctggagacccacaagaagtcctgcccggagggccagtgcccctactgcatgaccatcacggagagcaccgagtccgccctccaggcccacttcgccatctgcaagctgaccaaccgcttccaggagaacctgaagaagtccctcaagcggcccgaggtgcgcaaggggtgctaccggaccctgggcgtgttccgctacaagagccggtgctacgtcggcctggtgtgggggatcctcctgacgaccgagctgatcatctgggcggccagcgccgacacgcccctcatggagagcggctggtccgacaccgcccacggggtgggcatcatcccgatgaagaccgacctggagctggacttcgccctcgcgagctccagctcctacagctaccgccggaagctggtcaaccccgccaaccaggaggagaccctgcccttccacttccagctcgacaagcaggtcgtgcacgccgagatccagaacctgggccactggatggacgggaccttcaacatcaagaccgccttccactgctacggcgagtgcaagaagtacgcctacccgtggcagacggcgaagtgcttcttcgagaaggactaccagtacgagacctcctgggggtgcaacccgcccgactgccccggcgtcgggaccggctgcaccgcctgcggcgtgtacctggacaagctccgcagcgtggggaaggcctacaagatcgtctccctgaagtacacccgcaaggtgtgcatccagctgggcacggagcagacctgcaagcacatcgacgtgaacgactgcctcgtcacccccagcgtgaaggtgtgcatgatcgggaccatctccaagctgcagcccggcgacacgctcctgttcctggggcccctggagcagggcggcatcatcctcaagcagtggtgcaccaccagctgcgtcttcggggaccccggcgacatcatgtccaccacgagcgggatgcggtgcccggagcacaccggctccttccgcaagatctgcgggttcgccaccacccccacgtgcgagtaccagggcaacaccgtgagcggcttccagcggatgatggccacccgcgactccttccagagcttcaacgtgaccgagccccacatcacgagcaaccggctggagtggatcgaccccgactccagcatcaaggaccacatcaacatggtcctgaaccgcgacgtgtccttccaggacctcagcgacaacccgtgcaaggtggacctgcacacccagtccatcgacggggcgtggggcagcggggtcggcttcaccctggtgtgcaccgtggggctcacggagtgcgccaacttcatcacctccatcaaggcctgcgacagcgccatgtgctacggcgcgaccgtcaccaacctgctgcggggctccaacacggtgaaggtggtcgggaagggcgggcacagcggctccctcttcaagtgctgccacgacaccgactgcaccgaggagggcctggccgccagcccgccccacctggaccgcgtgaccgggtacaaccagatcgactccgacaaggtgtacgacgacggcgccccgccctgcacgatcaagtgctggttcaccaagagcggggagtggctcctgggcatcctgaacgggaactgggtcgtggtcgccgtgctcatcgtgatcctgatcctgtccatcctcctgttcagcttcttctgccccgtccggtcccgcaagaacaaggcgaactga

SEQ ID NO: 11884 - RNA, 3423 nt, synthetic construct
  misc_feature 1..3423: note = derived and/or modified CDS sequence (opt1) from SNV(1)__JQ690283.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccgccaccttcgaggcgaagaccaaggaggtcaacctcaagggcacgtgcaacatcccgcccaccaccttcgaggccgcctacaagagccggaagaccgtgatctgctacgacctggcctgcaaccagacgcactgcctgcccaccgtgcacctcatcgcgcccgtccagacctgcatgtccgtgcgcagctgcatgatcgggctgctgtccagccggatccaggtgatctacgagaagacctactgcgtcacgggccagctcatcgaggggctgtgcttcatccccacccacaccatcgccctgacccagcccggccacacgtacgacaccatgaccctcccggtgacctgcttcctggtggccaagaagctggggacgcagctcaagctggccgtcgagctggagaagctcatcaccggcgtgtcctgcaccgagaacagcttccagggctactacatctgcttcatcgggaagcactccgagcccctgttcgtgcccaccatggaggactaccgcagcgccgagctgttcacgcggatggtcctcaacccccgcggcgaggaccacgacccggaccagaacgggcagggcctgatgcggatcgcgggccccgtgaccgccaaggtgccctccaccgagaccaccgagacgatgcaggggatcgccttcgccggcgcccccatgtacagctccttcagcaccctggtccgcaaggcggacccggagtacgtgttctcccccgggatcatcgccgagagcaaccacagcgtctgcgacaagaagaccgtgcccctcacctggacgggcttcctggccgtgtccggggagatcgagcggatcaccggctgcaccgtcttctgcaccctggccggccccggggccagctgcgaggcgtactccgagacgggcatcttcaacatcagctccccgacctgcctcgtgaacaaggtgcagaagttccgcgggagcgagcagcggatcaacttcatgtgccagcgcgtcgaccaggacgtggtggtctactgcaacggccagaagaaggtgatcctgaccaagaccctggtgatcgggcagtgcatctacacgttcacctccctcttcagcctgatccccggcgtcgcccactccctggccgtggagctctgcgtgcccggcctgcacgggtgggccaccaccgccctgctcatcacgttctgcttcggctggctgctgatccccaccgtcaccctcatcatcctgaaggtgctgcggctcctgaccttcagctgctcccactacagcacggagtccaagttcaaggtgatcctggagcgcgtcaaggtggagtaccagaagaccatggggagcatggtgtgcgacatctgccaccacgagtgcgagaccgcgaaggagctggagacccacaagaagtcctgcccggagggccagtgcccctactgcatgacgatcaccgagagcaccgagtccgccctccaggcccacttcagcatctgcaagctgaccaaccggttccaggagaacctgaagaagtccctcaagcgccccgaggtccggaaggggtgctaccgcacgctgggcgtgttccggtacaagagccgctgctacgtgggcctggtctgggggatcctcctgaccaccgagctgatcatctgggccgcgagcgccgacacgcccctcatggagtccggctggagcgacaccgcccacggggtgggcatcatcccgatgaagaccgacctggagctggacttcgccctcgcctccagctccagctactcctaccggcgcaagctggtgaaccccgcgaaccaggaggagaccctgcccttccacttccagctcgacaagcaggtcgtgcacgccgagatccagaacctgggccactggatggacgggaccttcaacatcaagacggccttccactgctacggcgagtgcaagaagtacgcctacccgtggcagaccgccaagtgcttcttcgagaaggactaccagtacgagaccagctgggggtgcaacccgcccgactgccccggcgtggggaccggctgcaccgcgtgcggcgtctacctggacaagctccgctccgtggggaaggcctacaagatcgtgagcctgaagtacacgcggaaggtctgcatccagctgggcaccgagcagacctgcaagcacatcgacgtgaacgactgcctcgtgaccccctccgtcaaggtgtgcatgatcgggacgatcagcaagctgcagcccggcgacaccctcctgttcctggggcccctggagcagggcggcatcatcctcaagcagtggtgcaccacctcctgcgtgttcggggaccccggcgacatcatgagcacgacctccgggatgcgctgcccggagcacaccggcagcttccggaagatctgcgggttcgccaccacgccgacctgcgagtaccagggcaacaccgtctccggcttccagcgcatgatggccacccgggacagcttccagagcttcaacgtgacggagccccacatcacctccaaccgcctggagtggatcgaccccgacagctccatcaaggaccacatcaacatggtgctgaaccgggacgtcagcttccaggacctctccgacaacccctgcaaggtggacctgcacacccagagcatcgacggggcctggggctccggggtgggcttcaccctggtctgcacggtggggctcaccgagtgcgcgaacttcatcaccagcatcaaggcctgcgactccgccatgtgctacggcgccaccgtgacgaacctgctgcgcggcagcaacaccgtcaaggtggtggggaagggcgggcactccggcagcctcttcaagtgctgccacgacaccgactgcaccgaggagggcctggcggcctccccgccccacctggaccgggtcacggggtacaaccagatcgacagcgacaaggtgtacgacgacggcgccccgccctgcaccatcaagtgctggttcaccaagtccggggagtggctcctgggcatcctgaacgggaactgggtcgtggtggccgtcctcatcgtgatcctgatcctgagcatcctcctgttctccttcttctgccccgtgcgcaaccggaagaacaaggccaactga

SEQ ID NO: 11885 - RNA, 3423 nt, synthetic construct
  misc_feature 1..3423: note = derived and/or modified CDS sequence (opt1) from SNV(1)__JQ690279.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaacaccttcgaggccaagaccaaggagatcaacctcaagggcacgtgcaacatcccgcccaccaccttcgaggcggcctacaagagccggaagaccgtcatctgctacgacctggcctgcaaccagacgcactgcctgcccaccgtgcacctcatcgcccccgtgcagacctgcatgtccgtccgcagctgcatgatcgggctgctgtccagccggatccaggtgatctacgagaagacctactgcgtgacgggccagctcatcgaggggctgtgcttcatccccacccacaccatcgcgctgacccagcccggccacacgtacgacaccatgaccctcccggtgacctgcttcctggtggccaagaagctggggacgcagctcaagctggccgtggagctggagaagctcatcaccggcgtctcctgcaccgagaacagcttccagggctactacatctgcttcatcgggaagcactccgagcccctgttcgtgcccaccatggaggactaccgcagcgccgagctgttcacgcggatggtgctcaacccccgcggcgaggaccacgacccggaccagaacgggcagggcctgatgcggatcgccggccccgtcaccgcgaaggtgccctccaccgagaccaccgagacgatgcaggggatcgccttcgccggcgcccccatgtacagctccttcagcaccctggtgcgcaaggccgacccggagtacgtcttctcccccgggatcatcgcggagagcaaccacagcgtgtgcgacaagaagaccgtccccctcacctggacgggcttcctggccgtgtccggggagatcgagcggatcaccggctgcaccgtgttctgcaccctggccggccccggggccagctgcgaggcctactccgagacgggcatcttcaacatcagctccccgacctgcctcgtcaacaaggtgcagaagttccgcgggagcgagcagcggatcaacttcatgtgccagcgcgtggaccaggacgtcgtggtgtactgcaacggccagaagaaggtcatcctgaccaagaccctggtgatcgggcagtgcatctacacgttcacctccctcttcagcctgatccccggcgtggcgcactccctggccgtcgagctctgcgtgcccggcctgcacgggtgggccaccaccgccctgctcatcacgttctgcttcggctggctgctgatccccaccgtgaccctcctgatcctgaagatcctccggctgctgaccttcagctgctcccactacagcacggagtccaagttcaaggtcatcctggagcgcgtgaaggtggagtaccagaagaccatggggagcatggtctgcgacatctgccaccacgagtgcgagaccgccaaggagctcgagacccacaagaagtcctgcccggagggccagtgcccctactgcatgacgatcaccgagagcaccgagtccgcgctgcaggcccacttcagcatctgcaagctgaccaaccggttccaggagaacctcaagaagtccctgaagcgccccgaggtgaagaaggggtgctaccggacgctgggcgtgttccgctacaagagccggtgctacgtcggcctcgtgtgggggatcctgctgaccaccgagctcatcatctgggccgccagcgcggacacgcccctgatggagtccggctggagcgacaccgcccacggggtgggcatcatcccgatgaagtccgacctggagctcgacttcgccctggccagctccagctcctacagctaccgccggaagctggtcaaccccgccaaccaggaggagaccctccccttccacttccagctggacaagcaggtcgtgcacgcggagatccagaacctgggccactggatggacgggaccttcaacatcaagaccgccttccactgctacggcgagtgcaagaagtacgcctacccgtggcagacggccaagtgcttcttcgagaaggactaccagtacgagacctcctgggggtgcaacccgcccgactgccccggcgtcgggaccggctgcaccgcctgcggcgtgtacctcgacaagctgcgcagcgtggggaaggcgtacaagatcgtctccctgaagtacacccgcaaggtgtgcatccagctcggcacggagcagacctgcaagcacatcgacgtgaacgactgcctggtcacccccagcgtgaaggtgtgcatgatcgggaccatctccaagctgcagcccggcgacacgctcctgttcctggggcccctcgagcagggcggcatcatcctgaagcagtggtgcaccaccagctgcgtcttcggggaccccggcgacatcatgtccaccacgagcgggatgcggtgcccggagcacaccggctccttccgcaagatctgcgggttcgccaccacccccacgtgcgagtaccagggcaacaccgtgagcggcttccagcggatgatggccacccgcgacagcttccagtccttcaacgtgaccgagccccacatcacgagcaaccggctggagtggatcgaccccgactccagcatcaaggaccacatcaacatgatcctcaaccgcgacgtctccttccaggacctgagcgacaacccgtgcaaggtggacctgcacacccagtccatcgacggggcctggggcagcggggtgggcttcaccctcgtctgcaccgtggggctgacggagtgcgccaacttcatcacctccatcaaggcgtgcgacagcgccatgtgctacggcgccaccgtgaccaacctgctccggggctccaacacggtcaaggtggtggggaagggcgggcacagcggctccctgttcaagtgctgccacgacaccgactgcaccgaggagggcctggccgcgagcccgccccacctcgaccgcgtcaccgggtacaaccagatcgactccgacaaggtgtacgacgacggcgccccgccctgcacgatcaagtgctggttcaccaagagcggggagtggctgctgggcatcctcaacgggaactgggtggtcgtggccgtcctgatcgtgatcctgatcctctccatcctgctgttcagcttcttctgccccgtgcggtcccgcaagaacaaggccaactga

SEQ ID NO: 11886 - RNA, 3423 nt, synthetic construct
  misc_feature 1..3423: note = derived and/or modified CDS sequence (opt1) from SNV(2)__JQ690284.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagggctccaccacggagagcaccaacgccggcgccaacaccttcgaggccaagaccaaggaggtcaacctcaaggggacgtgcaacatcccgcccaccaccttcgaggcggcctacaagtcccggaagaccgtgatctgctacgacctggcctgcaaccagacgcactgcctgcccaccgtgcacctcatcgcccccgtccagacctgcatgagcgtgcgctcctgcatgatcggcctgctgagctcccggatccaggtgatctacgagaagacctactgcgtcacggggcagctcatcgagggcctgtgcttcatccccacccacaccatcgcgctgacccagcccgggcacacgtacgacaccatgaccctcccggtgacctgcttcctggtggccaagaagctgggcacgcagctcaagctggccgtcgagctggagaagctcatcaccggcgtgagctgcaccgagaactccttccaggggtactacatctgcttcatcggcaagcacagcgagcccctgttcgtgcccaccatggaggactaccgctccgccgaggtcttcacgcggatggtgctgaacccccgcggggaggaccacgacccggaccagaacggccagggcctcatgcggatcgccgggcccgtgaccgcgaaggtccccagcaccgagaccaccgagacgatgcagggcatcgccttcgccggggcccccatgtactccagcttctccaccctggtgcgcaaggccgacccggagtacgtcttcagccccggcatcatcgcggagtccaaccacagcgtgtgcgacaagaagaccgtgcccctgacctggacggggttcctcgccgtcagcggcgagatcgagcggatcaccggctgcaccgtgttctgcaccctggccgggcccggcgcctcctgcgaggcctacagcgagacggggatcttcaacatctccagcccgacctgcctggtgaacaaggtccagaagttccgcggctccgagcagcggatcaacttcatgtgccagcgcgtggaccaggacgtggtcgtgtactgcaacgggcagaagaaggtgatcctcaccaagaccctggtcatcggccagtgcatctacacgttcaccagcctgttctccctcatccccggcgtggcgcacagcctggccgtggagctgtgcgtccccgggctccacggctgggccaccaccgccctgctgatcacgttctgcttcgggtggctcctgatccccaccgtgaccctgatcatcctcaagatcctgcggctgctcaccttctcctgcagccactactccacggagagcaagttcaaggtgatcctggagcgcgtcaaggtggagtaccagaagaccatgggctccatggtgtgcgacatctgccaccacgagtgcgagaccgccaaggagctggagacccacaagaagtcctgcccggaggggcagtgcccctactgcatgacgatcaccgagagcaccgagagcgcgctgcaggcccacttctccatctgcaagctcaccaaccggttccaggagaacctgaagaagtccctgaagcgccccgaggtcaagaagggctgctaccggacgctcggcgtgttccgctacaagagccggtgctacgtggggctggtctggggcatcctgctcaccaccgagctgatcatctgggccgccagcgcggacacgcccctgatggagagcgggtggtccgacaccgcccacggcgtgggcatcatcccgatgaagaccgacctcgagctggacttcgccctggccagctccagctcctacagctaccgccggaagctcgtgaaccccgccaaccaggaggagaccctgcccttccacttccagctggacaagcaggtcgtgcacgcggagatccagaacctcgggcactggatggacggcaccttcaacatcaagacggccttccactgctacggggagtgcaagaagtacgcctacccgtggcagaccgccaagtgcttcttcgagaaggactaccagtacgagacctcctggggctgcaacccgcccgactgccccggggtgggcaccggctgcaccgcctgcggggtctacctggacaagctgcgcagcgtgggcaaggcgtacaagatcgtgtccctcaagtacacgcgcaaggtctgcatccagctggggaccgagcagacctgcaagcacatcgacgtgaacgactgcctggtgacccccagcgtcaaggtgtgcatgatcggcacgatctccaagctccagcccggggacaccctgctgttcctcggccccctggagcagggcgggatcatcctgaagcagtggtgcaccaccagctgcgtgttcggcgaccccggggacatcatgtccacgaccagcggcatgcggtgcccggagcacaccgggtccttccgcaagatctgcggcttcgccaccacgccgacctgcgagtaccagggcaacaccgtcagcgggttccagcggatgatggccacccgcgactccttccagagcttcaacgtgacggagccccacatcaccagcaaccggctcgagtggatcgaccccgactccagcatcaaggaccacatcaacatggtgctgaaccgcgacgtctccttccaggacctgagcgacaacccctgcaaggtggacctccacacccagtccatcgacggcgcctgggggagcggcgtggggttcaccctggtctgcacggtgggcctgaccgagtgcgccaacttcatcacctccatcaaggcgtgcgacagcgccatgtgctacggcgccaccgtgacgaacctcctgcgggggtccaacaccgtcaaggtggtgggcaagggcgggcacagcggctccctgttcaagtgctgccacgacaccgactgcaccgaggaggggctcgccgcgagcccgccccacctggaccgcgtcacgggctacaaccagatcgactccgacaaggtgtacgacgacggggccccgccctgcaccatcaagtgctggttcaccaagagcggcgagtggctgctcgggatcctgaacggcaactgggtcgtggtggccgtcctgatcgtgatcctcatcctgtccatcctcctgttcagcttcttctgccccgtgcggtcccgcaagaacaaggccaactga

SEQ ID NO: 11887 - RNA, 3423 nt, synthetic construct
  misc_feature 1..3423: note = derived and/or modified CDS sequence (opt1) from SNV(2)__JQ690280.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaacaccttcgaggccaagaccaaggaggtcaacctcaagggcacgtgcaacatcccgcccaccaccttcgaggcggcctacaagagccggaagaccgtgatctgctacgacctggcctgcaaccagacgcactgcctgcccaccgtgcacctcatcgcccccgtccagacctgcatgtccgtgcgcagctgcatgatcgggctgctgtccagccggatccaggtgatctacgagaagacctactgcgtcacgggccagctcatcgaggggctgtgcttcatccccacccacaccatcgcgctgacccagcccggccacacgtacgacaccatgaccctcccggtgacctgcttcctggtggccaagaagctggggacgcagctcaagctggccgtcgagctggagaagctcatcaccggcgtgtcctgcaccgagaacagcttccagggctactacatctgcttcatcgggaagcactccgagcccctgttcgtgcccaccatggaggactaccgcagcgccgagctgttcacgcggatggtcctcaacccccgcggcgaggaccacgacccggaccagaacgggcagggcctgatgcggatcgccggccccgtgaccgcgaaggtgccctccaccgagaccaccgagacgatgcaggggatcgccttcgccggcgcccccatgtacagctccttcagcaccctggtccgcaaggccgacccggagtacgtgttctcccccgggatcatcgcggagagcaaccacagcgtctgcgacaagaagaccgtgcccctcacctggacgggcttcctggccgtgtccggggagatcgagcggatcaccggctgcaccgtcttctgcaccctggccggccccggggccagctgcgaggcctactccgagacgggcatcttcaacatcagctccccgacctgcctcgtgaacaaggtgcagaagttccgcgggagcgagcagcggatcaacttcatgtgccagcgcgtcgaccaggacgtggtggtctactgcaacggccagaagaaggtgatcctgaccaagaccctggtgatcgggcagtgcatctacacgttcacctccctcttcagcctgatccccggcgtcgcgcactccctggccgtggagctctgcgtgcccggcctgcacgggtgggccaccaccgccctgctcatcacgttctgcttcggctggctgctgatccccaccgtcaccctcatcatcctgaagatcctgcggctcctgaccttcagctgctcccactacagcacggagtccaagttcaaggtgatcctggagcgcgtgaaggtcgagtaccagaagaccatggggagcatggtgtgcgacatctgccaccacgagtgcgagaccgccaaggagctggagacccacaagaagtcctgcccggagggccagtgcccctactgcatgacgatcaccgagagcaccgagtccgcgctccaggcccacttcagcatctgcaagctgaccaaccggttccaggagaacctgaagaagtccctcaagcgccccgaggtgaagaaggggtgctaccggacgctgggcgtcttccgctacaagagccggtgctacgtgggcctggtgtgggggatcctcctgaccaccgagctgatcatctgggccgccagcgcggacacgcccctcatggagtccggctggagcgacaccgcccacggggtcggcatcatcccgatgaagaccgacctggagctggacttcgccctcgcctccagctccagctactcctaccgccggaagctggtgaaccccgccaaccaggaggagaccctgcccttccacttccagctcgacaagcaggtcgtgcacgcggagatccagaacctgggccactggatggacgggaccttcaacatcaagacggccttccactgctacggcgagtgcaagaagtacgcctacccgtggcagaccgccaagtgcttcttcgagaaggactaccagtacgagaccagctgggggtgcaacccgcccgactgccccggcgtggggaccggctgcaccgcctgcggcgtgtacctggacaagctccgctccgtcgggaaggcgtacaagatcgtgagcctgaagtacacgcgcaaggtgtgcatccagctgggcaccgagcagacctgcaagcacatcgacgtcaacgactgcctcgtgaccccctccgtgaaggtctgcatgatcgggacgatcagcaagctgcagcccggcgacaccctcctgttcctggggcccctggagcagggcggcatcatcctcaagcagtggtgcaccacctcctgcgtgttcggggaccccggcgacatcatgagcacgacctccgggatgcggtgcccggagcacaccggcagcttccgcaagatctgcgggttcgccaccacgccgacctgcgagtaccagggcaacaccgtgtccggcttccagcggatgatggccacccgcgacagcttccagagcttcaacgtcacggagccccacatcacctccaaccggctggagtggatcgaccccgacagctccatcaaggaccacatcaacatggtgctgaaccgcgacgtgagcttccaggacctctccgacaacccctgcaaggtcgacctgcacacccagagcatcgacggggcctggggctccggggtgggcttcaccctggtgtgcacggtcgggctcaccgagtgcgccaacttcatcaccagcatcaaggcgtgcgactccgccatgtgctacggcgccaccgtgacgaacctgctgcggggcagcaacaccgtgaaggtcgtggggaagggcgggcactccggcagcctcttcaagtgctgccacgacaccgactgcaccgaggagggcctggccgcgtccccgccccacctggaccgcgtgacggggtacaaccagatcgacagcgacaaggtctacgacgacggcgccccgccctgcaccatcaagtgctggttcaccaagtccggggagtggctcctgggcatcctgaacgggaactgggtggtcgtggccgtgctcatcgtcatcctgatcctgagcatcctcctgttctccttcttctgccccgtgcggagccgcaagaacaaggccaactga

SEQ ID NO: 11888 - RNA, 3423 nt, synthetic construct
  misc_feature 1..3423: note = derived and/or modified CDS sequence (opt1) from SNV(CC107/POR)__KT885045.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaccaccttcgaggccaagacgaaggaggtcaacctcaaggggacctgcaacatcccgcccaccaccttcgaggcggcctacaagagccggaagacggtgatctgctacgacctggcctgcaaccagacccactgcctgcccaccgtgcacctcatcgcccccgtccagacctgcatgtccgtgcgcagctgcatgatcggcctgctgtccagccggatccaggtgatctacgagaagacgtactgcgtcaccggccagctcatcgaggggctgtgcttcatccccacccacaccatcgcgctgacgcagcccggccacacctacgacaccatgaccctcccggtgacgtgcttcctggtggccaagaagctggggacccagctcaagctggccgtcgagctggagaagctcatcaccggcgtgtcctgcaccgagaacagcttccagggctactacatctgcttcatcgggaagcactccgagcccctgttcgtgcccacgatggaggactaccgcagcgccgagctgttcacccggatggtcctcaacccccgcggcgaggaccacgacccggaccagaacgggcagggcctgatgcggatcgccggccccgtgaccgcgaaggtgccctccaccgagaccacggagaccatgcaggggatcgccttcgccggcgcccccatgtacagctccttcagcaccctggtccgcaaggccgacccggagtacgtgttctcccccgggatcatcgcggagagcaaccacagcgtctgcgacaagaagaccgtgcccctcacgtggaccggcttcctggccgtgtccggggagatcgagcggatcaccggctgcaccgtcttctgcacgctggccggccccggggccagctgcgaggcctactccgagaccggcatcttcaacatcagctccccgacctgcctcgtgaacaaggtgcagaagttccgcgggagcgagcagcggatcaacttcatgtgccagcgcgtcgaccaggacgtggtggtctactgcaacggccagaagaaggtgatcctgaccaagacgctggtgatcgggcagtgcatctacaccttcacctccctcttcagcctgatccccggcgtcgcgcactccctggccgtggagctctgcgtgcccggcctgcacgggtgggccaccacggccctgctcatcaccttctgcttcggctggctgctgatccccaccgtcaccctcatcatcctgaagatcctgcggctcctgacgttcagctgctcccactacagcaccgagtccaagttcaaggtgatcctggagcgcgtgaaggtcgagtaccagaagaccatggggagcatggtgtgcgacatctgccaccacgagtgcgagaccgccaaggagctggagacgcacaagaagtcctgcccggagggccagtgcccctactgcatgaccatcaccgagagcaccgagtccgcgctccaggcccacttcagcatctgcaagctgacgaaccggttccaggagaacctgaagaagtccctcaagcgccccgaggtgcggaaggggtgctaccgcaccctgggcgtcttccggtacaagagccgctgctacgtgggcctggtgtgggggatcctcctgaccaccgagctgatcatctgggccgccagcgcggacacgcccctcatggagtccggctggagcgacaccgcccacggggtcggcatcgtgccgatgaagaccgacctggagctggacttcgccctcgcctccagctccagctactcctaccggcgcaagctggtgaaccccgccaaccaggaggagaccctgcccttccacttccagctcgacaagcaggtcgtgcacgcggagatccagaacctgggccactggatggacgggacgttcaacatcaagaccgccttccactgctacggcgagtgcaagaagtacgcctacccgtggcagaccgccaagtgcttcttcgagaaggactaccagtacgagaccagctgggggtgcaacccgcccgactgccccggcgtggggaccggctgcacggcctgcggcgtctacctggacaagctccgctccgtggggaaggcgtacaagatcgtgagcctgaagtacacccggaaggtctgcatccagctgggcaccgagcagacctgcaagcacatcgacgtgaacgactgcctcgtgacgccctccgtcaaggtgtgcatgatcgggaccatcagcaagctgcagcccggcgacaccctcctgttcctggggcccctggagcagggcggcatcatcctcaagcagtggtgcaccacgtcctgcgtgttcggggaccccggcgacatcatgagcaccacctccgggatgcgctgcccggagcacaccggcagcttccggaagatctgcgggttcgccacgaccccgacctgcgagtaccagggcaacaccgtctccggcttccagcgcatgatggccacgcgggacagcttccagagcttcaacgtgaccgagccccacatcacctccaaccgcctggagtggatcgaccccgacagctccatcaaggaccacatcaacatggtgctgaaccgggacgtcagcttccaggacctctccgacaacccctgcaaggtggacctgcacacccagagcatcgacggggcctggggctccggggtgggcttcacgctggtctgcaccgtggggctcaccgagtgcgccaacttcatcaccagcatcaaggcgtgcgactccgccatgtgctacggcgccacggtgaccaacctgctgcgcggcagcaacaccgtcaaggtggtggggaagggcgggcactccggcagcctcttcaagtgctgccacgacaccgactgcacggaggagggcctggccgcgtccccgccccacctggaccgggtcaccgggtacaaccagatcgacagcgacaaggtgtacgacgacggcgccccgccctgcaccatcaagtgctggttcaccaagtccggggagtggctcctgggcatcctgaacgggaactgggtcgtggtggccgtcctcatcgtgatcctgatcctgagcatcctcctgttctccttcttctgccccgtgcgcaaccggaagaacaaggccaactga

SEQ ID NO: 11889 - RNA, 3423 nt, synthetic construct
  misc_feature 1..3423: note = derived and/or modified CDS sequence (opt1) from HPS(Convict Creek 107)__L33474.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaccaccttcgaggccaagacgaaggaggtcaacctcaaggggacctgcaacatcccgcccaccaccttcgaggcggcctacaagagccggaagacggtgatctgctacgacctggcctgcaaccagacccactgcctgcccaccgtgcacctcatcgcccccgtccagacctgcatgtccgtgcgcagctgcatgatcggcctgctgtccagccggatccaggtgatctacgagaagacgtactgcgtcaccggccagctcatcgaggggctgtgcttcatccccacccacaccatcgcgctgacgcagcccggccacacctacgacaccatgaccctcccggtgacgtgcttcctggtggccaagaagctggggacccagctcaagctggccgtcgagctggagaagctcatcaccggcgtgtcctgcaccgagaacagcttccagggctactacatctgcttcatcgggaagcactccgagcccctgttcgtgcccacgatggaggactaccgcagcgccgagctgttcacccggatggtcctcaacccccgcggcgaggaccacgacccggaccagaacgggcagggcctgatgcggatcgccggccccgtgaccgcgaaggtgccctccaccgagaccacggagaccatgcaggggatcgccttcgccggcgcccccatgtacagctccttcagcaccctggtccgcaaggccgacccggagtacgtgttctcccccgggatcatcgcggagagcaaccacagcgtctgcgacaagaagaccgtgcccctcacgtggaccggcttcctggccgtgtccggggagatcgagcggatcaccggctgcaccgtcttctgcacgctggccggccccggggccagctgcgaggcctactccgagaccggcatcttcaacatcagctccccgacctgcctcgtgaacaaggtgcagaagttccgcgggagcgagcagcggatcaacttcatgtgccagcgcgtcgaccaggacgtggtggtctactgcaacggccagaagaaggtgatcctgaccaagacgctggtgatcgggcagtgcatctacaccttcacctccctcttcagcctgatccccggcgtcgcgcactccctggccgtggagctctgcgtgcccggcctgcacgggtgggccaccacggccctgctcatcaccttctgcttcggctggctgctgatccccaccgtcaccctcatcatcctgaagatcctgcggctcctgacgttcagctgctcccactacagcaccgagtccaagttcaaggtgatcctggagcgcgtgaaggtcgagtaccagaagaccatggggagcatggtgtgcgacatctgccaccacgagtgcgagaccgccaaggagctggagacgcacaagaagtcctgcccggagggccagtgcccctactgcatgaccatcaccgagagcaccgagtccgcgctccaggcccacttcagcatctgcaagctgacgaaccggttccaggagatcctgaagaagtccctcaagcgccccgaggtgcggaaggggtgctaccgcaccctgggcgtcttccggtacaagagccgctgctacgtgggcctggtgtgggggatcctcctgaccaccgagctgatcatctgggccgccagcgcggacacgcccctcatggagtccggctggagcgacaccgcccacggggtcggcatcgtgccgatgaagaccgacctggagctggacttcgccctcgcctccagctccagctactcctaccggcgcaagctggtgaaccccgccaaccaggaggagaccctgcccttccacttccagctcgacaagcaggtcgtgcacgcggagatccagaacctgggccactggatggacgggacgttcaacatcaagaccgccttccactgctacggcgagtgcaagaagtacgcctacccgtggcagaccgccaagtgcttcttcgagaaggactaccagtacgagaccagctgggggtgcaacccgcccgactgccccggcgtggggaccggctgcacggcctgcggcgtctacctggacaagctccgctccgtggggaaggcgtacaagatcgtgagcctgaagtacacccggaaggtctgcatccagctgggcaccgagcagacctgcaagcacatcgacgtgaacgactgcctcgtgacgccctccgtcaaggtgtgcatgatcgggaccatcagcaagctgcagcccggcgacaccctcctgttcctggggcccctggagcagggcggcatcatcctcaagcagtggtgcaccacgtcctgcgtgttcggggaccccggcgacatcatgagcaccacctccgggatgcgctgcccggagcacaccggcagcttccggaagatctgcgggttcgccacgaccccgacctgcgagtaccagggcaacaccgtctccggcttccagcgcatgatggccacgcgggacagcttccagagcttcaacgtgaccgagccccacatcacctccaaccgcctggagtggatcgaccccgacagctccatcaaggaccacatcaacatggtgctgaaccgggacgtcagcttccaggacctctccgacaacccctgcaaggtggacctgcacacccagagcatcgacggggcctggggctccggggtgggcttcacgctggtctgcaccgtggggctcaccgagtgcgccaacttcatcaccagcatcaaggcgtgcgactccgccatgtgctacggcgccacggtgaccaacctgctgcgcggcagcaacaccgtcaaggtggtggggaagggcgggcactccggcagcctcttcaagtgctgccacgacaccgactgcacggaggagggcctggccgcgtccccgccccacctggaccgggtcaccgggtacaaccagatcgacagcgacaaggtgtacgacgacggcgccccgccctgcaccatcaagtgctggttcacccgctccggggagtggctcctgggcatcctgaacgggaactgggtcgtggtggccgtcctcatcgtgatcctgatcctgagcatcctcctgttctccttcttctgccccgtgcggaaccgcaagaacaaggccaactga

SEQ ID NO: 11890 - RNA, 3423 nt, synthetic construct
  misc_feature 1..3423: note = derived and/or modified CDS sequence (opt1) from HPS(Convict Creek 74)__L33684.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaccaccttcgaggccaagacgaaggaggtcaacctcaaggggacctgcaacatcccgcccaccaccttcgaggcggccttcaagagccggaagacggtgatctgctacgacctggcctgcaaccagacccactgcctgcccaccgtgcacctcatcgcccccgtccagacctgcatgtccgtgcgcagctgcatgatcggcctgctgtccagccggatccaggtgatctacgagaagacgtactgcgtcaccggccagctcatcgaggggctgtgcttcatccccacccacaccatcgcgctgacgcagcccggccacacctacgacaccatgaccctcccggtgacgtgcttcctggtggccaagaagctggggacccagctcaagctggccgtcgagctggagaagctcatcaccggcgtgtcctgcaccgagaacagcttccagggctactacatctgcttcatcgggaagcactccgagcccctgttcgtgcccacgatggaggactaccgcagcgccgagctgttcacccggatggtcctcaacccccgcggcgaggaccacgacccggaccagaacgggcagggcctgatgcggatcgccggccccgtgaccgcgaaggtgccctccaccgagaccacggagaccatgcaggggatcgccttcgccggcgcccccatgtacagctccttcagcaccctggtccgcaaggccgacccggagtacgtgttctcccccgggatcatcgcggagagcaaccacagcgtctgcgacaagaagaccgtgcccctcacgtggaccggcttcctggccgtgtccggggagatcgagcggatcaccggctgcaccgtcttctgcacgctggccggccccggggccagctgcgaggcctactccgagaccggcatcttcaacatcagctccccgacctgcctcgtgaacaaggtgcagaagttccgcgggagcgagcagcggatcaacttcatgtgccagcgcgtcgaccaggacgtggtggtctactgcaacggccagaagaaggtgatcctgaccaagacgctggtgatcgggcagtgcatctacaccttcacctccctcttcagcctgatccccggcgtcgcgcactccctggccgtggagctctgcgtgcccggcctgcacgggtgggccaccacggccctgctcatcaccttctgcttcggctggctgctgatccccaccgtcaccctcatcatcctgaagatcctgcggctcctgacgttcagctgctcccactacagcaccgagtccaagttcaaggtgatcctggagcgcgtgaaggtcgagtaccagaagaccatggggagcatggtgtgcgacatctgccaccacgagtgcgagaccgccaaggagctggagacgcacaagaagtcctgcccggagggccagtgcccctactgcatgaccatcaccgagagcaccgagtccgcgctccaggcccacttcagcatctgcaagctgacgaaccggttccaggagatcctgaagaagtccctcaagcgccccgaggtgcggaaggggtgctaccgcaccctgggcgtcttccggtacaagagccgctgctacgtgggcctggtgtgggggatcctcctgaccaccgagctgatcatctgggccgccagcgcggacacgcccctcatggagtccggctggagcgacaccgcccacggggtcggcatcgtgccgatgaagaccgacctggagctggacttcgccctcgcctccagctccagctactcctaccggcgcaagctggtgaaccccgccaaccaggaggagaccctgcccttccacttccagctcgacaagcaggtcgtgcacgcggagatccagaacctgggccactggatggacgggacgttcaacatcaagaccgccttccactgctacggcgagtgcaagaagtacgcctacccgtggcagaccgccaagtgcttcttcgagaaggactaccagtacgagaccagctgggggtgcaacccgcccgactgccccggcgtggggaccggctgcacggcctgcggcgtctacctggacaagctccgctccgtggggaaggcgtacaagatcgtgagcctgaagtacacccggaaggtctgcatccagctgggcaccgagcagacctgcaagcacatcgacgtgaacgactgcctcgtgacgccctccgtcaaggtgtgcatgatcgggaccatcagcaagctgcagcccggcgacaccctcctgttcctggggcccctggagcagggcggcatcatcctcaagcagtggtgcaccacgtcctgcgtgttcggggaccccggcgacatcatgagcaccacctccgggatgcgctgcccggagcacaccggcagcttccggaagatctgcgggttcgccacgaccccgacctgcgagtaccagggcaacaccgtctccggcttccagcgcatgatggccacgcgggacagcttccagagcttcaacgtgaccgagccccacatcacctccaaccgcctggagtggatcgaccccgacagctccatcaaggaccacatcaacatggtgctgaaccgggacgtcagcttccaggacctctccgacaacccctgcaaggtggacctgcacacccagagcatcgacggggcctggggctccggggtgggcttcacgctggtctgcaccgtggggctcaccgagtgcgccaacttcatcaccagcatcaaggcgtgcgactccgccatgtgctacggcgccacggtgaccaacctgctgcgcggcagcaacaccgtcaaggtggtggggaagggcgggcactccggcagcctcttcaagtgctgccacgacaccgactgcacggaggagggcctggccgcgtccccgccccacctggaccgggtcaccgggtacaaccagatcgacagcgacaaggtgtacgacgacggcgccccgccctgcaccatcaagtgctggttcaccaagtccggggagtggctcctgggcatcctgaacgggaactgggtcgtggtggccgtcctcatcgtgatcctgatcctgagcatcctcctgttctccttcttctgccccgtgcgcaaccggaagaacaaggccaactga

SEQ ID NO: 11891 - RNA, 3423 nt, synthetic construct
  misc_feature 1..3423: note = derived and/or modified CDS sequence (opt1) from BRV(Indiana)__AF030551.1__GP
  source 1..3423: mol_type = other RNA
atggtgggctgggtctgcatcttcctggtggtgctcaccaccgccacggccgggctgacccgcaacctgtacgagctcaagatcgagtgcccccacaccgtcggcctggggcagggctacgtgaccgggagcgtggagacgacccccgtccccctgggccaggtgaccgacctcaagatcgagtccagctgcaacttcgacctgcacgtgccctccaccacgatccagaagtacaaccaggtcgagtgggcgaagaagaccagcaccaccgagtccacgaacgccggcgccagcaccttcgaggccaagaccaaggaggtgaacctgaaggggacctgcaacatccccgtgacgaccttcgaggccgcgtacaagtcccggaagaccgtcatctgctacgacctcgcctgcaaccagacccactgcctgccgacggtgcacctgatcgcccccgtgcagacctgcatgagcgtccgctcctgcatgatcggcctcctgagctcccggatccacgtgatctacgagaagacctactgcgtgaccgggcaggtcgtggagggcctgtgcttcatccccacgcacaccatcgccctcacccagcccgggcacacctacgacacgatgaccctgccgatcacgtgcttcctggtggcgaagaagctcggcacccagctgaagatcgccgtcgagctggagaagctcatcacggccagcggctgcaccgagaactccttccaggggtactacatctgcttcctgggcaagcacagcgagcccctgtacgtgcccaccatggacgactaccgctccgccgagctgttcacccggatggtgctgaaccccaagggggaggaccacgacccggaccaggacggccagggcctgatgcgcatcacggggcccatcaccgccaaggtccccagcaccgagaccaccgagacgatgcagggcgtggcgttcgccgggacccccatgtactccagcttctccaccctcctgcggaaggccgacccggagtacgtcttcagccccggcatcatccccgagagcaaccactccgtgtgcgacaagaagaccatgcccatcacgtggaccgggttcctggccgtgagcggcgagatcgagaagatcaccggctgcaccgtcttctgcacgctcgccgggccgggcgcgtcctgcgaggcctacagcgagaccgggatcttcaacatctccagcccgacctgcctggtgaacaaggtgcagaagttccgcggctccgagcagcgggtcaacttcatgtgccagcgcgtggaccaggacgtggtcgtgtactgcaacgggcagaagaaggtgatcctgaccaagacgctcgtcatcggccagtgcatctacaccttcaccagcctgttctccctgctccccggcgtggcccacagcctggccgtggagctgtgcgtccccgggctccacggctgggccaccacggcgctgctgatcaccttctgcttcgggtggctcctgatcccctccgtgaccctgatcatcctccggatcctgcgcctgctcaccttcagctgctcccactacagcacggagtccaagttcaagatcctgctggagaaggtgaaggtcgagtaccagaagaccatgggcagcatggtgtgcgacatctgccaccacgagtgcgagaccgccaaggagctggacacccaccggaagtcctgccccgaggggcagtgcccctactgcatgacgatgaccgagagcaccgagtccgccctccaggcccacttcagcgtgtgcaagctgaccaaccgcttccaggagaacctgaagaagtccctcaagcaccccgaggtcaagcagggctgctaccggacgctgggcgtgttccgctacaagagccggtgctacgtggggctggtctggggcatcctcctgaccgccgagctgatcatctgggcggccagcgccgagaccccgctcatggagtccgggtggagcgacaccgcccacggcgtgggcatcgtgcccatgaagacggacctggagctggacttcgcgctcgcctccagctccagctactcctaccgccggaagctggtcaaccccgccaacagcgaggagaccctgccgttccacctccagctggagaagcaggtcgtgcacgccgagatccacaacctggggcactggatggacggcaccttcaacatcaagaccgccttccactgctacggggagtgcaagaagtacgcgtacccctggcagacggccaagtgcttcttcgagaaggactaccagtacgagacctcctggggctgcaacccgcccgactgccccggggtgggcaccggctggaccgcctgcggggtgtacctcgacaagctgcgcagcgtgggcaaggcctacaagatcgtctccctgaagtacacccggaaggtgtgcatccagctcgggacggagcagacctgcaagcacatcgacgtgaacgactgcctggtcacccccagcgtgaaggtgtgcatgatcggcaccgtctccaagctgcagcccggggacacgctcctgttcctgggccccctcgagcagggcgggatcatcctgaagcagtggtgcaccaccagctgcgtgttcggcgacccgggggacatcatgtccaccacgagcggcatgaagtgccccgagcacaccgggagcttccgcaagatctgcggcttcgccaccacccccacgtgcgagtaccagggcaacaccgtgtccgggttcaagcgcatgatggcgacccgggacagcttccagtccttcaacgtcaccgagccccacatcacgagcaaccgcctggagtggatcgacccggactccagcatcaaggaccacatcaacgtggtgctcaaccgggacgtctccttccaggacctgagcgacaacccctgcaaggtggacctgcacacccagtccatcgacggcgcctgggggagcggcgtggggttcaccctcgtctgcaccgtgggcctgacggagtgcgccaacttcatcacctccatcaaggcctgcgacctggccatgtgctacggcgcgaccgtgaccaacctcctgcgcgggagcaacacggtcaaggtggtcggcaagggcgggcactccggcagcctgttcaagtgctgccacgacaccgactgcaccgacgaggggctcgccgcctccccgccccacctggaccgggtgaccggcttcaaccagatcgacagcgacaaggtgtacgacgacggggccccgccctgctccgtcaagtgctggttcaccaagagcggcgagtggctgctccgcatcctgaacgggaactggatggtggtggcggtcctgatcgtgatcctcatcctgtccatcctcctcttcagcttcttctgccccatccggagccgcaagtccaagcccaactga

SEQ ID NO: 11892 - RNA, 3423 nt, synthetic construct
  misc_feature 1..3423: note = derived and/or modified CDS sequence (opt1) from BRV(Oklahoma)__AF030552.1__GP
  source 1..3423: mol_type = other RNA
atggtgggctgggtctgcatcttcctggtggtgctcaccaccagcacggccgggctgacccgcaacctgtacgagctcaagatcgagtgcccccacaccgtcggcctggggcagggctacgtgaccgggtccgtggagatcacgccggtccccctgggccaggtgaccgacctcaagatcgagagctcctgcaacttcgacctgcacgtgcccagcaccaccatccagaagtacacgcaggtcgagtgggccaagaagtccagcaccaccgagtccaccaacgcggccgccacgaccttcgaggccaagaccaaggaggtgagcctgaagggcacctgcaacatccccgtgacgaccttcgaggccgcgtacaagtcccggaagaccgtcatctgctacgacctcgcctgcaaccagacccactgcctgccgacggtgcacctgatcgcccccgtgcagacctgcatgagcgtccgctcctgcatggtggggctcctgagctcccggatccaggtgatctacgagaagacctactgcgtcaccggccagctggtggaggggctctgcttcatccccacgcacaccatcgccctgacccagcccggccacacctacgacacgatgaccctgccgatcacctgcttcctcgtggcgaagaagctggggacccagctgaagatcgccgtcgagctcgagaagctgatcacggccagcggctgcaccgagaactccttccagggctactacatctgcttcctggggaagcacagcgagcccatgtacgtgcccaccatggacgactaccgctccgccgagctcttcacccggatggtgctgaaccccaagggcgaggaccacgacccggaccagaacgggcagggcctgatgcgcatcgccggccccatcacggcgaaggtccccagcaccgagaccaccgagaccatgcaggggatcgccttcgccggcgcccccatgtactccacgttcgccaccctcgtgcggaaggcggacccggagtacgtcttcagccccgggatcatccccgagagcaaccactccgtgtgcgacaagaagaccatgcccatcacctggacgggcttcctggccctgagcggggagatcgagcgcatcaccggctgcaccgtgttctgcaccctcgccggcccgggggcctcctgcgaggcctacagcgagacgggcatcttcaacatctccagccccacctgcctggtcaacaaggtgcagaagttccgggggtccgagcagcgcatcaacttcatgtgccagcgggtggaccaggacgtcgtggtgtactgcaacggccagaagaaggtcatcctgaccaagaccctcgtgatcgggcagtgcatctacacgttcaccagcctgttctccctgctccccggcgtggcgcacagcctggccgtcgagctgtgcgtgcccggcctccacgggtgggccaccaccgccctgctgatcacgttctgcttcggctggctcctgatcccggccatcaccctgatcgtgctcaagatcctgcgcctgctcaccttctcctgcagccactactccaaggagagccggttcaagatcctgctggagaaggtcaaggtggagtaccagaagaccatggggtccatggtgtgcgacatctgccaccacgactgcgagacggcgaaggagctggacacccacaagaagagctgccccgagggccagtgcccctactgcatgaccatgaccgagtccacggagagcgccctccaggcccacttctccgtctgcaagctgaccaaccgcttccaggagaacctgaagaagagcctcaagcaccccgaggtgaagcaggggtgctaccggaccctgggcgtgttccgctacaagagccggtgctacgtcggcctggtgtgggggctcctgctgaccacggagctcatcatctgggccgcgtccgccgagaccccgctgatggagagcggctggtccgacaccgcccacggggtgggcatcgtccccatgcgcaccgacctggagctcgacttcgccctggccagctccagctcctacagctaccggcgcaagctggtgaaccccgcgaacacggaggagaccctcccgttccacctgcagctggagaagcaggtggtccacgccgagatccagaacctcggccactggatggacgggaccttcaacatcaagaccgccttccactgctacggcgagtgcaagaagtacgcctacccctggcagacggccaagtgcttcttcgagaaggactaccagtacgagacctcctgggggtgcaacccccccgactgcccgggcgtggggaccggctgcaccgcgtgcggcgtgtacctggacaagctgcggagcgtcgggaaggcctacaagatcgtgtccctcaagtacacccgcaaggtgtgcatccagctgggcacggagcagacctgcaagcacatcgacgtcaacgactgcctggtgagcccctccgtgaaggtctgcatgatcgggaccgtgagcaagctccagcccggcgacaccctgctgttcctcgggcccctggagcagggcggcatcatcctgaagcagtggtgcacgacctcctgcgtgttcggggacccgggcgacatcatgagcaccacctccgggatgcgctgccccgagcacacgggcagcttccggaagatctgcgggttcgccaccacccccacctgcgagtaccagggcaacacgatcagcggcttcaagcgcatgatggccacccgggactccttccagagcttcaacgtcaccgagccccacatcacctccaaccgcctcgagtggatcgacccggacagctccatcaaggaccacatcaacgtggtgctgaaccgggacgtcagcttccaggacctgtccgacaacccctacaaggtggacctccacacgcagagcatcgacggggcctggggctccggggtgggcttcaccctggtctgcatcgtggggctgaccgagtgcgcgaacttcatcaccagcatcaaggcctgcgacatggccatgtgctacggcgccacggtgaccaacctcctgcgcggctccaacaccgtcaaggtggtggggaagggcgggcacagcggctccctgttcaagtgctgccacgacaccgactgcacggaggagggcctcgcggccagccccccccacctggaccgggtcaccgggtacaaccagatcgactccgacaaggtgtgcgacgacggcgccccgctgtgcagcgtcaagtgctggttcaccaagtccggggagtggctcctgggcatcctgaacgggaactggatggtggtggccgtcctcgtggtgatcctgatcctgagcatcctcctgttctccttcttctgccccatccgcagcaagaagagcaagcccaactga

SEQ ID NO: 11893 - RNA, 3399 nt, synthetic construct
  misc_feature 1..3399: note = derived and/or modified CDS sequence (opt1) from THAIV(Thai749)__L08756.1__GP
  source 1..3399: mol_type = other RNA
atgtggggcctgctcgtgatcgccgtcctggtggggcccggcttcgccatcaagaacgtgtacgacatgaagatcgagtgcccgcacagcgtcaacttcggggagacctccgtgaccggccaggtggagctgcccgccctccccatcacggaggccgagcagctggtccccgagagctcctgcaacatggacaaccaccagagcctggccaccatcaacaccctcaccaaggtgtcctggcgcaagaaggccgaccaggtgagcgcctcccagaacagcttcgaggtcatcgaggcggagacgtccttcaaggggctgtgcatgctgaagcaccggatgatcgaggagagcttcaagaaccgccggtccgtgatctgctacgacctcagctgcaacaccaccttctgcaagccgaccgtgtacatggtcgtgcccgtgcacgcctgcaacatgatgaagtcctgcctggtcggcctgggcccctaccgcgtccaggtggtgtacgagcggacgtactgcaccgtggggatcctcaccgagggcaagtgcttcatccccgacaagaccatcctgagctccatcaagcgcgggatgttcgtggtcacgagcgtccaggtgctgtgcttcttcatcgtgcagaagggccactcctacaagatcatggacgaggtgaagaagtccatgatgaacaagtgcaacgacaccgagaacaaggtccaggggtactacatctgcatcctcggcggcaacagcgccccggtgtacgtgcccagcctggacgacttccggagcatggagatcttctccaacatgctgcgcagccccttcggggaggaccacgacctccccggcgaggagttctccacctaccagatcgccgggccgaccgaggcgaaggtcccccacacggccagctccaagaacctggccctgatcgcctacagcggcaacccctcctacagctccctcagcctgatcacctccagccaggacggccggtacgtgttctcccccgggctgttcccgaacctcaaccagacccagtgcgagaagaacgccctgcccatggtgtggcgcggcatgatcgacctgagcgggtactacgaggcgatccacccctgcaacatcttctgcgtcctctccggccccggggccagctgcgaggccttctccgagggcggcatcttcaacatcaccagcccgacgtgcctggtgtccaagcagaaccggttccgcgccgccgagcagcagatcaacttcgtgtgccagcgggtcgacatggacatcgtggtgtactgcaacgggcagaagaagaccatcctgaccaagaccctcatcatcggccagtgcatctacacgatcaccagcctgttcagcctgctccccggggtcgcgcactccatcgccatcgagctgtgcgtgcccggcttccacgggtgggccaccgccgccctgctcatcaccttctgcttcggctggatcctgatccccacgatcaccctggcggtgctcgtcgtgctgaagttcatcgccaacatcctgcacaccaacagccaggagaaccgcttcaagctcatcctgaagaaggtgaaggaggagttcgagaagaccaagggctccatggtctgcgaggtgtgcaagtacgagtgcgagacgagcaaggagctgaaggcccacaacctctcctgcccgcagagcaagtgcccctactgcttcacccactgcgagcccaccgaggccaccttcaaggcccactacaaggtgtgccaggcgacgcaccggttccgcgaggacctgaagaagaccgtcacgccccagaccgtggggccgggctgctaccggaccctgaacctcttccgctacaagtcccggtgctacatcctgaccatgtggctgttcctgctcagcatcgagtccatcatgtgggccgccagcgccgcggagatccccctggtgcccctgtggaccgacaacgcccacgggatcggctccgtcccgatgcacaccgacctcgagctggacttcagcctgccctccagctccaagtacacctacaagcgcaagctcacgaaccccgtgaacaccgagcagggggtgcagctgcacatcgagatcgaggagcagggcatcggcgccgacgtccaccacctggggcactggttcgacgcccggctcaacctgaagaccagcttccactgctacggcgcctgctccaagtaccagtacccctggcacaccgcgaagtgccacttcgagaaggactacgagtacgagaacagctgggcctgcaacccggccgactgccccggggtgggcacgggctgcaccgcctgcgggctgtacctcgaccagatgaagcccatcggcaccgcctacaagctggtggcgatccgctacagccgcaaggcctgcgtccagttcggggaggagcacctgtgcaagaccatcgacatgaacgactgcttcgtgacgcggcacgtgaagatctgcatcatcggcaccgtctccaagttcatccagggggacaccctcctgttcctgggccccctcgagggcgggggcctgatcttcaagcactggtgcaccagcacgtgccagttcggggacccgggcgacatcatgtcccccaaggacaagcccttcctgtgccccgagttcccggggcagttccgcaagaagtgcaacttcgccaccacccccgtgtgcgagtacgacggcaaccagatcagcggctacaagaagatgaaggccaccatcgactccttccagagcttcaacacgtccagcatccacttcaccgacgagcggctcatggaggaccccgacgggatgctgcgcgaccacatcaacatcgtggtcaccaaggacatcgacttcgagaacctggccgagaacctctgcggcatcgggctccaggtgtccgcgatcaagggcgcctgggggagcggcgtgggcttcaccctgacgtgccaggtctccctgaccgagtgccccaccttcctgaccagcatcaaggcctgcgacatggccatctgctacggggcggagtccgtgacgctggtgcggggccagaacaccgtcaagatcagcgggaagggcgggcactccggcagctccttcaagtgctgccacggcgtggactgcagctccaacgggctccaggccaacccgccccacctggaccgcgtggccggcgtcagcgagctgaccaacgagaaggtgtacgacgacggggcgccccagtgcggcatcgcctgctggttcatcaagagcggcgagtgggtgaaggggatcttctccggcaactggatcgtcctcatcgtgctgtgcgtgctgctcctgatcagcctgatcctcctggggatcttctgccccgtccggaagcacaagaagtcctga

SEQ ID NO: 11894 - RNA, 3426 nt, synthetic construct
  misc_feature 1..3426: note = derived and/or modified CDS sequence (opt1) from TULV(Moravia/5302v/95)__NC_005228.1__GP
  source 1..3426: mol_type = other RNA
atgttctgcctgtgcctcagcctgctgggcctcctgctgtgctggcccgccgccacccgcaacctcctggagctgaaggtggagtgcccgcacaccatcgggctcggccaggggatcgtcatcggctccgcggagctgccgcccgtgcccctggccaaggtggagagcctcaagctggagtccagctgcaacttcgacctgcacacgtccaccgccgcccagcaggccttcaccaagtggagctgggagaagaaggcggacaccgccgagaacgccaaggccgcgtccacgaccttccagagctccagcaaggaggtccagctccgggggctgtgcgtgatccccaccctggtgctcgagaccgcctcccgcacgcggaagaccgtgacctgcttcgacctgagctgcaaccagaccgtctgccagcccacggtgtacctgatggcccccatccagacctgcgtcaccaccaagtcctgcctcctgggcctgggcgaccagcgcatccaggtggtgtacgagaagacgtactgcgtcagcgggcagctcatcgagggcaactgcttcaaccccctgcacaccatcgccatctcccagccgacccacacctacgacatcatgacgctggccgtgcactgcttcttcatcagcaagaagggcgggaccgacgacaccctcaagatcgagaagcagttcgagaccctggtggagaagacggggtgcaccgagaacgcgctgaagggctactacgcctgcatcctcggcacctccagcgaggtcgtgtacgtgcccgccatggacgactaccggtccagcgagatcctgagccgcatgaccacggcgccccacggggaggaccacgacatcgaccccaacgccatctccagcctgcggatcgtcggccagctcaccgggaaggccccgtccaccgagagctccgacaccgtgcagggcatcgccttcgccggcacgcccctgtacaccagcacctccatcctggtgcgcaaggaggaccccatctacctctggagccccgggatcatcccggagggcaaccactcccagtgcgacaagaagaccctgcccctgacgtggaccgggttcatcaccctccccggcgagatcgagaagaccacccagtgcacggtcttctgcaccctgagcgggcccggcgccgactgcgaggcctactccgacaccggcatcttcaacatcagctccccgacctgcctggtgaaccgggtgcagcgcttccgcggggcggagcagcaggtcaagttcgtgtgccagcgggtcgacctcgacatcacggtgtactgcaacggcgtgaagaaggtcatcctgaccaagaccctggtgatcgggcagtgcatctacaccttcacgagcatcttctccctcatgcccggcgtggcccacagcctggccgtcgagctgtgcgtgcccgggctccacggctgggccaccatctccctgctgatcaccttctgcttcggctggctggccatccccctcctgagcatgatcatcatccggttcctgctcatcttcacctacctgtgctccaagtacagcacggacagcaagttcaagctgatcatcgagaaggtgaagcaggagtaccagaagaccatggggtccatggtctgcgaggtgtgccagcagggctgcgagaccgcgaaggagctcgagagccacaagaagtcctgcccgcacgggcagtgcccctactgcctgaaccccaccgaggccacggagagcgccctgcaggcccacttcaaggtgtgcaagctcaccacccgcttccaggagaacctgaagaagtccctgagcacctacgagcccaagcggggcctctaccgcacgctgtccatgttccggtacaagagcaagtgctacgtcgggctggtgtggtgcatcctcctgaccatggagctgatcgtgtgggcggcctccgccgagaccatcaacctcgagccgggctggaccgacacggcccacggcagcgggatcatccccctgaagaccgacctggagctcgacttctccctgcccagctccgccacctacacctaccgccgggagctgcagaacccggcgaacgagcaggagaagatccccttccacttccagatggagcgccaggtcatccacgccgagatccagcacctcggccactggatggacgggacgttcaacctgaagaccgccttccactgctacggcagctgcatcaagtacgcctacccctggcagaccgccaagtgcttcctggagaaggacttcgagttcgagaccggctgggggtgcaacccgcccgactgccccggcgtggggacgggctgcaccgcgtgcggggtgtacctcgacaagctgcggtccgtcggcaaggtgtacaagatcctgagcctcaagtacacccgcaaggtgtgcatccagctgggcaccgagcagacgtgcaagaccatcgactccaacgactgcctggtcaccaccagcgtgaaggtgtgcatgatcgggaccatcagcaagttccagcccggcgacacgctcctgttcctggggcccctcgaggagggcgggatgatcttcaagcagtggtgcaccacgacctgccagttcggcgacccgggcgacatcatgtccacgcccctggggatgaagtgccccgagcacgccggcagcttccgcaagaagtgctccttcgccaccctgcccagctgccagtacgacgggaacaccgtctccggctaccagcggatgatcgccaccaaggacagcttccagtccttcaacatcaccgagccgcacatcaccaccaacagcctcgagtgggtggaccccgactccagcctgaaggaccacgtgaacctgatcgtcaaccgcgacctctccttccaggacctggccgagaacccctgccaggtggacctgagcgtgtccagcatcgacggggcgtggggctccggcgtcgggttcaacctcgtgtgcagcgtgtccctgaccgagtgcgccagcttcctgacgtccatcaaggcctgcgacagcgccatgtgctacggcagctccaccgcgaacctcgtccgggggcagaacaccgtgcacgtggtcggcaagggcgggcacagcggctccaagttcatgtgctgccacgacaagaagtgcagcgccaccgggctggtggccgccgcgccccacctggaccgcgtgacgggctacaaccagatcgacaccaacaaggtcttcgacgacggggccccgcagtgcggcgtgcactgctggttcaagaagtccggcgagtggctcctggggatcctgagcggcaactggatggtggtcgccgtgctcatcgccctgttcatcttctccctgctcctgttcagcctgtgctgcccccggcgccagaactacaagaagaacaagtga

SEQ ID NO: 11895 - RNA, 5055 nt, synthetic construct
  misc_feature 1..5055: note = derived and/or modified CDS sequence (opt1) from CCHFV(10200)__U39455.2__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctccagcacgtgcctgcacaaggagtggccccactcccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 11896 - RNA, 5055 nt, synthetic construct
  misc_feature 1..5055: note = derived and/or modified CDS sequence (opt1) from CCHFV(IbAr10200)__AF467768.2__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccccggggacaacccgagctccgagccccccgtgagcacggccctgtccatcaccctggaccccagcaccgtcaccccgacgacccccgcgtccggcctcgaggggagcggcgaggtgtacacctccccccccatcaccacgggcagcctgccgctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccgtccggcaccggcaaggagagctccgccaccagctccccccaccccgtgagcaaccggcccccgacgccccccgcgaccgcccaggggcccaccgagaacgactcccacaacgccaccgagcacccggagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacctgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtgtccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggggccatcaacgtgcagagcacctacaagcccaccgtgtccaccgccaacatcgcgctgagctggagctccgtcgagcaccgcggcaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacctgcaccggcgactgccccgagcgctgcgggtgcacgagctccacctgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccccccgagatcatcaccctccacccgcgcatcgaggaggggttcttcgacctgatgcacgtgcagaaggtcctgagcgcgtccaccgtgtgcaagctccagagctgcacgcacggcgtccccggggacctgcaggtgtaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagagcttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctga

SEQ ID NO: 11897 - RNA, 5067 nt, synthetic construct
  misc_feature 1..5067: note = derived and/or modified CDS sequence (opt1) from CCHFV(Turkey-Kelkit06)__GQ337054.1__GP
  source 1..5067: mol_type = other RNA
atgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgacccccccccacgcccccgagtccagcaccatcaagccgaccacgcccatctccgaggccgaggggagcggcgagaccacctccccccccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccccacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacctgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctgcaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggccacctgcaccggggactgcccggagcggtgcggctgcacgtccagcacctgcctccacaaggagtggtcccacagccgcaactggcggtgcaaccccacctggtgctggggggtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccccagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtgaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacctgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctga

SEQ ID NO: 11898 - RNA, 5103 nt, synthetic construct
  misc_feature 1..5103: note = derived and/or modified CDS sequence (opt1) from CCHFV(UCCR4416)__KY484026.1__GP
  source 1..5103: mol_type = other RNA
atgttcctgcacttcaagttcatgctcctgaccaacttcttcttctgccagctgctctggggcgggggcggggtggccagcggcgggcgcaccaacacgtccagcacccagaccaccctgatctccagcaacacgctgaactccaccatgagcgtcctcgagtccagcatcggcaccgccaccgagacggtgccctccaccaccaccaacacgccggacacccaggtgaccaccgacagcggctccggggagagctccacggacccccagaccaccagcaaggaggtcccctccaccagcgtggcgacgatcaagacccaggagtccgagacccaccgggcccagaaccccagcaccacggccggctccggggccagcaccccgagcaacaccacctccaacaagcccgacgtgaacagcctgacgtcccccatcctggaggccaagagctcccccagcccgtccaagaccagcatgccccagaccgcgcaccacctctcccgcagcctgctgtccgccgccaccacggagaccaaccaggccgcgagcgtcatgaccaccacgcgggagaccaccaccatgtccagccccaccacggtgaagaactccgtgaccgccatccccacccagggcatcaccacgagcaacacctccaagcagaccgacaccatcacgctcgagatcagcccgaagatccagaccacccagtcccagcagaccgccacgcccgccatcgcccccgcgaccaccgccatcgccttcatcagccccaccaaccgcagcaagcgggagtccaaggtccagatcatcctgacgttcagccaggggctgaagaagtactactccaagatcctcaagctgctgcacctcacccaggaggaggacagcgagggcctgctggagtggtgcacccgcgtgctcgagcaggcctgcaacgacgactacttcaacgagcggatcgaggagttcttcatcaccggcaaggggtacttcaacgacgtgctgcagttccgcctgtacgacacgctctccaccaccgagagcacccagaacacgtccccgaccgccaagcccttccggagctactacgcgaagggctccctgaccttcgacagcgggtacttctccgccaagtgctacccccgcgccagcaactccggcctgcagctcatcaacgtcacccagcacagcgtgaagatcgccaacacgcccggcccgaagatctccaaccccaagaccatcaactgcatcaacctgaaggtgagcaccgacaaggaccactccaagctggagatcaacgtcctcctgccccaggtggccgtgaacctgagcaactgccacgtcctcatcgagagccacgtgtgcgactactccctggacaccgacgggacgatcaagctgcccaagatcacccacaacggcgcgttcatcccggggacctacaagatcgtgatcgacaagaagaacaagctcaacgaccggtgcgccctgttcaccaactgcgtcatcaagggccgcgaggtgcggcgcgggcagagcgccctgcggcagtaccgcacggagatccggatcggccagaccttcaccggctcccgccggctcctggccgagggcgggagcaacgactgcgtgtcccgcacccagctggtcaagaccgaggtggccgagatccacgaggacagctacgggggccccggggagaagatcacgatctgcaacggctccaccatcgtcgaccagcggctcggcagcgagctggggtgctacaccatcaaccgcgtgcgcacctacaagctgtgcgagaactccgcgacggagaagtcctgcgagatcgacagcgtgcccgtcaagtgcaagcagggcttctgcctcaagatcacccaggaggggcggggccacgtgaagctgagccgcgggaccgagatcgtgctggacgtctgcgacacctcctgcgagctcatgatccccaagggcacgggcgacatcctggtggactgcagcgggggccagcagcacttcctgcaggacaacctgatcgacctcgggtgcccgaacatccccctgctgggccggaccgccatctacgtgtgccgcatgtccaaccaccccaagaccaccatggccttcctcttctggttcagcttcggctacgtcatcacgtgcgtggtgtgcaaggtcctgttctacctgctcatcgtgatcgggaccctgggcaagcggctgaagcagtaccgcgagctcaagccgcagacctgcatcgtgtgcgagtccatccccgtcaacgccatcgacgcggagatgcacgacctgaactgcaactacaacatctgcccctactgcgccagccggctgacctccgacgggctcgtgcgccacgtgacgcagtgccccaagcggaaggagaaggtcgaggagaccgagctgtacctgaacctcgagcgcatcccgtggctggtgcggaagctgctccaggtgagcgagagcaccggcgtcgccctgaagcgctcctgctggatgatcaccctgctcatcctgctgacggtgagcatgtcccccgtgcagagcgcccccgtcgggcacaagcgggccgtggaggtgtaccagatgcgcgagtcctacaccggcatctgcctcttcgtcctgggcagcgtgctgttcgcggtgtcctggctcgtcaaggccctgatcgacagcatcgggaactccttcttccccggcctgagcatctgcaagacctgctccatcgggagcatcaacggcttcgagatcgagtcccacaagtgctactgcagcctcttctgctgcccgtactgccgggcctgctccagcgacaagatcacccaccgcatgcacctgaacgtgtgcaagaagcggaaggtggggtccaacgtcatgctggccgtgtgcaagcgcatgtgcttcaaggccacgatcgaggcgagcaaccgggccaccttcatccgcaacatcatcaactccaccttcgtgatctgcatcctcatcctggtcatctgcgtggtgagcaccagcgccgtcgacatggagaacctgcccgccggcatctgggagaaggaggaggacctcacgaacttctgccaccaggagtgccaggtgaccgagaccgagtgcctgtgcccctacgaggccctgatgctccgcaagcccctgttcctggaccggatcgcgaagggcatgaagtccctcctgaacagcacctccctggagacgagcctctccatcgaggccccgtggggcgccatcaacgtgcagagcaccttcaagcccaccgtctccgccgcgaacatcgccctgagctggtccagcgtggagcacaaggggaacaagatcctggtgtccgggcgcagcgagtccatcatgaagctcgaggagcggaccggcatcagctggtgcctgggggtcgaggacgcctccgagagcaagacgctgaccgtgtccgtgatggacctcagccagatgtactcccccgtcttcgagtacctgagcggcgaccgccaggtggaggagtggcccaaggcgacctgcaccggcgactgcccggagcggtgcgggtgcaccagctccacgtgcctgcacaaggagtggccccacagccgcaactggcggtgcaaccccacctggtgctggggcgtggggaccggctgcacgtgctgcgggctcgacgtcaaggacctgttcaccgactacatgctggtgaagtggaaggtcgagtacatcaagaccgaggccatcatctgcgtggagctcacctcccaggagcgccagtgcagcctgatcgaggccggcacccggttcaacctgggccccgtgacgatcaccctctccgagccgcgcaacgtccagcagcggctgccgcccgagatcatcaccctgcaccccaagatcgaggaggggttcttcgacctcatgcacgtgcagaaggtgatgagcgcctccaccgtctgcaagctgcagagctgcacgcacggcgtgcccggggacctccaggtgtaccacgtcggcaacctcctgaagggcgacaaggtgaacgggcactccatccacaagatcgagagccacctgaacacctcctggatgagctgggacggctgcgacctcgactacttctgcaacatgggggactggccctcctgcacctacaccggcgtgacgcagcacaaccacgccgccttcatcaacatgctgaacatcgagaccgactacaccaagaccttccacttccacagcaagcgcgtcacggcccacggggacacgccccagctggacctcaaggcgcggccggcctacggcgccggcgagatcaccgtgctggtggaggtcgccgacctggagctccacaccaagaagatcgaggtgtccgggctgaagttcgccagcctgtcctgcagcggctgctacgcgtgctccagcgggatcagctgcaaggtgcgcatccacgtcaacgagcccgacgagttcaccgtgcacgtgaagtccaacgaccccgacgtcgtggccgccggcagctccctcatggcccggaagatcgagagcggggcggactccaccttcaaggccttcagctccatgcccaagaacagcctgtgcttctacatcgtggagcgcgactactgctccagctgcaccgacgacgacacccagaagtgcgtcgacatcaagctggagcacccgcagtccatcctcatcgagcacaagggcacgatcatcggcaagcagaacgacacgtgccccaccaagaccagctgctggctggagtccatcaagagcttcttctacgggctgaagaacatgctctccggcatcttcgggaacgtgttcctgggcatgctgctgttcctggcccccttcatcctgctcatcctgttcttcttcttcgggtggcggctcctgttctgcctgaagtgctgccgccggacccgcaagctgctgaagtacaagcacctccgggacgaggaggagagcggctacaagaagatcatcgagcgcctgaacgacaagaagggcaagtcccgcctgttcgacggggagcggctcgccgaccgcaagatcgccgagctgttcagcaccaagacccacatcggctga

SEQ ID NO: 11899 - RNA, 5103 nt, synthetic construct
  misc_feature 1..5103: note = derived and/or modified CDS sequence (opt1) from CCHFV(ArD15786)__DQ211627.1__GP
  source 1..5103: mol_type = other RNA
atgttcctgcacttcaagttcgtgctcctgaccaacttcttcttctgccagctgctctggggcgggggcggggtcaccagcggcgggggcacgaacacctccagcacccaggccatcctgatctccagcaacacccccaactccacgatgagcgtgctggagtccagcaccggcaccgccgcggagaccgtgccgtccacgaccatcaacacccccgacacccaggtcacgaccgacagcgggtccggcgagagctccaccgacccccagaccacgaacggggaggtgcccagcacctccatcgccaccatcaagacccaggagagcgagacgcgccggacccagaacctctccaccaccgccggcagcggggcctccacgccgggcaacaccaccagcaacaagcccgacgtgaacctgctgaccagccccatctccgaggccaagagctcccccagcccgtccaagacgagcacgccccagaccgcgcaccacctctcccgcagcctgctgtccgccgccaccaccgagaccagccaggccgcgtccgtcatgaccaccacgcgggagaccaccaccatgagctcccccaccacggtgaagaacagcgccaccgccacccccacccagggcatcacgacctccaacaccagcaagcagaccgacacgaccaccctcgagatcccgcccaagatccagaccacgcagtcccagcagaccgccacccccgccatcacccccgcgacgaccgccatcgccttcatcagcccgaccaaccgctccaagcgggagagcaaggtgcagatcatcctgaccttcagccaggggctgaagaagtactactccaagatcctcaagctgctgcacctcacgcaggaggaggacagcgagggcctgctggagtggtgcacccgcgtcctcgagcaggcctgcgacgacgactacttcaacgagcggatcgaggagttcttcatcaccgggaagggctacttcaacgacgtgctgcagttccgcctgtacgacaccttctccacgaccgagagcacccagaacacctcccccacggccaagcccttccggagctactacgcgaagggctccctcaccttcgacagcgggtacttctccgccaagtgctacccccgcgccagcaactccggcctgcagctgatcaacgtgacccagcacagcgtcaagatcgccaacaccccggggcccaagatctccaaccccaagacgatcaactgcatcaacctcaaggtgagcaccgacaaggaccactccaagctggagatcaacgtgctgctcccccaggtcgccgtgaacctgagcaactgccacgtgctgatcgagtcccacgtctgcgactacagcctcaacaccgacggcaccatcaagctgccgaagatcgcgcacaacggggccttcatccccggcacgtacaagatcgtgatcgacaagaagaacaagctgaacgaccggtgcgccctcttcaccaactgcgtgatcaagggccgcgaggtccggcgcgggcagagcgccctgcggcagtaccgcaccgagatccggatcggccagaccttcaccgggtcccgccggctgctcgccgagggcgggagcaacgactgcgtgtcccgcacgcagctggtgaagaccgaggtcaccgagatccacgaggacagctacggcggccccggggagaagatcaccatctgcaacggctccacgatcgtggaccagcggctggggagcgagctcggctgctacaccatcaaccgcgtccgcacctacaagctgtgcgagaactccgcgaccgagaagtcctgcgagatcgacagcgtgcccgtgaagtgcaagcaggggttctgcctgaagatcacgcaggagggccggggccacgtcaagctcagccgcgggaccgagatcgtgctggacgtgtgcgacacctcctgcgagctgatgatcccgaagggcaccggggacatcctcgtcgactgcagcggcggccagcagcacttcctgcaggacaacctgatcgacctggggtgccccaacatccccctcctgggccagacggccatctacgtgtgccggatgtccaaccacccgaagaccaccatggccttcctgttctggttcagcttcgggtacgtgatcacgtgcgtcgtgtgcaaggtgctgttctacctgctgatcgtcatcggcaccctcgggaagcgcctgaagcagtaccgggagctgaagccccagacctgcatcgtgtgcgagtccatccccgtgaacgccatcgacgcggagatgcacgacctcaactgcaactacaacatctgcccctactgcgccagccgcctgacctccgacggcctggtccggcacgtgacccagtgcccgaagcgcaaggagaaggtggaggagacggagctctacctgaacctggagcggatcccctggctcgtccgcaagctgctccaggtgagcgagtccaccggcgtggccctcaagcggagctgctggatcatcaccctgctgatcctcctgaccgtcagcatgtcccccgtgcagagcgcccccgtggggcacaagcgcgccgtcgaggtgtaccagatccgggagtcctacacgggcatctgcctgttcgtgctcgggggcgtcctgttcgcggtgagctggctggtgaaggccctcatcgactccatcgggaacagcttcttcccgggcctgtccatctgcaagacctgcagcatcggctccatcaacgggttcgagatcgagagccacaagtgctactgctccctgctctgctgcccctactgccgcgcctgcagctccgacaagatcacccaccggatgcacctgaacgtctgcaagaagcgcaaggtgggcagcaacgtgatgctggccgtctgcaagcggatgtgcttcaaggccaccatcgaggcgaacaaccgcgccacgttcatccggaacatcatcaactccaccttcgtgatctgcatcctcatcctggtgatctgcgtcgtgagcacctccgccgtggacatggagaacctgcccgccgggatctgggagaaggaggaggacctcaccaacttctgccaccaggagtgccaggtcacggagaccgagtgcctgtgcccctacgaggccctgatgctccgcaagccgctgagcctggactccatcgcgaagggcatgaagtccctcctgaacagcaccagcctggagaccagcctctccatcgaggccccctggggcgccatcaacgtgcagagcacgttcaagcccaccatctccgccgcgaacatcgccctgagctggtccagcgtggagcacaaggggaacaagatcctggtctccggccgcagcgagtccatcatgaagctcgaggagcggaccgggatcagctggtgcctgggcgtggaggacgcctccgagagcaagaccctgaccgtgtccgtcatggacctcagccagatgtactcccccgtgttcgagtacctgagcggggaccgccaggtggaggagtggccgaaggccacgtgcaccggcgactgccccgagcggtgcgggtgcacctccagcacgtgcctgcacaaggagtggccccacagccgcaactggcggtgcaaccccacctggtgctggggcgtcggcaccgggtgcacgtgctgcggcctcgacgtgaaggacctgttcaccgactacatgctggtgaagtggaaggtcgagtacatcaagaccgaggccatcatctgcgtggagctcacctcccaggagcgccagtgcagcctgatcgaggcggggacccggttcaacctgggcccggtcaccatcacgctctccgagccccgcaacgtgcagcagcggctgccgcccgagatcatcaccctgcaccccaagatcgaggagggcttcttcgacctcatgcacgtgcagaaggtcatgagcgcctccaccgtgtgcaagctgcagagctgcacccacggggtgcccggcgacctgcaggtctaccacgtggggaacctcctgaagggcgacaaggtgaacgggcactccatccacaagatcgagagccacctgaacacgtcctggatgagctgggacggctgcgacctcgactacttctgcaacatgggcgactggccctcctgcacctacaccggggtcacccagcacaaccgcgccgccttcatcaacatgctgaacatcgagacggactacaccaagaccttccacttccacagcaagcgggtgaccgcccacggcgacacgccgcagctggacctcaaggcgcgccccacctacggggccggcgagatcaccgtgctggtcgaggtggccgacctggagctccacaccaagaagatcgaggtgtccgggctgaagttcgccagcctgacgtgctccggctgctacgcctgcagctccggcatcagctgcaaggtccggatccacgtgaacgagcccgacgagttcaccgtgcacgtcaagtccaacgaccccgacgtggtggcggccgggagcagcctcatggcccgcaagatcgagtccggcgccgacagcaccttcaaggcgttctccagcatgccgaagaactccctgtgcttctacatcgtcgagcgggactactgcagctcctgcaccgacgacgacacgcagaagtgcgtggacatcaagctggagcacccccagagcatcctcatcgagcacaaggggaccatcatcggcaagcagaacgacacgtgccccaccaagacctcctgctggctggagagcatcaagtccttcttctacgggctgaagaacatgctcagcggcatcttcggcaacatcttcctggggatgctgctgttcctggcccccttcgtgctgctcatcctgttcttcttcttcggctggcgcctcctcttctgcctgaagtgctgccggcgcacccggaagctgctgaagtacaagcacctccgcgacgaggaggagtccgggtacaagaagatcatcgagcggctgaacgacaagaagggcaagagccgcctgttcgacggcgagcgcctcgccgaccggaagatcgccgagctgttctccaccaagacccacgtcgggtga

SEQ ID NO: 11900 - RNA, 5100 nt, synthetic construct
  misc_feature 1..5100: note = derived and/or modified CDS sequence (opt1) from CCHFV(UCCR4432)__KY484047.1__GP
  source 1..5100: mol_type = other RNA
atgttctgcctgcgcctcgtgctgctgatcaacctcgccctgtgccagctgctcgagggcaacgacggggtcaccagcgccgacgagatcaactccaacaccacgcagaccagcctgggcctgcccaccatcctcaactccaccacgccggcgcccgggcccagcatcgacgccaccatggaggccgtgcccggcaccaccaactccgtgctggagacgcaggtcaccatggacagcgggtccggcgagctgagcaccgacccgaccacgacccgggaggccaccacccccatcacggccgcgaccgtgtccgcccaggagaccaagacccacatgacgcagaaccccggcaccaccgtggaccccgacaccacgaccagcaacaccaccacgtccatcgagccgatcaccaccccgcccaccagccccacgccccaggccacccccaccccctcctacagcgagacccccacgctcccgaacacccaccacctgtcccgcagcctgctctccgccgtcgggaccgaggcgggccagaccgcccccgccacccccacggccgaggtggccctggcgcccgggggcagctccaccgccgagagcaacaccatcagcatcccggcccaggacaccacgatctccggggtgagcaagcaggacaaccccaccaccaccggcatctcccccgaggcccagacgatgcagagccagcaggccgtcgcgcccgtgaccaccccggccaccgccatctccgcccccacgagccccaccaaccggtccaagcgcgagagcaaggtgcagatcatcctgaccttcccccagggcctcaagaagtactactccaagatcctgaagttcctgcacctcacccaggaggaggacagcgaggggctgctggagtggtgcacgcgggtcctccagcaggtctgcgacgacacctacttcaacgagcgcatcaaggagttcttcatcaccggcaaggggtacttcaacgacgtgctgcagttcaagctgcacgacaccccggccacgaccgtccccgcgctcgccgcctccagcaccgccatgcccttccggtcctactacgccaagggcagcctgaccctggactccggctacttcagcgcgaagtgctacccgcgcgcctccaacagcgggatgcagctcatcaacgtgacgcagcaccccatgaagatcgccaacacccccggccccaagatctccaacctgaagaccatcaactgcatcaacctgaaggtgagcaccgacaaggagcacagcgagctcgagatcaacgtcctgatcccccaggtggccgtgaacctgtccaactgcttcgtcagcatcaagtcccacgtgtgcgactacagcctcgacacggacggggcgatccggctgcccaaggtggcccacaacggcgtcttcatgcccgggacctacaagatcgtgatcgacaagaagaacaagctgaacgaccgctgcgccctcatcaccaactgcgtcatcaagggccgggaggtgcgcaagggccagtccaccctgcggcagtacaagacggagatccgcatcgggcagaccatcgccggcagccggcgcctgctcgccgagggggtgtccaacgactgcgtcagccggacccagctgatcaagaccgaggtggcggagatccacgaggactcctacggcgggcccggcgagaagatcacgatctgcaacggcagcaccatcgtggaccagcgcctggggtccgagctcggctgctacaccatcaaccgggtgaagacctacaagctgtgcgagaacagcgccaccgagaaggggtgcgagatcgactccgtgccggtgaagtgcaagcagggcttctgcctgaaggtcacgcaggaggggcgcggccacgtgaagctcagccggggcaccgagatcgtgctggacgtctgcgacacctcctgcgagctgatgatcccgaaggggaccggcgacatcctggtggactgcagcgggggccagcagcacttcctccaggacaacctgatcgacctgggctgccccaacgtgcccctcctggggaagatggccatctacatctgccgcatgtccaaccacccgaagacgaccatggccttcctgttctggttcagcttcggctacgtcatcacgtgcatcgtgtgcaaggtcctcttctacctgctgatcgtgatcgggaccctcagcaagaagctgaagcagtaccgcgagctgaagccccagacctgcatcgtgtgcgagtccacccccgtgaacgccatcgacgcggagatgcacgagctcaactgcaactacaacatctgcccctactgcgccagccggctgacctccgacggcctggtccgccacgtgaaccagtgcccgaagcggaaggagaaggtggaggagaccgagctctacctgaacctggagcgcatcccctggctcgtccggcgcctgctgcaggtcagcgagtccacggggatggccctcaagcggagctgctggatgaccaccctgctgatcctcctggtggtgtccctgagccccgtgcagtccgcccccgtgggccagggcaaggccgtcgaggtgtaccgcgtgcgggagagctacacctccatctgcctcttcgtcctggggagcgtgctgttcgcggtgtcctggctcatcaagggcctgatcgacgggatcggcaacagcttcttcccggggctgtccgtctgcaagacgtgcagcatcggctccatcaacggcttcgagatcgagagccacaagtgctactgctccctcttctgctgcccctactgccgcgcctgcagcagcgacaagatcacccaccggatgcacctgaacgtgtgcaagaagcgcaaggccgggtccaacgtgatgctggccgtctgcaagcggatgtgcttcaaggcgaccgtggaggccagcaacaccgccctcctgatccgcggcatcatcaactccacgttcgtgatctgcgtcctgatcctcgtgatctgcgtggtcagcacctccgccgtggacatggagaacctgcccgccgggatctgggagcgggaggaggacctgaccaacttctgccaccaggagtgccaggtgaccgagacggagtgcctctgcccctacgaggcgctgatcctgcgcaagccgctctacctggacagcatcgccaagggcatgaagtccctgctcaacagcaccaacctggagacctccctgagcatcgaggccccctggggcgccatcaacgtccagtccaccttcaagcccacggtgagcgccgcgaacatcgccctctcctggagctccgtggagcaccgggggaacaagatcctggtcagcggccgctccgagagcatcatgaagctggaggagcggaccgggatctcctggagcctcggcgtggaggacgccagcgagtccaagaccctgaccgtcagcgtgatggacctgtcccagatgtacagcccggtgttcgagtacctctccggggaccgccaggtcgaggagtggcccaaggccacgtgcaccggcgactgccaggagcgctgcgggtgcaccagcagcacgtgcctgcacaaggagtggccccacagccggaactggcgctgcaaccccacctggtgctggggcgtgggcaccgggtgcacgtgctgcggcctggacgtgcgggacctcttcaccgactacatgatggtcaagtggaaggtggagtacgtgaagaccgaggccatcatgtgcgtcgagctgacctcccaggagcgccagtgcagcctgatcgaggcggggacccggttcaacctcggcccggtgaccatcaccctgtccgagccccgcaacatccagcagcggctgcccagcgagatcgtgacgctccaccccaagatcgaggagggcttcttcgacctgatgcacgtccagaaggtgctgtccgccagcaccgtgtgcaagctccagtcctgcacccacggggtcccgggcgacctccaggtgtaccacgtggggaacctgctcaagggcgacaaggtcaacgggcacagcatccacaagatcgagtcccacttcaacaccagctggatgtcctgggacggctgcgacctggactacttctgcaacatgggcgactggcccagctgcacgtacaccggggtgacccagcacaaccgcgccgccttcatcaacatgctgaacatcgagaccgactacacgaagaccttccacttccacagcaagcgggtgaccgcgcacggcgacacgccccagctcgacctgaaggcccgccccacctacggggccggcgaggtcaccgtgctggtggaggtcgccgacctcgagctgcacaccaagaagatcgaggtgtccgggctgaagttcgccagcctcacgtgctccggctgctacgcgtgcagctccggcatcagctgcaaggtgcggatccacgtcaacgagccggacgagttcaccgtgcacgtgaagtccagcgaccccgacgtcgtggccgccgggtccagcctgatggcccgcaagatcgagttcggcgccgactccaccttcaaggcgttcagctccatgcccaagaacagcctgtgcttctacatcgtggagcgggactactgctccagctgcaccaacgacgacacccagaagtgcgtcgacacgaagctcgagcacccccagtccatcctgatcgagcacaaggggaccatcatcggcaagcagaacgacacgtgcagcaccaagacctcctgctggctggagagcgtgaagtccttcttctacgggctcaagaacatgctgggcggcatcttcgggaacgtgttcctgggcatcttcctcttcctggccccgttcgccctgctcatcttcttcttcttcttcgggtggcgcctgctgttctgcctgaagtgctgccggcgcacccggggcctcctgaagtacaagcagctgaaggacgaggaggaggccggctacaagaagatcatcgagcgcctcaacgacaagaaggggaagtcccggctgttcgacggcgagcgcctggccgaccggaagatcgcggagctgttcagcaccaagacccacatcgggtga

SEQ ID NO: 11901 - RNA, 5100 nt, synthetic construct
  misc_feature 1..5100: note = derived and/or modified CDS sequence (opt1) from CCHFV(Nakiwogo)__KX013484.1__GP
  source 1..5100: mol_type = other RNA
atgttctgcctgaagctcgtgctgctgatcaacctcaccctgtgccagctgctcgagggcaacgaccgcgtcaccagcgccgacgggatcaactccaacacgacccagaccaacctgggcatcagcaccatcctgaactccacgacccccgccccggggcccagcaccgacaccacgatggagaccgtgccctccaccgcggacagcatgctcgagacccaggtgacgaccgactccggcagcggggagccctccaccgagccgaccacgaccggcgaggccaccagctccaccacggccgccaccgtcagcatgcaggagaccaagaagcacatgacccagaacacgcggtccaccgccgaccccgacaccaccacgcccaacagcaccacctccgtggagcccaccacgatcccgcccaccagccccatcccccaggcgaccccgacccccggccacgggaaggcccccacgctgcccaacacccaccacctgtcccgcagcctcctgtccgccgtgagcaccgaggccggccagaccaccccggcgacgagcaccaccgaggccgcctccgcccccagctccagctccaccgccgagaacaacacggtcagccagcccgcgcaggacaccaccacctccggggtgagcgagcagtacaaccccacgaccaccggcatctccccgaaggcccagaccatgcaggggcagcaggccatcgtgcccgtcacgacccccgtgaccaccacgttcacccccaccaacccgaccaaccggagcaagcgcgagtccaaggtgcagatcatcctgacgttcccccagggcctcaagaagtactacagcaagatcctgaagctgctccacctgacccaggaggaggactccgagggcctgctcgagtggtgcacccgggtcctgcagcaggtgtgcgacgacacctacttcaacgagcgcatcgaggagttcttcatcacggggaagggctacttcaacgacgtgctgcagttcaagctccacgacacccccaccaccacggtcagcgccctggccgcgtccagcaccgccatgcccttccggtcctactacgccaaggggagcctgaccctcgactccggctacttcagcgccaagtgctacccgcgcgccagcaactccggcatgcagctgatcaacgtgacccagcaccccatgaagatcgcgaacacgcccgggccgaagaccagcaacctgaagaccatgaactgcatcaacctcaaggtgtccaccgacaaggagcacagcgagctggagatcaacgtcctgatcccccaggtggccgtgaacctctccaactgcctggtcagcatcaagtcccacgtgtgcgactacagcctggacacggacggcgccatccggctccccaaggtggcctacaacggggtcttcatgcccggcacctacaagatcgtgatcgacaagaagaaccgcctgaacgaccggtgcgccctgatcaccaactgcgtcatcaaggggcgcgaggtgcggaagggccagtccaccctccgccagtacaagaccgagatccggatcggccagacgctgatggggagccgccggctgctcgcggagggcgtgtccaacgactgcgtcagccgcacccagctgatcaagaccgaggtggccgagatccacgaggactcctacgggggcccgggggagaagatcaccatctgcaacggcagcacgatcgtggaccagcggctgggctccgagctcgggtgctacaccatcaaccgcgtcaagacctacaagctgtgcgagaacagcgccaccgagaagggctgcgagatcgactccgtgcccgtgaagtgcaagcaggggttctgcctgaaggtcacgcaggagggccgggggcacgtgaagctcagccgcggcaccgagatcgtgctggacgtctgcgacaccagctgcgagctgatgatccccaagggcaccggggacatcctggtggactgctccggcgggcagcagcacttcctccaggacaacctgatcgacctgggctgccccaacgtgccgctcctgggcaagatggccatctacatctgccgcatgagcaaccaccccaagacgaccatggcgttcctgttctggttctccttcgggtacgtcatcacctgcgtggtgtgcaaggtcctcttctacctgctgatcgtgatcggcaccctcgggaagaagctgaagcagtaccgggagctgaagccccagacgtgcatcgtgtgcgagagcatccccgtcaacgtgatcgacgccgagatgcacgagctcaactgcaactacaacatctgcccgtactgcgcctcccgcctgaccagcgacggcctggtgcggcacgtcacccagtgccccaagcgcaaggagaaggtggaggagaccgagctctacctgaacctggagcggatcccctggctcgtgcgccggctgctgcaggtctccgagagcacggggatggccctcaagcgctcctgctggatgaccaccctgctgatcctcctggtggtgagcctgtcccccgtccagagcgccccggtgggccaggagaaggcgatcgaggtgtaccaggtccgggagtcctacaccagcatgtgcctcttcgtgctgggctccgtgctgttcgccgtcagctggctcgtgaaggggctgatcgacggcatcgggaactccttcttccccggcctgagcgtgtgcaagacgtgctccatcgggagcatcaacggcttcgagatcgagagccacaagtgctactgctccctcttctgctgcccctactgccgcgcctgcagctccgacaagatcacccaccggatgcacctgaacatctgcaagcgccggaaggtcggcagcaacgtgatgctggccgtgtgcaagcgcatgtgcttcaaggccaccgtcgaggcgtccaacagcgccctcctgatccggtccatcatcaacagcaccttcgtgatctgcgtgctgatcctcgtcatctgcgtggtgtccacgagcgccgtcgacatggagaacctgcccgccgggatctgggagcgcgaggaggacctgaccaacttctgccaccaggagtgccaggtgaccgagaccgagtgcctctgcccgtacgaggccctgatcctgcggaagcccctctacctggactccatcgcgaagggcatgaagagcctgctcaactccacgaacctggagaccagcctgtccatcgaggccccctggggggccatcaacgtgcagagcaccttcaagcccaccgtctccgccgcgaacatcgccctcagctggtccagcgtggagcaccgcggcaacaagatcctggtcagcgggcggtccgagagcatcatgaagctggaggagcgcacgggcatctcctggagcctcggcgtggaggacgcctccgagagcaagaccctgaccgtgtccgtcatggacctgagccagatgtactccccggtgttcgagtacctcagcggggaccgccaggtggaggagtggcccaaggccacctgcaccggcgactgccccgagcggtgcgggtgcacgtccagcacctgcctgcacaaggagtggccgcactcccgcaactggcggtgcaaccccacctggtgctggggcgtcgggaccggctgcacgtgctgcggcctggacgtgcgcgacctcttcaccgactacatgatggtgaagtggaaggtcgagtacgtgaagaccgaggccatcatgtgcgtggagctgaccagccaggagcggcagtgctccctgatcgaggcggggacgcgcttcaacctcggccccgtcaccatcaccctgagcgagccccggaacgtgcagcagcgcctgccgtccgagatcgtgaccctccaccccaagatcgaggaggggttcttcgacctgatgcacgtccagaaggtgctgttctgcaagcacagcctccaggccacgtcctgcacccacggcgtgcccggcgacctgcaggtctaccacgtggggaacctgctcaagggcgacaaggtgaacgggcacagcatccacaagatcgagagccacttcaacacctcctggatgagctgggacggctgcgacctggactacttctgcaacatgggggactggccctcctgcacctacacgggcgtcacccagcacaaccgggccgccttcgtgaacatgctgaacatcgagaccgactacaccaagacgttccacttccacagcaagcgcgtgaccgcccacggcgacaccccgcagctcgacctgaaggcgcggcccacctacggggccggcgaggtcacggtgctggtggaggtcgccgacctcgagctgcacaccaagaagatcgaggtgtccgggctgaagttcgccagcctcacctgctccggctgctacgcctgcagctccgggatcagctgcaaggtgcgcatccacgtcaacgagcccgacgagttcaccgtgcacgtgaagtccaacgaccccgacgtcgtggcggccggcagctccctgatggcccggaagatcgagctgggcgccgacagcacgttcaaggcgttctccagcatgccgaagaactccctctgcttctacatcgtggagcgcgactactgcagctcctgcaccgacgacgacacccagaagtgcgtcaacaccaagctggagcacccccagagcatcctgatcgagcacaaggggacgatcatcggcaagcagaacgacacctgccccaccaagaccagctgctggctcgagtccgtgaagagcttcttctacgggctgaagaacatgctgggcgggatcttcggcaacgtgttcctcggcatcttcctgttcctggcccccttcgccctcctgatcctgttcttcttcttcgggtggcggctgctcttctgcctgaagtgctgccgccggacgcgcggcctgctcaagtacaagcagctgaaggacgaggaggaggccgggtacaagaagatcatcgagcggctgaacgacaagaagggcaagtcccgcctcttcgacggcgagcggctggccgaccgcaagatcgcggagctgttcagcaccaagacccacatcgggtga

SEQ ID NO: 11902 - RNA, 5100 nt, synthetic construct
  misc_feature 1..5100: note = derived and/or modified CDS sequence (opt1) from CCHFV(UG3010)__AY900143.1__GP
  source 1..5100: mol_type = other RNA
atgttctgcctgcgcctcgtgctgctgatcaacctcgccctgtgccagctgctcgagggcaacgacggggtcaccagcgccgacgagatcaactccaacaccacgcagaccagcctgggcctgcccaccatcctcaactccaccacgccggcgcccgggcccagcatcgacgccaccatggaggccgtgcccggcaccaccaactccgtgctggagacgcaggtcaccatggacagcgggtccggcgagctgagcaccgacccgaccacgacccgggaggccaccacccccatcacggccgcgaccgtgtccgcccaggagaccaagacccacatgacgcagaaccccggcaccaccgtggaccccgacaccacgaccagcaacaccaccacgtccatcgagccgatcaccaccccgcccaccagccccacgccccaggccacccccaccccctcctacagcgagacccccacgctcccgaacacccaccacctgtcccgcagcctgctctccgccgtcgggaccgaggcgggccagaccgcccccgccacccccacggccgaggtggccctggcgcccgggggcagctccaccgccgagagcaacaccatcagcatcccggcccaggacaccacgatctccggggtgagcaagcaggacaaccccaccaccaccggcatctcccccgaggcccagacgatgcagagccagcaggccgtcgcgcccgtgaccaccccggccaccgccatctccgcccccacgagccccaccaaccggtccaagcgcgagagcaaggtgcagatcatcctgaccttcccccagggcctcaagaagtactactccaagatcctgaagttcctgcacctcacccaggaggaggacagcgaggggctgctggagtggtgcacgcgggtcctccagcaggtctgcgacgacacctacttcaacgagcgcatcaaggagttcttcatcaccggcaaggggtacttcaacgacgtgctgcagttcaagctgcacgacaccccggccacgaccgtccccgcgctcgccgcctccagcaccgccatccccttccggtcctactacgccaagggcagcctgaccctggactccggctacttcagcgcgaagtgctacccgcgcgcctccaacagcgggatgcagctcatcaacgtgacgcagcaccccatgaagatcgccaacacccccggccccaagatctccaacctgaagaccatcaactgcatcaacctgaaggtgagcaccgacaaggagcacagcgagctcgagatcaacgtcctgatcccccaggtggccgtgaacctgtccaactgcttcgtcagcatcaagtcccacgtgtgcgactacagcctcgacacggacggggcgatccggctgcccaaggtggcccacaacggcgtcttcatgcccgggacctacaagatcgtgatcgacaagaagaacaagctgaacgaccgctgcgccctcatcaccaactgcgtcatcaagggccgggaggtgcgcaagggccagtccaccctgcggcagtacaagacggagatccgcatcgggcagaccatcgccggcagccggcgcctgctcgccgagggggtgtccaacgactgcgtcagccggacccagctgatcaagaccgaggtggcggagatccacgaggactcctacggcgggcccggcgagaagatcacgatctgcaacggcagcaccatcgtggaccagcgcctggggtccgagctcggctgctacaccatcaaccgggtgaagacctacaagctgtgcgagaacagcgccaccgagaaggggtgcgagatcgactccgtgccggtgaagtgcaagcagggcttctgcctgaaggtcacgcaggaggggcgcggccacgtgaagctcagccggggcaccgagatcgtgctggacgtctgcgacacctcctgcgagctgatgatcccgaaggggaccggcgacatcctggtggactgcagcgggggccagcagcacttcctccaggacaacctgatcgacctgggctgccccaacgtgcccctcctggggaagatggccatctacatctgccgcatgtccaaccacccgaagacgaccatggccttcctgttctggttcagcttcggctacgtcatcacgtgcatcgtgtgcaaggtcctcttctacctgctgatcgtgatcgggaccctcagcaagaagctgaagcagtaccgcgagctgaagccccagacctgcatcgtgtgcgagtccacccccgtgaacgccatcgacgcggagatgcacgagctcaactgcaactacaacatctgcccctactgcgccagccggctgacctccgacggcctggtccgccacgtgaaccagtgcccgaagcggaaggagaaggtggaggagaccgagctctacctgaacctggagcgcatcccctggctcgtccggcgcctgctgcaggtcagcgagtccacggggatggccctcaagcggagctgctggatgaccaccctgctgatcctcctggtggtgtccctgagccccgtgcagtccgcccccgtgggccagggcaaggccgtcgaggtgtaccgcgtgcgggagagctacacctccatctgcctcttcgtcctggggagcgtgctgttcgcggtgtcctggctcatcaagggcctgatcgacgggatcggcaacagcttcttcccggggctgtccgtctgcaagacgtgcagcatcggctccatcaacggcttcgagatcgagagccacaagtgctactgctccctcttctgctgcccctactgccgcgcctgcagcagcgacaagatcacccaccggatgcacctgaacgtgtgcaagaagcgcaaggccgggtccaacgtgatgctggccgtctgcaagcggatgtgcttcaaggcgaccgtggaggccagcaacaccgccctcctgatccgcggcatcatcaactccacgttcgtgatctgcgtcctgatcctcgtgatctgcgtggtcagcacctccgccgtggacatggagaacctgcccgccgggatctgggagcgggaggaggacctgaccaacttctgccaccaggagtgccaggtgaccgagacggagtgcctctgcccctacgaggcgctgatcctgcgcaagccgctctacctggacagcatcgccaagggcatgaagtccctgctcaacagcaccaacctggagacctccctgagcatcgaggccccctggggcgccatcaacgtccagtccaccttcaagcccacggtgagcgccgcgaacatcgccctctcctggagctccgtggagcaccgggggaacaagatcctggtcagcggccgctccgagagcatcatgaagctggaggagcggaccgggatctcctggagcctcggcgtggaggacgccagcgagtccaagaccctgaccgtcagcgtgatggacctgtcccagatgtacagcccggtgttcgagtacctctccggggaccgccaggtcgaggagtggcccaaggccacgtgcaccggcgactgccaggagcgctgcgggtgcaccagcagcacgtgcctgcacaaggagtggccccacagccggaactggcgctgcaaccccacctggtgctggggcgtgggcaccgggtgcacgtgctgcggcctggacgtgcgggacctcttcaccgactacatgatggtcaagtggaaggtggagtacgtgaagaccgaggccatcatgtgcgtcgagctgacctcccaggagcgccagtgcagcctgatcgaggcggggacccggttcaacctcggcccggtgaccatcaccctgtccgagccccgcaacatccagcagcggctgcccagcgagatcgtgacgctccaccccaagatcgaggagggcttcttcgacctgatgcacgtccagaaggtgctgtccgccagcaccgtgtgcaagctccagtcctgcacccacggggtcccgggcgacctccaggtgtaccacgtggggaacctgctcaagggcgacaaggtcaacgggcacagcatccacaagatcgagtcccacttcaacaccagctggatgtcctgggacggctgcgacctggactacttctgcaacatgggcgactggcccagctgcacgtacaccggggtgacccagcacaaccgcgccgccttcatcaacatgctgaacatcgagaccgactacacgaagaccttccacttccacagcaagcgggtgaccgcgcacggcgacacgccccagctcgacctgaaggcccgccccacctacggggccggcgaggtcaccgtgctggtggaggtcgccgacctcgagctgcacaccaagaagatcgaggtgtccgggctgaagttcgccagcctcacgtgctccggctgctacgcgtgcagctccggcatcagctgcaaggtgcggatccacgtcaacgagccggacgagttcaccgtgcacgtgaagtccagcgaccccgacgtcgtggccgccgggtccagcctgatggcccgcaagatcgagttcggcgccgactccaccttcaaggcgttcagctccatgcccaagaacagcctgtgcttctacatcgtggagcgggactactgctccagctgcaccaacgacgacacccagaagtgcgtcgacacgaagctcgagcacccccagtccatcctgatcgagcacaaggggaccatcatcggcaagcagaacgacacgtgcagcaccaagacctcctgctggctggagagcgtgaagtccttcttctacgggctcaagaacatgctgggcggcatcttcgggaacgtgttcctgggcatcttcctcttcctggccccgttcgccctgctcatcttcttcttcttcttcgggtggcgcctgctgttctgcctgaagtgctgccggcgcacccggggcctcctgaagtacaagcagctgaaggacgaggaggaggccggctacaagaagatcatcgagcgcctcaacgacaagaaggggaagtcccggctgttcgacggcgagcgcctggccgaccggaagatcgcggagctgttcagcaccaagacccacatcgggtga

SEQ ID NO: 11903 - RNA, 5100 nt, synthetic construct
  misc_feature 1..5100: note = derived and/or modified CDS sequence (opt1) from CCHFV(Semunya)__DQ094832.1__GP
  source 1..5100: mol_type = other RNA
atgttctgcctgaagctcgtgctgctgatcaacctcgccctgtgccagctgctcgagggcaacgaccgcgtcaccagcgccgacgggatcaactccaacaccacgcagaccaacctgggcatcagcaccatcctgaactccaccacgcccgcgccggggcccagcaccgacaccaccatggagacggtgccctccaccgccgacagcatgctcgagacccaggtgaccacggactccggcagcggggagccctccaccgagccgaccaccacgggcgaggccaccagctccaccaccgccgccacggtcagcatgcaggagaccaagacccacatgacccagaacacgcggtccaccgcggaccccgacaccaccacgcccaacaccaccaccagcgtggagcccacgaccatcccgcccacctcccccatcctgcaggccacccccacgccgggccacgggaaggcccccaccctgcccaacacccaccacctcagccgctccctgctgagcgccgtgtccaccgaggcgggccagaccacgcccgccaccagcaccaccgaggccgccagcgccccgtccagctccagcacggcggagaacaacaccatgttccagcccgcccaggacaccaccacgtccggggtcagcgagcagtacaaccccaccaccaccggcatctcccccaaggcccagacgatgcaggcccagcaggccatcgtgccggtgaccacccccgtcaccacgaccttcacccccatcaaccccaccaaccggagcaagcgcgagtccaaggtgcagatcatcctcacgttcccgcaggggctgaagaagtactacagcaagatcctgaagctcctgcacctgacccaggaggaggactccgagggcctcctggagtggtgcacccgggtgctgcagcaggtctgcgacgacacctacttcaacgagcgcatcgaggagttcttcatcacgggcaaggggtacttcaacgacgtgctccagttcaagctgcacgacacccccaccaccacggtgcccgcgctggccgccagctccaccgccatgcccttccggagctactacgccaagggctccctcaccctggacagcgggtacttctccgcgaagtgctacccgcgcgccagcaactccggcatgcagctgatcaacgtcacccagcaccccatgaagatcgccaacacgcccggcccgaagaccagcaacctcaagaccatgaactgcatcaacctgaaggtgagcaccgacaaggagcactccgagctggagatcaacgtgctcatcccccaggtcgccgtgaacctgagcaactgcctggtgtccatcaagagccacgtctgcgactactccctcgacacggacggggccatccggctgcccaaggtggcgtacaacggcgtgttcatgcccgggacctacaagatcgtcatcgacaagaagaaccgcctgaacgaccggtgcgccctcatcaccaactgcgtgatcaagggccgcgaggtccggaaggggcagagcaccctgcgccagtacaagaccgagatccggatcggccagacgctgatgggctcccgccggctcctggccgagggggtgagcaacgactgcgtgtcccgcacccagctgatcaagaccgaggtcgccgagatccacgaggacagctacggcgggccgggcgagaagatcaccatctgcaacgggtccacgatcgtggaccagcggctcggcagcgagctgggctgctacaccatcaaccgcgtgaagacctacaagctgtgcgagaactccgcgaccgagaaggggtgcgagatcgacagcgtccccgtgaagtgcaagcagggcttctgcctcaaggtgacgcaggaggggcggggccacgtcaagctgtcccgcgggaccgagatcgtgctggacgtgtgcgacaccagctgcgagctgatgatccccaagggcaccggcgacatcctcgtcgactgctccgggggccagcagcacttcctgcaggacaacctgatcgacctcgggtgccccaacgtgccgctgctgggcaagatggccatctacatctgccgcatgagcaaccaccccaagacgaccatggccttcctcttctggttcagcttcggctacgtgatcacctgcgtcgtgtgcaaggtgctgttctacctgctcatcgtcatcgggaccctgggcaagaagctgaagcagtaccgggagctcaagccccagacgtgcatcgtgtgcgagtccatccccgtgaacgccatcgacgccgagatgcacgagctgaactgcaactacaacatctgcccgtactgcgcgagccgcctgacctccgacgggctcgtccggcacgtgacccagtgccccaagcgcaaggagaaggtggaggagaccgagctgtacctgaacctcgagcggatcccctggctggtccgccggctgctccaggtgagcgagtccacgggcatggccctgaagcgcagctgctggatgaccaccctgctcatcctgctggtggtctccctcagccccgtgcagtccgccccggtggggcaggagaaggccatcgaggtctaccaggtgcgggagagctacacctccatctgcctgttcgtgctgggcagcgtcctcttcgccgtgtcctggctggtgaagggcctgatcgacgggatcggcaacagcttcttccccgggctctccgtctgcaagacgtgcagcatcggctccatcaacgggttcgagatcgagagccacaagtgctactgctccctgttctgctgcccctactgccgcgcgtgcagcagcgacaagatcacccaccggatgcacctgaacatctgcaagcgccggaaggtgggctccaacgtgatgctcgccgtctgcaagcgcatgtgcttcaaggccaccgtggaggccagcaactccgccctgctgatccggagcatcatcaactccaccttcgtgatctgcgtcctcatcctggtgatctgcgtggtcagcacgtccgcggtggacatggagaacctgcccgccggcatctgggagcgcgaggaggacctcaccaacttctgccaccaggagtgccaggtgaccgagaccgagtgcctgtgcccgtacgaggccctgatcctccggaagcccctgttcctggacagcatcgccaaggggaagaagtccctcctgaacagcacgaacctggagacctccctcagcatcgaggcgccctggggcgccatcaacgtccagtccaccttcaagcccaccgtgagcgccgccaacatcgccctgtcctggagctccgtggagcaccgcgggaacaagatcctggtcagcggccggtccgagagcatcatgaagctcgaggagcgcacggggatcagctggtccctgggcgtggaggacgcgagcgagtccaagaccctgaccgtcagcgtgatggacctctcccagatgtacagcccggtgttcgagtacctgtccggcgaccgccaggtcgaggagtggcccaaggccacctgcaccggggactgccccgagcggtgcggctgcacgagctccacctgcctgcacaaggagtggccgcacagccgcaactggcggtgcaaccccacctggtgctggggggtgggcaccgggtgcacgtgctgcggcctcgacgtgcgcgacctgttcaccgactacatgatggtcaagtggaaggtggagtacgtgaagaccgaggccatcatgtgcgtcgagctgacctcccaggagcggcagtgcagcctcatcgaggccggcacgcgcttcaacctggggcccgtgaccatcaccctgtccgagccccggaacgtgcagcagcgcctcccgagcgagatcgtcaccctgcaccccaagatcgaggagggcttcttcgacctgatgcacgtgcagaaggtgctcttctgcaagtactccctgcaggccacgagctgcacccacggggtccccggcgacctgcaggtgtaccacgtgggcaacctcctgaagggggacaaggtcaacggccactccatccacaagatcgagagccacttcaacacctcctggatgagctgggacgggtgcgacctggactacttctgcaacatgggcgactggcccagctgcacctacacgggggtgacccagcacaaccgggcggccttcgtgaacatgctcaacatcgagaccgactacaccaagacgttccacttccactccaagcgcgtcaccgcccacggcgacaccccgcagctggacctgaaggcccggcccacctacggcgccggggaggtgacggtgctcgtcgaggtggcggacctggagctgcacaccaagaagatcgaggtgagcggcctcaagttcgcctccctgacctgcagcgggtgctacgcctgctccagcggcatctcctgcaaggtccgcatccacgtgaacgagcccgacgagttcaccgtgcacgtcaagagcaacgaccccgacgtggtggccgcggggtccagcctgatggcccggaagatcgagttcggcgccgactccacgttcaaggccttcagctccatgccgaagaacagcctctgcttctacatcgtcgagcgcgactactgctccagctgcaccgacgacgacacccagaagtgcgtgaacatcaagctggagcacccccagtccatcctgatcgagcacaagggcaccatcatcgggaagcagaacgacacgtgccccaccaagaccagctgctggctcgagtccgtgaagagcttcttctacggcctgaagaacatgctggggggcatcttcgggaacgtcttcctcggcatcttcctgttcctggcccccttcgcgctcctgatcctgttcttcttcttcggctggcggctgctcttctgcctgaagtgctgccgccggacccgcgggctgctcaagtacaagcagctgaaggacgaggaggaggccggctacaagaagatcatcgagcggctgaacgacaagaaggggaagagccgcctcttcgacggcgagcggctggccgaccgcaagatcgccaagctgttctccacgaagacccacatcggctga

SEQ ID NO: 11904 - RNA, 5094 nt, synthetic construct
  misc_feature 1..5094: note = derived and/or modified CDS sequence (opt1) from CCHFV(79121)__AB069673.1__GP
  source 1..5094: mol_type = other RNA
atgctgttccacttcaagttcatgctcctgatcaacttcatcctgtgccacctcctgtggggcgggggcggggtgaccggcggggtcgagaccaacagctccagcacgcaggccatccagacccccccggtgacctccaacagcaccacgcccggcccctccaccgacaccgccaccgagacggcgagctccatgaccaccagcacccccgacacgcaggtgaccaccgacaacggctccggggagccgagcaccgaccccctgacgaccaacgaggccaccccccccctctccgtcaccacggcccagaccaccgagaccaagaagcacacgaccctggacccgagcacctccaccaaccccgacgccacgacccccagcatcaccatcctgtccgccagcaacacctccctccccatcagctccgtgcacgcgagcccgagcccctccagctccgaggagcccacgccccagaacgcccaccacctgagccgctccctgctcagcgccgtgtccaccgagaccggccagatcgccagcgcggccaccgccgccaaggagatcacgaccaagaactccccgcccaccgccgggaacgacaccatggtcaccagcgcgcccaacggcaacatccggaacacgcccgagcaggccaacccgaccgcccccgaggcctcccccaagatccagaccacccagaaccagcagacggtgacccccgaggccaccccgatcaccacgatcaccgcgctgaccgacctgaccaaccgcagcaagcgggactccaaggtgcagaagatcctcacgttcagccaggggctgaagaagtactactccaagatcctgaagctcctgcagctgacccaggaggaggacagcgagggcctcctggagtggtgcacccgcgtcctggagcaggcctgcgacgacgactacttcaacaagcggatcgaggagttcttcatcaccggcaaggggtacttcaacgacgtgctccagttccgcctgcacgacgccctgtccaacacggagcccgcccagaccaccagccccaccgccgtgcccttcaagtcctactacgcgaagggcagcctcacgttcgacagcgggtacttctccgcccggtgctacccgcgcgccagcaactccggcctgcagctgatcaacgtcacccagcaccccgtgaagatcgccaacacccccggcccgaagctcagcaacctgaagaccatcaactgcatcaacctgaaggtgtccacggacaaggagcacagcgagctcgaggtcaacgtgctgctgccccaggtggccgtcaacctctccaactgccacgtgagcatcaagtcccacgtgtgcgactacagcctggacaccgacggggcgatcaagctgccccgggtcgcccacaacggcgtgttcatccccgggacctacaagatcgtgatcgacaagaagaacaacctcaacgaccgctgcaccctgatcacgaactgcgtcatcaagggccgggaggtgcgcaaggggcagtccgccctgcggcagtacaagaccgagatccgcatcggccagaccttcaccggcagccggcgcctcctggccgaggggggctccagcgactgcatctcccggacgcagctggtcaagaccgaggtggcggagatccacgaggacagctacgggggcccgggggagaagatcaccatctgcaacggctccaccatcgtggaccagggcctcgggagcgagctgggctgctacacgatcaaccgcgtccggagctacaagctgtgcgagaactccgccagcgggaagtcctgcgagatcgacagcatccccgtgaagtgcaagcagggcttctgcctcaagatcacccaggaggggcgcggccacgtgaagctgtcccggggcaccgagatcgtcctggacgtgtgcgacagctcctgcgagctgatgatccccaaggggaccggcgacatcctcgtggactgcagcgggggccagcagcacttcctgcagaacaacctgatcgacctcggctgccccaacgtcccgctgctggggaagatggccatctacgtgtgccgcatgtccaaccaccccaagaccacgatggccttcctcttctggttcagcttcggctacgtgatcacctgcatcgcctgccgcgtcctgttctacctgctcatcgcgatcgggaccgtgggcaagaagctgaagcagtaccgggagctgaagccccagacctgcatcgtgtgcgagtccgtccccgtgaacgccatcgacgccgagatgcacgagctcaactgcagctacaacatctgcccgtactgcgcctcccgcctgagcacggacgggctgatccggcacgtgacccagtgccccaagcgccgggagaaggtcgaggagaccgagctcttcctgaacctggagcgcatcccctggctcgtgcggaagctgctgcaggtgtccgagagcaccggcatggccctcaagcgctcctgctggatgatcacgctgctgatcctcctgctggtcagcatctcccccgtgcagagcgcgccggtgggcaaggagcgggccatcgagacctaccaggcccgcgagacctacaccgggatctgcctcttcgtcctgggcagcgtgctgttcgccgtgtcctggctcacgaaggccctgatcgacgggatcggcaacagcttctcccccgggctgagcgtctgcaagacctgctccatcggcagcatcaacggcttcgagatcgagtcccacaagtgctactgcagcctcttctgctgcccctactgccgggcgtgctccagcgacaagaacacccaccgcatgcacctgaacgtgtgcaagaagcggaagatggggtccaacgtgatgctggccgtctgcaagcgcatgtgcttccgggccaccatcgaggccagcaacaaggcgctcctgatccgctccatcatcaacagcacgttcgtgatctgcatcctgatcctcaccatctgcgtggtctccaccagcgccgtggacatggagaacctgcccgccggcatctgggagaaggaggaggacctgaccaacttctgccaccaggagtgccaggtgacggagaccgagtgcctctgcccgtacgaggccatggtcctgcggaagcccctgttcctcgactccaccgccaaggggatgaagagcctgctgaactccaccagcctcgagacgagcctgtccatcgaggcgccctggggcgccatcaacgtgcagagcaccttcaagcccaccgtgtccgccgccaacatcgccctgagctggtccagcgtcgagcaccgcgggaacaagatcctcgtgtccggccggagcgagtccatcatgaagctggaggagcgcaccggcgtgagctggaacctgggggtcgaggacgcgtccgagagcaagacgctcaccgtgtccgtgatggacctgagccagatgtactccccggtcttcgagtacctgagcggcgaccgccaggtggaggagtggcccaaggccacctgcaccggggactgccccgagcggtgcggctgcacgtccagcacctgcctccacaaggagtggccgcactcccgcaactggcggtgcaaccccacctggtgctggggggtgggcaccggctgcacgtgctgcgggctggacgtcaaggacttcttcaccgactacatgctggtgaagtggaaggtggagtacatcaagaccgaggccatcgtctgcgtggagctcaccagccaggagcgccagtgcagcctgatcgaggccggcacccggttcaacctggggcccgtcacgatcaccctctccgagccccgcaacgtgcagcagcggctgccgcccgagatcgtgaccctgcaccccaagatcgaggagggcttcttcgacctcatgcacgtccagaagatcctgagcgcctccaccgtgtgcaagctgcagagctgcacgcacggcgtgcccggggacttccagatctaccacgtcggcaacctcctgcgcggggacaaggtgaacggccactccatccacaagatcgagccgcacttcaacaccagctggatgtcctgggacgggtgcgacctggactacttctgcaacatgggcgactggcccagctgcacctacaccggcgtgacgcagcacaaccgggcggccttcatcaacatgctcaacatcgagaccgactacaccaagaccttccacttccactccaagcgcgtcacggcccacggggacaccccccagctggacctgaaggcccggcccgcgtacggcgccggggaggtgaccgtgctcgtcgaggtggccgacctggagctgcacaccaagaacctcgaggtgagcggcctgaagatcgcctccctgacgtgcagcgggtgctacgcctgctccagcggcatctcctgcaaggtccgcatccacgtgaacgagccggacgagttcaccgtgcacgtccggagctccgaccccgacgtggtggcggccggcagctccctcatggcccgcaagatcgagttcggggccgacagcaccttcaaggccttcagctccatgcccaaggacagcctgtgcttctacatcgtcgagaaggactactgctccagctgcaccgacgacgacacgcagaagtgcgtgaacaccaagctggaccacccccagtccatcctcatcgagcacaagggcaccatcatcgggaagcagaacgacacctgcagcacgaagacctcctgctggctggagagcgtgaagggcttcttctacgggctgaagaacatgctctccggcatcttcggcaacgtcttcctggggatcttcctgttcctcgcgccgttcgtgctgctgatcttcttcttcttcttcggctggcggctcctgttctgcctgaagtgctgccgccggacccgcgggctgctcaagtacaagcacctgaaggacgaggaggaggccggctacaagaagatcatcgagcggctgaacggcaagaaggggaagagccagctcttcgacggcgagcgcctggccgaccggaagatcgccgagctgttctccaccaagatccacatcgggtga

SEQ ID NO: 11905 - RNA, 5094 nt, synthetic construct
  misc_feature 1..5094: note = derived and/or modified CDS sequence (opt1) from CCHFV(7001)__AB069670.1__GP
  source 1..5094: mol_type = other RNA
atgctgttccacttcaagttcatgctcctgatcaacttcatcctgtgccacctcctgtggggcgggggcggggtgaccggcggggtcgagaccaacagctccagcacgcaggccatccagacgcccccggtgacctccaacagcaccacccccggcccctccaccgacaccgccaccgagacggcgagctccatgaccaccagcacccccgacacgcaggtcaccaccgacaacggctccggggagccgagcaccgaccccctgacgaccaacgaggccaccccgcccctctccgtcaccacggcccagaccaccgagaccaagaagcacacgaccctggaccccagcacctccaccaaccccgacgccacgacccccagcatcaccatcctgtccgccagcaacacctccctccccatcagctccgtgcacgcgagcccgagcccctccagctccgaggagcccacgccccagaacgcccaccacctgagccgctccctgctcagcgccgtgtccaccgagaccggccagatcgccagcgcggccaccgccgccaaggagatcacgaccaagaactccccgcccaccgccgggaacgacaccatggtcaccagcgcgcccaacggcaacatccggaacacgcccgagcaggccaacccgaccgcccccgaggcctcccccaagatccagaccacccagaaccagcagacggtgacccccgaggccaccccgatcaccacgatcaccgcgctgaccgacctgaccaaccgcagcaagcgggactccaaggtgcagatcatcctcacgttcagccaggggctgaagaagtactactccaagatcctgaagctcctgcagctgacccaggaggaggacagcgagggcctcctggagtggtgcacccgcgtcctggagcaggcctgcgacgacgactacttcaacaagcggatcgaggagttcttcatcaccggcaaggggtacttcaacgacgtgctccagttccgcctgcacgacgccctgtccaacacggagcccgcccagaccaccagccccaccgccgtgcccttcaagtcctactacgcgaagggcagcctcacgttcgacagcgggtacttctccgcccggtgctacccgcgcgccagcaactccggcctgcagctgatcaacgtcacccagcaccccgtgaagatcgccaacacccccggcccgaagctcagcaacctgaagaccatcaactgcatcaacctgaaggtgtccacggacaaggagcacagcgagctcgaggtcaacgtgctgctgccccaggtggccgtcaacctctccaactgccacgtgagcatcaagtcccacgtgtgcgactacagcctggacaccgacggggcgatcaagctgccccgggtcgcccacaacggcgtgttcatccccgggacctacaagatcgtgatcgacaagaagaacaacctcaacgaccgctgcaccctgatcacgaactgcgtcatcaagggccgggaggtgcgcaaggggcagtccgccctgcggcagtacaagaccgagatccgcatcggccagaccttcaccggcagccggcgcctcctggccgagggcgggtccagcgactgcatctcccggacgcagctggtcaagaccgaggtggcggagatccacgaggacagctacgggggcccgggggagaagatcaccatctgcaacggctccaccatcgtggaccagcgcctcggcagcgagctggggtgctacacgatcaaccgggtgcgcagctacaagctgtgcgagaactccgccagcggcaagtcctgcgagatcgacagcatccccgtgaagtgcaagcaggggttctgcctcaagatcacccaggagggccgggggcacgtgaagctgtcccgcggcaccgagatcgtcctggacgtgtgcgacagctcctgcgagctgatgatccccaagggcaccggggacatcctcgtggactgcagcggcgggcagcagcacttcctgcagaacaacctgatcgacctcggctgccccaacgtcccgctgctgggcaagatggccatctacgtgtgccgcatgtccaaccaccccaagaccacgatggccttcctcttctggttcagcttcgggtacgtgatcacgtgcatcgcctgccgggtcctgttctacctgctcatcgcgatcggcaccgtggggaagaagctgaagcagtaccgcgagctgaagccccagacctgcatcgtgtgcgagtccgtccccgtgaacgccatcgacgccgagatgcacgagctcaactgcagctacaacatctgcccgtactgcgcctcccggctgagcaccgacggcctgatccgccacgtgacccagtgccccaagcggcgcgagaaggtcgaggagaccgagctgttcctcaacctggagcggatcccctggctcgtgcgcaagctgctgcaggtctccgagagcaccgggatggccctcaagcggtcctgctggatgatcacgctgctgatcctcctgctggtgagcatctcccccgtgcagagcgcgccggtgggcaaggagcgcgccatcgagacctaccaggcccgggagacctacaccggcatctgcctcttcgtcctggggagcgtgctgttcgccgtgtcctggctcacgaaggccctgatcgacggcatcgggaacagcttcttccccggcctgtccgtctgcaagacctgcagcatcgggtccatcaacggcttcgagatcgagagccacaagtgctactgctccctcttctgctgcccctactgccgcgcgtgcagctccgacaagaacacccaccggatgcacctgaacgtgtgcaagaagcgcaagatgggcagcaacgtgatgctggccgtctgcaagcggatgtgcttccgcgccaccatcgaggcctccaacaaggcgctcctgatccggagcatcatcaactccacgttcgtgatctgcatcctgatcctcaccatctgcgtggtcagcacctccgccgtggacatggagaacctgcccgccgggatctgggagaaggaggaggacctgaccaacttctgccaccaggagtgccaggtgacggagaccgagtgcctctgcccgtacgaggccatggtcctgcgcaagcccctgttcctcgacaacatcgccaagggcatgaagtccctgctgaacagcaccagcctcgagacctccctgagcatcgaggcgccctggggcgccatcaacgtgcagagcacgttcaagcccaccgtgtccgccgccaacatcgccctgagctggtccagcgtcgagcaccgggggaacaagatcctcgtgtccgggcgcagcgagtccatcatgaagctggaggagcgcaccggcgtgagctggaacctgggcgtcgaggacgcgtccgagagcaagaccctcacggtgtccgtgatggacctgagccagatgtactccccggtcttcgagtacctgagcggggaccgccaggtggaggagtggcccaaggcgacctgcaccggcgactgccccgagcggtgcgggtgcacctccagcacgtgcctccacaaggagtggccgcactcccggaactggcgctgcaaccccacctggtgctggggcgtggggaccggctgcacgtgctgcggcctggacgtcaaggacttcttcaccgactacatgctggtgaagtggaaggtggagtacatcaagaccgaggccatcgtctgcgtggagctcaccagccaggagcggcagtgctccctgatcgaggccgggacccgcttcaacctgggccccgtcaccatcacgctcagcgagccccggaacgtgcagcagcgcctgccgcccgagatcgtgaccctgcaccccaagatcgaggaggggttcttcgacctcatgcacgtccagaagatcctgagcgcctccaccgtgtgcaagctgcagagctgcacccacggcgtgcccggcgacttccaggtctaccacgtggggaacctcctgcggggcgacaaggtgaacgggcactccatccacaagatcgagccgcacttcaacacgagctggatgtcctgggacggctgcgacctggactacttctgcaacatgggggactggcccagctgcacctacaccggcgtcacccagcacaaccgcgccgccttcatcaacatgctcaacatcgagacggactacaccaagaccttccacttccactccaagcgggtgaccgcccacggcgacacgccccagctggacctgaaggcccgccccgcgtacggggccggcgaggtgaccgtcctcgtggaggtggccgacctggagctgcacaccaagaagctcgaggtcagcgggctgaagatcgcctccctgacctgcagcggctgctacgcctgctccagcgggatctcctgcaaggtgcggatccacgtgaacgagccggacgagttcacggtccacgtgcgcagctccgaccccgacgtggtcgcggccggcagctccctcatggcccggaagatcgagttcggcgccgacagcaccttcaaggccttctccagcatgcccaaggacagcctgtgcttctacatcgtggagaaggactactgctccagctgcaccgacgacgacacccagaagtgcgtgaacacgaagctggaccacccccagtccatcctcatcgagcacaaggggaccatcatcggcaagcagaacgacacgtgcagcaccaagacctcctgctggctggagagcgtcaaggggttcttctacggcctgaagaacatgctctccgggatcttcggcaacgtgttcctgggcatcttcctgttcctcgcgccgttcgtgctgctgatcttcttcttcttcttcgggtggcgcctcctgttctgcctgaagtgctgccggcgcacccggggcctgctcaagtacaagcacctgaaggacgaggaggaggccgggtacaagaagatcatcgagcgcctgaacggcaagaagggcaagagccagctgttcgacggggagcggctcgccgaccgcaagatcgccgagctgttctccaccaagatccacatcggctga

SEQ ID NO: 11906 - RNA, 5094 nt, synthetic construct
  misc_feature 1..5094: note = derived and/or modified CDS sequence (opt1) from CCHFV(YL16070)__KY354081.1__GP
  source 1..5094: mol_type = other RNA
atgctgttccacttcaagttcatgctcctgatcaacttcatcctgtgccacctcctgtggggcggggtgggcgtcaccgggggcgtggagaccaacagctccagcacgcaggccatccccaccccgcccgtgacctccaacagcaccacgcccgggccctccaccgacaccgccaccgagacggcgagctccatgaccaccagcaccccggacacgcaggtcaccaccgacaacggctccggcgagcccagcaccgaccccctgacgaccaacgaggccacgcccccgctctccgtgaccaccgcccagaccaaggagaccaagaagcacaccacgctggaccccaacaccagcgccaaccccgacgccaccaccccctccatcacgatcctgagcgcgtccaacaccagcctcccgacctccagcgtgcacgcctcccccagccccagctccagcgaggagcccaccccgcagaacgcccaccacctgtcccgcagcctgctctccgccgtcagcacggagaccgggcagaccgcgtccgccaccacggccaccaaggagatcaccaccaagaacagcccgcccaccgccggcaacgacacgatggtgacctccgcccccaacgggaacacccggaacacccccgagcaggcgaaccccacggcccccgaggccagcctgaagatccagaccacccagaaccagcagaccgtgacgcccgaggccaccccgatcaccaccgtcacggccctgaccgacctcaccaaccgctccaagcgggacagcaaggtgcagatcatcctgaccttctcccagggcctgaagaagtactacagcaagatcctcaagctgctgcagctcacgcaggaggaggactccgaggggctgctggagtggtgcacccgcgtgctcgagcaggcgtgcgacgacgactacttcaacaagcggatcgaggagttcttcatcaccggcaagggctacttcaacgacgtcctgcagttccgcctgcacgacgccctcagcaacaccgagcccgcccagacgacctcccccaccgccgtgcccttcaagagctactacgccaaggggtccctgaccttcgacagcggctacttcagcgcgcggtgctacccgcgcgcctccaacagcgggctgcagctcatcaacgtgacgcagcaccccgtcaagatcgccaacacccccggcccgaagctgtccaacctgaagaccatcaactgcatcaacctcaaggtgagcaccgacaaggagcactccgagctggaggtgaacgtcctgctcccccaggtggccgtgaacctgagcaactgccacgtctccatcaagagccacgtgtgcgactactccctggacacggacggcgccatcaagctcccccgggtggcgcacaacggggtcttcatccccggcacctacaagatcgtgatcgacaagaagaacaacctgaacgaccgctgcaccctgaccacgaactgcgtcatcaaggggcgggaggtgcgcaagggccagagcgccctccggcagtacaagaccgagatccgcatcgggcagaccgtgaccggctcccggcgcctgctggccgagggcgggagctccgactgcatcagccggacgcagctcgtcaagaccgaggtggccgagatccacgaggactcctacggcgggccgggcgagaagatcaccatctgcaacgggagcaccatcgtggaccagcgcctgggctccgagctgggctgctacaccatcaaccgggtcaagagctacaagctctgcgagaacagcgcgtccggcaagagctgcgagatcgactccatccccgtgaagtgcaagcaggggttctgcctgaagatcacgcaggaggggcgcggccacgtgaagctgagccgggggaccgagatcgtcctggacgtgtgcgactccagctgcgagctcatgatccccaagggcaccggcgacatcctggtggactgctccgggggccagcagcacttcctgcagaacaacctcatcgacctggggtgccccaacgtcccgctgctcggcaagatggccatctacgtgtgccgcatgagcaaccaccccaagaccacgatggccttcctgttctggttctccttcggctacgtgatcacgtgcatcgtctgccgcgtgctgttctacctcctgatcgccatcgggaccgtgggcaagaagctgaagcagtaccgggagctcaagccccagacctgcatcgtctgcgagagcgtgcccgtgaacgccatcgacgcggagatgcacgagctgaactgctcctacaacatctgcccgtactgcgccagccgcctgtccaccgacgggctcatccggcacgtcacccagtgccccaagcgccgggagaaggtggaggagaccgagctgttcctgaacctcgagcgcatcccctggctggtgcggaagctgctccaggtcagcgagtccaccggcatggccctgaagcgcagctgctggatgatcacgctgctcatcctgctgctcgtgtccatgagccccgtgcagtccgccccggtcgggaaggagcgggccatcgagacctaccaggcgcgcgaggcctacaccggcatctgcctgttcgtgctgggcagcgtcctcttcgccgtgagctggctgaccaaggccctgatcgacgggatcggcaactccttcttccccgggctcagcgtgtgcaagacgtgctccatcggcagcatcaacgggttcgagatcgagtcccacaagtgctactgcagcctgttctgctgcccctactgccgggcctgctccagcgacaagaacacccaccgcatgcacctgaacgtgtgcaagaagcggaagatgggctccaacgtcatgctcgcggtgtgcaagcgcatgtgcttccgggccaccatcgaggccagcaacaaggccctgctgatccgctccatcatcaacagcaccttcgtgatctgcatcctcatcctgacgatctgcgtcgtgtccaccagcgcggtggacatggagaacctgcccgccggcatctgggagaaggaggaggacctcaccaacttctgccaccaggagtgccaggtcaccgagacggagtgcctgtgcccgtacgaggccatggtgctgcggaagcccctcttcctggactccatcgccaaggggatgaagtccctgctcaacagcaccagcctggagacctccctgagcatcgaggccccctggggcgcgatcaacgtgcagagcaccttcaagcccacggtctccgccgccaacatcgccctcagctggtccagcgtggagcaccgcgggaacaagatcctggtgtccggccggagcgagtccatcatgaagctggaggagcgcaccggggtcagctggaacctcggcgtggaggacgcctccgagagcaagaccctgaccgtgtccgtcatggacctgagccagatgtactccccggtgttcgagtacctcagcggcgaccgccaggtggaggagtggcccaaggcgacgtgcaccggggactgccccgagcggtgcggctgcacctcctccacgtgcctgcacaaggagtggccgcacagccgcaactggcggtgcaaccccacctggtgctggggcgtcgggaccgggtgcacgtgctgcggcctggacgtgaaggacttcttcaccgactacatgctcgtcaagtggaaggtggagtacatcaagaccgaggccatcgtgtgcgtcgagctgaccagccaggagcgccagtgctccctgatcgaggccggcacccggttcaacctcgggcccgtgaccatcaccctgagcgagccccgcaacgtgcagcagcggctgccgcccgagatcgtcacgctccaccccaagatcgaggagggcttcttcgacctgatgcacgtgcagaagatcctgagcgcctccaccgtgtgcaagctccagagctgcacccacggggtccccggcgacttccaggtgtaccacgtgggcaacctgctgcgcggggacaaggtcaacggccactccatccacaagatcgagccgcacttcaacaccagctggatgtcctgggacgggtgcgacctcgactacttctgcaacatgggcgactggcccagctgcacgtacaccggggtgacccagcacaaccgggccgcgttcatcaacatgctgaacatcgagaccgactacacgaagaccttccacttccactccaagcgcgtgaccgcccacggcgacacgccccagctggacctcaaggcccggcccgcctacggcgcgggggaggtcaccgtgctggtggaggtcgccgacctggagctccacaccaagaagctggaggtgagcggcctgaagatcgcctccctgacctgcagcgggtgctacgcctgctccagcggcatctcctgcaaggtgcgcatccacgtcaacgagccggacgagttcaccgtgcacgtgcggagctccgaccccgacgtcgtggccgcggggagctccctgatggcccgcaagatcgagttcggcgccgacagcacgttcaaggccttctccagcatgcccaaggacagcctgtgcttctacatcgtggagaaggactactgctccagctgcaccgacgacgacacccagaagtgcgtcaacaccaagctcgaccacccccagtccatcctgatcgagcacaagggcacgatcatcgggaagcagaacgacacgtgcagcaccaagacctcctgctggctcaagagcttcaagggcttcttctacgggctcaagaacatgctgtccggcatcttcgggaacgtgttcctgggcatcctcctgttcctggccccgttcgtgctcctgatcttcttcttcttcttcggctggcggctgctgttctgcctcaagtgctgcaagaagaccaaggggctgctgaagtacaagcacctcaaggacaaggaggaggcgggctacaagaagatcatcgagcgcctgaacgggaagaagggcaagagccagctgttcgacggcgagcggctcgccaaccgcaagatcgccgagctgttctccaccaagatccacatcgggtga

SEQ ID NO: 11907 - RNA, 5094 nt, synthetic construct
  misc_feature 1..5094: note = derived and/or modified CDS sequence (opt1) from CCHFV(YL04057)__FJ562094.1__GP
  source 1..5094: mol_type = other RNA
atgctgttccacttcaagttcatgctcctgatcaacttcatcctgtgccacctcctgtggggcgggggcggggtgaccggcggggtcgagaccaacagctccagcacgcaggccatccccaccccgcccgtgacctccaacagcaccacgcccggcccctccaccgacaccgccaccgagacggcgagctccatgaccaccagcaccccggacacccaggtgaccaccgacaacggctccggggagcccagcaccgacccgcccacgaccaacgagaccaccccgccgccctccgccacgaccgcccagaccaccgagacgaagaagcacaccaccctggaccccaacaccagcacgaaccccgacgccatcaccccctccatcaccatcctcagcgcctccaacaccagcctgcccatctccagcgtccacgcgtcccccagcccgagctccagcgaggagcccacgccccagaacgcccaccacctgtcccgcagcctcctgtccgccgtgagcaccgagaccggccagatcgcctccgcgaccacggccgccaaggagatcaccaccaagaacagcccgcccaccgccgggaacgacaccatgatcacgtccgcccccaacggcaacacccggaacacccccgagcaggcgaaccccaccgccccggaggccagccccaagatccagacgacccagaaccagcagaccgtgatccccgaggccacccccatcacgaccatcaccgccctgaccgacctcacgaaccgctccaagcgggacagcaaggtccagatcatcctgaccttctcccaggggctgaagaagtactacagcaagatcctcaagctgctgcagctcacccaggaggaggactccgagggcctgctggagtggtgcacccgcgtgctcgagcaggcgtgcgacgacgactacttcaacaagcggatcgaggagttcttcatcacgggcaaggggtacttcaacgacgtgctgcagttccgcctgcacgacgccctcagcaacaccgagccggcccagaccacctcccccacggccgtccccttcaagagctactacgccaagggctccctgaccttcgacagcgggtacttcagcgcgcggtgctacccgcgcgcctccaacagcggcctgcagctcatcaacgtgacccagcaccccgtgaagatcgccaacacccccggccccaagctgtccaacctgaagacgatcaactgcatcaacctcaaggtcagcaccgacaaggagcactccgagctggaggtgaacgtgctgctcccgcaggtcgccgtgaacctgagcaactgccacgtgtccatcaagagccacgtctgcgactactccctggacaccgacggggccatcaagctcccccggatcgcgcacaacggcgtgttcatccccgggacctacaagatcgtgatcgacaagaagaacaacctgaacgaccgctgcacgctgaccaccaactgcgtcatcaagggccgggaggtgcgcaaggggcagagcgccctccggcagtacaagaccgagatccgcatcggccagacgttcaccggctcccggcgcctgctggccgagggcgggagctccgactgcatcagccggacccagctcgtgaagaccgaggtcgccgagatccacgaggactcctacgggggccccggggagaagatcacgatctgcaacggcagcaccatcgtggaccagcgcctgggccgggagctggggtgctacaccatcaaccgcgtccggtcctacaagctctgcgagaacagcgcgagcggcaagtcctgcgagatcgacagcatcccggtgaagtgcaagcaggggttctgcctgaagatcacccaggagggccgcgggcacgtgaagctgtcccgcggcaccgagatcgtcctcgacgtgtgcgacagctcctgcgagctgatgatccccaagggcacgggggacatcctggtggactgcagcggcgggcagcagcacttcctgcagaacaacctcatcgacctgggctgccccaacgtccccctgctcggcaagatggccatctacgtgtgccggatgtccaaccacccgaagaccaccatggccttcctgttctggttcagcttcgggtacgtgatcacgtgcatcgcctgccgcgtcctgttctacctcctgatcgccatcggcacggtggggaagaagctgaagcagtaccgggagctcaagccccagacctgcatcgtgtgcgagtccgtccccgtgaacgcgatcgacgccgagatgcacgagctgaactgcagctacaacatctgcccctactgcgcctcccgcctgagcaccgacggcctcatccggcacgtgacccagtgcccgaagcgccgggagaaggtcgaggagacggagctgttcctgaacctcgagcgcatcccctggctggtgcggaagctgctccaggtgtccgagagcaccgggatggccctgaagcgctcctgctggatgatcaccctgctcatcctgctgctcgtcagcatctcccccgtgcagagcgcccccgtgggcaaggagcgggcgatcgagacctaccaggcccgcgagacgtacaccggcatctgcctgttcgtcctggggtccgtcctcttcgccgtgagctggctgaccaaggccctgatcgacggcatcgggaacagcttcttcccgggcctctccgtgtgcaagacctgcagcatcgggtccatcaacggcttcgagatcgagagccacaagtgctactgctccctgttctgctgcccctactgccgggcctgcagctccgacaagaacacgcaccgcatgcacctgaacgtgtgcaagaagcggaagatgggcagcaacgtgatgctcgcggtctgcaagcgcatgtgcttccgggccaccatcgaggcctccaacaaggccctgctgatccgcagcatcatcaactccaccttcgtgatctgcatcctcatcctgaccatctgcgtggtcagcacgtccgcggtggacatggagaacctgcccgccgggatctgggagaaggaggaggacctcaccaacttctgccaccaggagtgccaggtgaccgagaccgagtgcctgtgcccctacgaggccatggtcctgcggaagcccctcttcctggacagcatcgccaagggcaagaagtccctgctcaacagcacgtccctggagaccagcctgtccatcgaggccccctggggcgcgatcaacgtgcagagcaccttcaagcccaccgtgagcgccgccaacatcgccctctcctggagctccgtcgagcaccgcgggaacaagatcctggtgagcgggcgctccgagagcatcatgaagctggaggagcggacgggcgtgtcctggaacctcggcgtcgaggacgccagcgagtccaagaccctgaccgtgagcgtgatggacctgtcccagatgtacagcccggtcttcgagtacctctccggggaccgccaggtggaggagtggcccaaggcgacctgcacgggcgactgccccgagcggtgcgggtgcaccagctccacgtgcctgcacaaggagtggccccacagccgcaactggcggtgctccccgacctggtgctggggcgtggggaccggctgcacgtgctgcggcctggacgtcaaggacttcttcaccgactacatgctcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccccgcaacgtccagcagcggctgcccccggagatcgtgaccctccaccccaagatcgaggaggggttcttcgacctgatgcacgtccagaagatcctgagcgcctccacggtgtgcaagctccagagctgcacccacggcgtgcccggcgacttccaggtctaccacgtggggaacctgctgcgcggcgacaaggtgaacgggcactccatccacaagatcgagccccacttcaacaccagctggatgtcctgggacggctgcgacctcgactacttctgcaacatgggggactggccgagctgcacctacacgggcgtcacccagcacaaccgggccgcgttcatcaacatgctgaacatcgagaccgactacaccaagacgttccacttccactccaagcgcgtgaccgcccacggcgacacgccccagctggacctcaaggcccggcccgcctacggggcgggcgaggtgaccgtcctggtggaggtggccgacctggagctccacaccaagaagctggaggtcagcgggctgaagatcgcctccctgacctgcagcggctgctacgcctgctccagcgggatctcctgcaaggtgcgcatccacgtgaacgagcccgacgagttcaccgtccacgtgcggagctccgacccggacgtggtcgccgcgggcagctccctgatggcccgcaagatcgagttcggcgccgacagcaccttcaaggccttctccagcatgcccaaggacagcctgtgcttctacatcgtggagaaggactactgctccagctgcacggacgacgacacccagaagtgcgtgaacaccaagctcgaccacccccagtccatcctgatcgagcacaaggggaccatcatcggcaagcagaacgacacgtgcagcaccaagacctcctgctggctggagagcgtcaaggggttcttctacggcctcaagaacatgctgtccgggatcttcggcaacgtgttcctgggcatcctcctgttcctggcccccttcgtgctcctgatcttcttcttcttcttcgggtggcggctcctcttctgcctgaagtgctgccgccggacccgcggcctgctgaagtacaagcacctcaaggacgaggaggaggcggggtacaagaagatcatcgagcggctgaacggcaagaagggcaagagccagctgttcgacggggagcgcctcgccgaccgcaagatcgccgagctgttctccacgaagatccacatcggctga

SEQ ID NO: 11908 - RNA, 5094 nt, synthetic construct
  misc_feature 1..5094: note = derived and/or modified CDS sequence (opt1) from CCHFV(79121M18)__GU477493.1__GP
  source 1..5094: mol_type = other RNA
atgctgttccacttcaagttcatgctcctgatcaacttcatcctgtgccacctcctgtggggcgggggcggggtgaccggcggggtcgagaccaacagctccagcacgcaggccatccagacccccccggtgacctccaacagcaccacgcccggcccctccaccgacaccgccaccgagacggcgagctccatgaccaccagcacccccgacacgcaggtgaccaccgacaacggctccggggagccgagcaccgaccccctgacgaccaacgaggccaccccccccctctccgtcaccacggcccagaccaccgagaccaagaagcacacgaccctggacccgagcacctccaccaaccccgacgccacgacccccagcatcaccatcctgtccgccagcaacacctccctccccatcagctccgtgcacgcgagcccgagcccctccagctccgaggagcccacgccccagaacgcccaccacctgagccgctccctgctcagcgccgtgtccaccgagaccggccagatcgccagcgcggccaccgccgccaaggagatcacgaccaagaactccccgcccaccgccgggaacgacaccatggtcaccagcgcgcccaacggcaacatccggaacacgcccgagcaggccaacccgaccgcccccgaggcctcccccaagatccagaccacccagaaccagcagacggtgacccccgaggccaccccgatcaccacgatcaccgcgctgaccgacctgaccaaccgcagcaagcgggactccaaggtgcagaagatcctcacgttcagccaggggctgaagaagtactactccaagatcctgaagctcctgcagctgacccaggaggaggacagcgagggcctcctggagtggtgcacccgcgtcctggagcaggcctgcgacgacgactacttcaacaagcggatcgaggagttcttcatcaccggcaaggggtacttcaacgacgtgctccagttccgcctgcacgacgccctgtccaacacggagcccgcccagaccaccagccccaccgccgtgcccttcaagtcctactacgcgaagggcagcctcacgttcgacagcgggtacttctccgcccggtgctacccgcgcgccagcaactccggcctgcagctgatcaacgtcacccagcaccccgtgaagatcgccaacacccccggcccgaagctcagcaacctgaagaccatcaactgcatcaacctgaaggtgtccacggacaaggagcacagcgagctcgaggtcaacgtgctgctgccccaggtggccgtcaacctctccaactgccacgtgagcatcaagtcccacgtgtgcgactacagcctggacaccgacggggcgatcaagctgccccgggtcgcccacaacggcgtgttcatccccgggacctacaagatcgtgatcgacaagaagaacaacctcaacgaccgctgcaccctgatcacgaactgcgtcatcaagggccgggaggtgcgcaaggggcagtccgccctgcggcagtacaagaccgagatccgcatcggccagaccttcaccggcagccggcgcctcctggccgaggggggctccagcgactgcatctcccggacgcagctggtcaagaccgaggtggcggagatccacgaggacagctacgggggcccgggggagaagatcaccatctgcaacggctccaccatcgtggaccagggcctcgggagcgagctgggctgctacacgatcaaccgcgtccggagctacaagctgtgcgagaactccgccagcgggaagtcctgcgagatcgacagcatccccgtgaagtgcaagcagggcttctgcctcaagatcacccaggaggggcgcggccacgtgaagctgtcccggggcaccgagatcgtcctggacgtgtgcgacagctcctgcgagctgatgatccccaaggggaccggcgacatcctcgtggactgcagcgggggccagcagcacttcctgcagaacaacctgatcgacctcggctgccccaacgtcccgctgctggggaagatggccatctacgtgtgccgcatgtccaaccaccccaagaccacgatggccttcctcttctggttcagcttcggctacgtgatcacctgcatcgcctgccgcgtcctgttctacctgctcatcgcgatcgggaccgtgggcaagaagctgaagcagtaccgggagctgaagccccagacctgcatcgtgtgcgagtccgtccccgtgaacgccatcgacgccgagatgcacgagctcaactgcagctacaacatctgcccgtactgcgcctcccgcctgagcacggacgggctgatccggcacgtgacccagtgccccaagcgccgggagaaggtcgaggagaccgagctcttcctgaacctggagcgcatcccctggctcgtgcggaagctgctgcaggtgtccgagagcaccggcatggccctcaagcgctcctgctggatgatcacgctgctgatcctcctgctggtcagcatctcccccgtgcagagcgcgccggtgggcaaggagcgggccatcgagacctaccaggcccgcgagacctacaccgggatctgcctcttcgtcctgggcagcgtgctgttcgccgtgtcctggctcacgaaggccctgatcgacgggatcggcaacagcttctcccccgggctgagcgtctgcaagacctgctccatcggcagcatcaacggcttcgagatcgagtcccacaagtgctactgcagcctcttctgctgcccctactgccgggcgtgctccagcgacaagaacacccaccgcatgcacctgaacgtgtgcaagaagcggaagatggggtccaacgtgatgctggccgtctgcaagcgcatgtgcttccgggccaccatcgaggccagcaacaaggcgctcctgatccgctccatcatcaacagcacgttcgtgatctgcatcctgatcctcaccatctgcgtggtctccaccagcgccgtggacatggagaacctgcccgccggcatctgggagaaggaggaggacctgaccaacttctgccaccaggagtgccaggtgacggagaccgagtgcctctgcccgtacgaggccatggtcctgcggaagcccctgttcctcgactccaccgccaaggggatgaagagcctgctgaactccaccagcctcgagacgagcctgtccatcgaggcgccctggggcgccatcaacgtgcagagcaccttcaagcccaccgtgtccgccgccaacatcgccctgagctggtccagcgtcgagcaccgcgggaacaagatcctcgtgtccggccggagcgagtccatcatgaagctggaggagcgcaccggcgtgagctggaacctgggggtcgaggacgcgtccgagagcaagacgctcaccgtgtccgtgatggacctgagccagatgtactccccggtcttcgagtacctgagcggcgaccgccaggtggaggagtggcccaaggccacctgcaccggggactgccccgagcggtgcggctgcacgtccagcacctgcctccacaaggagtggccgcactcccgcaactggcggtgcaaccccacctggtgctggggggtgggcaccggctgcacgtgctgcgggctggacgtcaaggacttcttcaccgactacatgctggtgaagtggaaggtggagtacatcaagaccgaggccatcgtctgcgtggagctcaccagccaggagcgccagtgcagcctgatcgaggccggcacccggttcaacctggggcccgtcacgatcaccctctccgagccccgcaacgtgcagcagcggctgccgcccgagatcgtgaccctgcaccccaagatcgaggagggcttcttcgacctcatgcacgtccagaagatcctgagcgcctccaccgtgtgcaagctgcagagctgcacgcacggcgtgcccggggacttccagatctaccacgtcggcaacctcctgcgcggggacaaggtgaacggccactccatccacaagatcgagccgcacttcaacaccagctggatgtcctgggacgggtgcgacctggactacttctgcaacatgggcgactggcccagctgcacctacaccggcgtgacgcagcacaaccgggcggccttcatcaacatgctcaacatcgagaccgactacaccaagaccttccacttccactccaagcgcgtcacggcccacggggacaccccccagctggacctgaaggcccggcccgcgtacggcgccggggaggtgaccgtgctcgtcgaggtggccgacctggagctgcacaccaagaagctcgaggtgagcggcctgaagatcgcctccctgacgtgcagcgggtgctacgcctgctccagcggcatctcctgcaaggtccgcatccacgtgaacgagccggacgagttcaccgtgcacgtccggagctccgaccccgacgtggtggcggccggcagctccctcatggcccgcaagatcgagttcggggccgacagcaccttcaaggccttcagctccatgcccaaggacagcctgtgcttctacatcgtcgagaaggactactgctccagctgcaccgacgacgacacgcagaagtgcgtgaacaccaagctggaccacccccagtccatcctcatcgagcacaagggcaccatcatcgggaagcagaacgacacctgcagcacgaagacctcctgctggctggagagcgtgaagggcttcttctacgggctgaagaacatgctctccggcatcttcggcaacgtcttcctggggatcttcctgttcctcgcgccgttcgtgctgctgatcttcttcttcttcttcggctggcggctcctgttctgcctgaagtgctgccgccggacccgcgggctgctcaagtacaagcacctgaaggacgaggaggaggccggctacaagaagatcatcgagcggctgaacggcaagaaggggaagagccagctcttcgacggcgagcgcctggccgaccggaagatcgccgagctgttctccaccaagatccacatcgggtga

SEQ ID NO: 11909 - RNA, 5088 nt, synthetic construct
  misc_feature 1..5088: note = derived and/or modified CDS sequence (opt1) from CCHFV(ArD39554)__DQ211628.1__GP
  source 1..5088: mol_type = other RNA
atgctgtgccacatcaagcacatcctcctgttctgcatcatcctgtaccaccagcagtggaacaccggcgccagcaacaccacgatctcccccaccaccaacaagagccacaccgacatctcccaccagccgacgagcatcaccgccgcgtccagccccgggtcccccgccaccaccgcgcccccggagcgcagcgtgacgccctcccacacccccaccaccagcgtctccgaggccggcagcggggagcccccggccgccacgcccgcctccgccaccgcccagagccccgagcccgcgtccgccgcccagccgagccccaccatccccaagcccaccacgccggaccccacctccgaggccctcagcacccccgccacctcccggccccaggagccgagcacgcaccccagcccccgctccagcccctccaagccggtggagacccagagcacccggcacaccgcgcgcgagctgctgtccgtgacgggcaccgaggccgagcagctcatcacccagaccatccacacgaccaaggaggccaccaaggccaccagcccccagcccacggcctccaaccccgacccgaccctggcgaccaccagccggtccatcaacagcatcaaccccaaggggcccgagtccacgcgcgccaccccgcagagcacctcccccacccccgagagctccaccatccagacgcagatcctgcccatcatcaccaccccgggcaccctcgaggccatcatccaccccacgaaccggagcaagcgcaacctgggcaccgagatcatcctgaccctcccccaggggctgaagaagtactactccaaggtcctgaagctcatgcacctgacccgggaggaggacagcgagggcctgctcgagtggtgcacgcgcatcctggggcagacctgcgacgacgactacttccagaagcggatcaccgagttcttcatcaccggcgtggggtacttcaacgaggtgctgctgttcaaggagacgaccgacgcccccaccctggccccgacccacaagggcgcgccgcccacggagcccttcaagtcctactacgccaagggcttcatcaccatggacagcgggtacttcagcgccaagtgctactcccgcgccagcaactccggcctgcagctcatcaacgtcaccatgcacagctccaagatgcccatcacccccgggcccaagtacagcaacctgaagaacatcaactgcatcaacctgaaggtgtccacggacaaggagcacaacgaggtggagatcaacgtcctcctgccccaggtggccgtgaacctgagctcctgccacgtcctcgtgcggagccacgtgtgcgactactccctggacgcggacggcatgatcaagctgccgcagatcacccacgagggcaccttcatccccgggacctacaagatcatcatcgacaagaagaacaagcagaacgaccgctgcacgctcatcaccaactgcgtcatcaagggccgggaggtgcgcaaggggcagagcgccctgcggcagtacaagaccgagatccgcgtgggccaggcctccagcgggacccggcgcctgctctccgagagcaacaacaacgactgcgtctcccggacgcagctgatcaagaccgagaacgccgagatccacggcgacgactacggcgggcccggcgagaagatcaccatctgcaacgggagcaccatcgtggagcagcgcctgggcagcgagctcgggtgctacacgatcaaccgcatcaagtccttcaagctgtgcgagaacagcgcgtccggcaagggctgcgagatcgacagcacccccgtgaagtgcaagcaggggttctgcctgaagatcacccaggagggccgggggcacgtcaagctctcccgcggcagcgagatcatcctggacgtgtgcgactccagctgcgagatgatgatcccgaaggggtccggcgacatcctggtggactgcagcggcgggcagcagcacttcctccaggacaacctggtcgacctgggctgccccaacgtgcccctcctggggaagatggccatctacatctgccggatgtccaaccaccccaagaccacgatggccttcctgttctggttcagcttcggctacgtcatcacgtgcatcttctgcaaggtgatcttctacgtgctgatcatcatcggcaccctcgggaagcgcatcaagcagtaccgggagctgaagccgcagacctgcaccatctgcgaggccacccccgtcaacgccatcgacgcggagatgcacgacctgaactgctcctacaacatctgcccctactgcgccagccgcctcacctccgagggcctggtgcggcacgtgacccagtgcccgaagcgcaaggagaagatcgaggagaccgagctgtacctcaacctggagcggatcccctggttcgtccgcaagctgctccaggtgagcgagtccacgggggtggccctgaagcggagctcctggctggtcaccctcctggtgctgctcaccgtgagcctgagccccgtccagtccgcccccatcggccaggagcgcaccgtggtgacgtaccaggtccgggagagctacaccgggatgtgcctgttcatcctcggctccgtgctgttcgccatcagctggctgaccaagggcctcgtggactccgtcgggaacatcttcttcccgggcctgagcgtgtgcaagacctgctccatcgggagcatcaacggcttcgagatcgagtcccacaagtgctactgcagcctgttctgctgcccctactgccgctactgctccgcggaccgcggggcccaccagagccacctctccgtgtgcaagaagcggaagacgggcagcaacgtcatgctggccgtgtgcaagcggatgtgcttccgcgccaccctgaaggtgtccagcgaggccctcatcatccggtccatcatcaacaccaccttcgtcgtgtgcatcctgatcctggtggtctgcgtggtgagcacgtccgcggtcgagatggagaacctccccgccggcacctgggagaaggaggaggacctgaccaacttctgccaccaggagtgccaggtgaccgagacggagtgcctgtgcccctacgaggccttcgtgctccgcaagccgctgttcctggacagcaccgccaagagcatgaagtccctcctgaacagcacctccctggagaccagcctctccatcgaggcgccctggggcgccatcaacgtccagagcacgttcaagcccaccgcctccaccgccaacatcgccctgagctggtccagcgtggagcaccgcgggaacaagatcctggtgaccgggcggtccgagagcatcatgaagctcgaggagcgcacgggcatctcctggaacctgggggtcgaggacgcgagcgagtccaagaccctgaccgtgagcgtgatggacctctcccagatgtacagcaccgtcttcgagtacctgtccggcgaccgccaggtggaggagtggcccaaggccacgtgcaccggcgactgcccggagcggtgcgggtgcaccagcagcacgtgcctgcacaaggcctggccccactcccggaactggcgctgcaaccccacctggtgctggggcgtggggaccggctgcacgtgctgcgggctcgacgtcaagaacctgttcaccgactacatgctgatcaagtggaaggtggagttcatcaagaccgaggccatcgtgtgcgtcgagctcaccagccaggagcggcagtgctccctgatcgaggccggcacccgcttcaacctgggccccgtgaccatcaccctcagcgagccgcggaacatccagcagaagctgccgcccgagctggtgacgctccacccccgcgtcgaggaggggttcttcgacctgatgcacgtgcagaaggtgctgtccgcgagcaccgtctgcaagctccagtcctgcacccacggcgtgcccggggacctgcaggtctaccacgtgggcaacctgctcaagggcgacaagatcaacgggaacagcttccacaagatcgagcccaacctgaacacctcctggatgagctgggacggctgcgacctggactactactgcaacatgggggactggccctcctgcacgtacaccggcgtgacccagcacaaccacgccgccttcgtcaacctcctgaacatcgagaccgactacacgaagaacttccacttccacagcaagcgggtgaccgcccacggggagacgccccagctggacctcaaggcccgcccgaagtacggcgcgggcgaggtgaccgtcctggtggaggtggccgacatggagctgcacaccaagaagatcgagatctccgggctcaagttcgccagcctgacctgcaccggctgctacgcctgctccagcgggatctcctgcaaggtccggctgcacgtggacgagcccgacgagctcaccgtgcacgtcaagagcgacgaccccgacgtggtggcggcctccagcagcctgatggcccgcaagatcgagttcggcacggactccaccttcaaggccttcagctccatgcccaaggacaagctgtgcttctacatcgtcgagcgggactactgcagctcctgcagcaaggaggacacccagaagtgcgtgaacgccaagctcgagcagccgcagtccatcctgatcgagcacaaggggaccatcatcggcaagcagaacgacacgtgcaccgtgaaggcgagctgctggctggagtccgtcaagagcttcttctacggcctcaagaacatgctcgggggcatcttcgggaacgtgatcctgggcatcatcatgttcctcgcccccttcgccctgctgctcctgttcttcctgttcgggtggcgcatcctcttctgcctgcggtgctgccgccggacccgcggcctgttcaagtacaagcacatcaaggacgacgaggagtccggctacaagcggatcatcgagcgcctcaacaacaagaaggggaagaacaagctgttcgacggcgagcgcctggccgacaagaagatcgccgagctgttcagcaccaagacgcacatcgggtga

SEQ ID NO: 11910 - RNA, 5088 nt, synthetic construct
  misc_feature 1..5088: note = derived and/or modified CDS sequence (opt1) from CCHFV(AP92)__DQ211625.1__GP
  source 1..5088: mol_type = other RNA
atgcccgaccacttcatcctgctcctgctgatgtacaccgtgttccaccagcacccgcaggacgtcagcgccaacgtgcacctcgtgaacccctccaacagcaccacgggcgcctccaccgcgttcaaccccgtccacaacgccaccaccgacgggcagaagcagagcacgtccaccaccaccatggcccgccccagcacggtgacccagatcaccaccgcccaggccatggaggtggacggctccggggagagcacgaccctgccggcggtcacccccacccccgccgagacgaccacccacgccaaccagaagtccgccagcaccatgggcacgctgaccacctccctcgaggacaccgcgctgatgacgctgaccgggcggagcatcctcacctcccagagccagaccggctccttcgaccgcacgagcaagccccagaccccgcggtccaccaaccagcccctgcgcaagctgctcagcgccgtgtccaccgaggccgcgccccagacgagccccaccgccgtgaccgccgaccagaccgaggccagcacgtccccgcaggtcaccaccgacaccagcccctccacccccacgcaggtcaccagctccgccggcagctccagctccaacaccagcaaccactccaagaccacgccccagctgaccagctccgggagcgaggcccagcagacccagccgaccacgatgcccaacaccaccgccctggtgacccccacggcgcacatctcccccaccaaccggagcaagcgcaactccgaggtcgagatcatcctcaccctgccgcagggcctgaagaagtactacagcaagatcctcaagctgctgcacctcaccctggaggaggactccgaggggctgctcgagtggtgcacgcggaccctgaagcaggcctgcgacgacggctacttccaggagcgcatcaaggagttcttcctgaccggggagggctacttcaacgaggtgctcctgttccggagccccagccagctgggcaccacggggagccccctcgcctccccgcccaccgccgagcccttcaagtccttctacgccaagggcttcctgatcatggacagcgggtacttctccgcgaagtgctaccccaaggccagcaactccggcctgcagctcatcaacatcacccagcacagcatcaaggtggtcaacacccccggcccgaagtactccaacctgaagacggtgaactgcatcaacctgaaggtgagcaccgacaaggaccactccgagctcgaggtcaacgtgctgctgccccaggtggccgtcaacatcagcaactgccacgtgctcatcaagtcccacgtgtgcgactacagcctggacaccgacgggatgatccgcctgccccaggtcacccacgagggcacgttcatcccggggacctacaagatcgtgatcgacaagaagaacaagctcaacgaccggtgcaccatgaccacgaactgcgtcatcaagggcaaggaggtgcgcaaggggcagtccaccctgcggcagtaccgcaccgagatccgggtgggccagatgagctccggcacccgccggctgctcagcgagggcggggacgggggctgcatcagccgcacgcagctgatcaagaccgagaccgccgaggtccacggggacgactacggcggccccggggagaagatcaccatctgcaacggctccaccatcgtggaccagcggctggggagcgagctcggctgctacacgatcaaccgcatcaagtccttcaagctgtgcgagaacagcgcccaggggaagaactgcgagatcgactccgcgcccgtgcagtgccggcagggctactgcctgaagatcagccaggagggccgcgggcacgtgaagctgtcccgcggcagcgagatcgtgctcgacgtgtgcgacacctcctgcgagatcatgatccccaaggggaccggcgacatcctggtcgactgcagcggcgggcagcagcacttcctgcagtccaacctcgtggacctgggctgcccgaacatccccctgctcgggaagatggccatctacatctgccggatgagcaaccaccccaagaccacgatggccttcctgttctggttctccttcggctacgtgatcacgtgcatcctgtgcaagaccctcttctacatcctgatcatcatcgggaccctgggcaagaagctcaagcagtaccgcgagctgaagccccagacctgcaccatctgcgagagcgtcccggtgaacgccatcgacgcggagatgcacgacctgaactgctcctacaacatctgcccctactgcgccagccggctcacctccgagggcctgacccgccacgtgaaccagtgccccaagcggaaggagaaggtcgaggagacggagctgtacctcaacctggagcgcatcccctggatcgtgcggaagctgctccaggtgagcgagtccaccggggtcgccctgaagcgcagcagctggatgatcgtgctgctcatcctgctgatcgtgtccatgagcccggtccagtccgcccccatcagccaggagcggaccgtggccctctaccagtcccgcgaggactacatgggcatctgcctggtgatcatggggagcgtcctgctcgcggtgtccctgctggtgcggggcctcatcgacagcatctccagcaccttcttccccgggctgtccgtctgccgcacgtgccacatcggcagcatcaacggcttcgagatcgagtcccacaagtgctactgcgggctgctctgctgcccctactgccgggcctgcagcaccgaccaggacgcccaccagttccacctgtccgtgtgcaagaagcgcaaggccggcagcaacgtgatgctggccgtctgcaagcggatgtgcttcaaggcgatcatcgaggcctccaacaaggtcctcttcatccgcaacgtgatcaacaccaccttcgtggtgtgcatcctggtgatggtcgcctgcatcgccagctccgccgcggtggagatggagaacctgccggccgggacgtgggagcgggaggaggagctcaccaacttctgccaccaggagtgccaggtgaccgagaccgagtgcctgtgcccctacgagagcttcatcctgcgcaagcccctcttcctggacagcatcgccaagggcgtcaagaacctgctcaactccacgagcctggagacctccctgagcatcgaggccccctggggcgcgatcaacgcccagtccacctacaagccgaccgccagctccgccaacatcgccctcacgtggagctccgtggagcaccgggggaacaagatcctggtgagcggccgctccgagagcatcatgaagctggaggagcgcaccgggatctcctggaacctcggcgtcgaggacgcgagcgagtcccggaccctgaccatcagcgtgatggacctgtcccagatgtacagccccgtgttcgagtacctctccggggaccgccaggtcgaggagtggcccaaggccacgtgcaccggcaactgccccgagcggtgcgggtgcaccagctccacgtgcctgtacaaggagtggccgcacagccgcaactggcggtgcaaccccacctggtgctggggcgtgggcaccgggtgcacgtgctgcggcctggacgtgaaggagctgttcaccgaccacatgctcgtcaagtggaaggtggagtacatcaagaccgaggccatcgtgtgcgtcgagctgaccagccaggagcgccagtgctccctcatcgaggccgggacccggttcagcctgggccccgtgaccatcaccctgtccgagccgcgcaacatccagcagaagctcccgcccgagctgatcacgctgcaccccaagatcgaggacggctacttcgacctcatgcacgtccagaaggtgatgagcgcctccaccgtgtgcaagctgcagagctgcacccacggggtccccggcgacctgcagatctaccacgtggggaacctcctgaagggcgaccgggtgaacgggcacctgatccacaaggtcgagccccacctcaacacctcctggatgagctgggacggctgcgacctggactacttctgcaacatgggcgactggccctcctgcacgtacaccggggtgacccagcacaaccacgcggccttcgccaacctgctcaacatcgagaccgactacacgaagaccttccacttccacagcaagcgcgtgaccgcccacggcgacacgccccagctggacctgaaggcccggccgcgctacggggcgggcgagatcaccgtcctcgtggaggtggccgacatggagctgcacaccaagaaggtcgaggtgaccgggctgaagttcgcctccctgacctgcagcggctgctacgcctgctccagcggcatctcctgcaaggtgcggatccacgtcgacgagcccgacgagctcacggtgcacgtcaagagctccgaccccgacatcgtggcggccagcagctccctgatggcccgcaagatcgagttcggggtggacagcaccttcaaggccttctccagcatgcccaaggactccctctgcttctacatcgtggagcgggactactgcaacagctgcaagaacgaggagacccagcgctgcgtcaacgccaagctggagcagccgcagtccatcctgatcgagcacaccggcacgatcatcgggaagcagaacgacacgtgcggcagccggacctcctgctggctcgacagcttcaagtccttcttctacgggctgaagtccatgctgagcggcatcttcggcaacgtgttcctcgggatcttcctgttcctggcgcccttcgccctgctcctgttcttcttcttcttcggctggcgcatcctgttctgcttcaagtgctgccggcgcacccggggcctcttcaagtaccgccacatcaaggacgacgaggaggtggggtacaagaagatcatcgagcgcctgaacaacaagaagggcaagcaccggctgctcgacggggagcgcctggccgaccggaagatcgccgagctgttcagcaccaagacccacatcggctga

SEQ ID NO: 11911 - RNA, 5085 nt, synthetic construct
  misc_feature 1..5085: note = derived and/or modified CDS sequence (opt1) from CCHFV(UCCR4413)__KY484038.1__GP
  source 1..5085: mol_type = other RNA
atgctgcgctacatcctctacgccctgctggccagcgcgatcctccaccagcacctgtacaaggtgggcgccgacacccagaagcccaccgtccggacgaacaccacccacaagatctccccgaccgccacggccaaccgcaccacctacgagcaggccacccccagcacgacccccaagtccagcaccaagcccaccacgcacatcgcgaccgcccacctggccgagtccgacgggagcggcgagaccaccctcctgctgccgacgaccgcctcccagtacaccaccgaggggcagacgagcctcgagcccaccgcggaggagaccggctccaacaccatccccagcgacacgacctccaccagccccatcaccgagaactccgagagcacggacacccagatgaacgtgtccgacagctccagctccccgctggccacccagggggcccggagccccgcccgcaacctgctcagcgtgccctccgtcgagcccggccagcagaccacgccgaagcagcccaccaccaagggcaccgtgacgcccaccaccccgcagccgaccaccagctcccccacgcccgcccccaccagcgcgaccctgtccaccaacagctccagcatctccacgccggtgcagaccagcagccccctgcagcccatggccccctcccacgagacccagcacgccctctacaccacgtccaccgagagcaccctgcggaccctgtccgccgagcgcatccacccgacgaaccggagccgccggaactccgaggtcgagatcatcctcaccctgccccaggggctgaagaagtactacagccgcctcctgaagctgctccacctgaccatggaggaggacaccgagggcctgcaggagtggtgcgtgcgggtgctcgggcagacgtgcgacgactcctacttccacaagcgcctggccgagttcttcatcaccggcaccgggttcttcaacgaggtcctcctcttccggagccccagcacccccacgaccatcaagccgtcccccaccggcagccccaccgtggagccgttccgctcctactacgcgaagggcagcctgacgatcgactccgggtacttcagcgccaagtgctacccccggacctccaacagcggcctgcagctcatcaacctgacccagcactccgtggagatcgccaacacccccgggcccaagcacagctccctgaagacgatcaactgcatcaacatcaaggccagcaccgacaaggagcacaacgaggtcgagatcaacgtgctcctgccccaggtggccatcaacctgtccaactgccacgtcagcatccgctcccacgtgtgcgactacagcctcgacaccgacggcaagatccggctgccccagatctcccacgagggcaccttcatccccgggacgtacaagatcatcatcgacaagaagaacaagctgaacgaccgctgcagcctcatcaccagctgcgtgatcaagggccgggagctgcgcaaggggcagtccaccctgcggcagtacaagaccgagatcaagatcggccagacgagctccgggagccgccgcctcctgtccgagagctccgcgagcggctgcatctcccggacccagatgatcaagagcgagaccgccgagatccacgacgacatctacggcgggcccggcgagaagctgaccatctgcaacgggaccacggtcgtggaccagcgcctcggctccgagctggggtgctacaccatcaaccggatcaagacctacaagctgtgcgagaacagcgtgaaggagaagacctgcgagatcgactccgtcccggtgaagtgccgccagggcctgtgcctcaagatcacgcaggagggccgggggcacgtgaagctgagccgcggctccgagatcgtcctggacatctgcgacagctcctgcgagctcatgatccccaaggggaccggcgacatcctggtggactgcagcgggggccagcagcacttcctgcaggacaacctcgtcgacctgggctgccccaacatccccctgctcgggaaggtggccatctacatctgccggatgtccaaccacccgaagaccaccatggccttcctgttctggttcagcttcggctacgtgatcacgtgcatcctgtgcaagatcctcttctacctgctgatcatcaccgggaccctcggcaagaagctgaagcagtaccgcgagctgaagccccagacctgcacgatctgcgagagcacccccgtcaacgccatcgacgcggagatgcacgacctcaactgctcctacaacatctgcccctactgcgccagccggctgacctccgacggcctgatccgccacgtgaacctctgcccgaagcggaaggagaaggtggaggagaccgagctgtacctgaacctcgagcgcatcccctggttcgtccggaagctgctccaggtgagcgagtccacgggggtggccctgaagcgcagctcctggctgctgatcctcgtcatcctgctgaccgtgagcatgtcccccgtgcagagcgcccccatcaaccagcagcgggcggtcgaggcctaccaggcccgcgagggctacaccgggatctgcctcttcatcctgggctccgtgctgttcatgaccagctggctcacgaaggggctgatcgactccatcggcgacagcttcttcccgggcctgttcgtgtgcaagacctgctccatcgggagcatcaacggcttcgagatcgagtcccaccggtgctactgcagcctcctgtgctgcccctactgccggacctgctccgccgacaaggacagccaccagctgcacctcagcatctgcaagaagaagaaggccgggtccaacgtcatgctggcggtgtgcaagcggatgtgcttcaaggccaccatcgaggccagcaaccgcgtgctgctcatccgctccatcatcaacacgaccttcatcatctgcatgctgatcctggtcgtgtgcgtgatcagcacctccgccgtcgagatggaggacctccccgccggcacctgggagcgggaggaggacctgacgaacttctgccaccaggagtgccaggtgaccgagaccgagtgcctgtgcccctacgaggcgttcgtgctccgcaagccgctgttcctgagctccatcgtcaaggggaagaagaacctcctgaacagcgcctccctggagaccagcctctccatcgaggccccctggggcgccatcaacgcccagagcacgttcaagcccaccatctccaccgcgaacatcgccctgagctggtccagcgtggagcaccggggcaacaaggtgctggtctccgggcgcagcgagtccatcatgaagctcgaggagcggaccggcatcagctggaacctgggggtggaggacgccagcgagtcccgcatgctgacggtgagcgtcatggacctctcccagatgtacctgccggtgttcgagtacctgagcggcgaccgccaggtggaggagtggcccaaggcgacctgcaccggggactgccccgagcgctgcggctgcacctccagcacgtgcctccacaaggagtggccccactcccggaactggcgctgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcggcagtgctccctgatcgaggccggcacccgcttcaacctggggcccgtcaccatcacgctcagcgagccccggaacatccagcagaagctgccctccgagatcgtgaccctgcacccgaagatcgaggagggcttcttcgacctcatgcacgtgcagaaggtcctgagcgcctccaccgtgtgcaagctgcagagctgcacccacggcgtggccggggacctccaggtctaccacgtgggcaacctgctgaagggggacaagatcaacggccactccatccacaagatcgagccccacctcaacacgagctggatgtcctgggacggctgcgacctggactactactgcaacatgggggactggcccagctgcacctacaccggcgtgacccagcacaaccacgccgcgttcgtcaacctgctcaacatcgagacggactacaccaagtccttccacttccacagcaagcgcgtgaccgcccacggggacacgccccagctggacctgaaggcccggccgatgtacggcgccggggagatcaccgtgctcgtcgaggtggccgacatggagctgcacagcaagaacatcgagatctccggcctgaagttcgcgagcctgacctgctccggctgctacgcctgcagctccgggatcagctgcaaggtccgcatccacgtggacgagcccgacgagctggccgtgcacgtcaagtccgacgacctggacgtggtggccgccagctccagcctcatggcgcggaagatcgagttcggcaccgactccaccttcaaggccttcagctccatgcccaaggagagcctgtgcttctacatcgtcgagcgcgacttctgcaagtcctgcgccgccgaggacacgcagaagtgcgtgaaggcgaagctggagcagccccagagcatcctgatcgagcacaaggggaccatcatcggcaagcagaacgacacgtgctccaccaagaccagctgctggctcgagtccttcaagagcttcttctacgggctgaagaacatgctgagcggcgtgttcggctccgccatcatggggatcctcctgttcctggccccgttcatcctcctgatcctgttcttcttcttcggctggcggatcctcttctgcctgcgctgctgccggcgcacccgcgggctgttcaagtacaagcacatcaaggacgacgaggaggccggctacaagaagatcatcgagaagctcaacaacaagaagggcgggaccagcaagctgctggacggcgagcggctcgccgaccgcaagatcgcggagctgttctccaccaaggcccacatcgggtga

SEQ ID NO: 11912 - RNA, 5076 nt, synthetic construct
  misc_feature 1..5076: note = derived and/or modified CDS sequence (opt1) from CCHFV(SCT ex Afghanistan)__KC344856.1__GP
  source 1..5076: mol_type = other RNA
atgcaccacgcctaccagatcatgtacaccctgctcgtgtgcgccatcctgtgcccccagccgtggagcctggagggcacccacgtccccctcaacgggacgaagcacaacggcaccgggatcaccgcggcccccggcgggtcccagggccccaccagcccggcctccacggccgtgagcctgacccccgaccccttcaccaccgagcccacggcctccgcggtggagctggagagctccggcgaggggcacaccagcctctccgtcaccacccagggcctgacgagcccggagaccacccccgggctgcccaccgtgacggacaccggcgtgtccagcacctccatcttcgggatcggcatccgcgtcgccggcgacacccccacgagcaccacccacaccgggctcccgtccagcccctccatgcccagcacggcccagggcccccaccacgccgtgcgggggctgctgtccgtgagcagcacccgcccgggcgaggcgtccaccatcaccgtccccggcgaggccgggacggaggccaacagctccagctccgccatcagcaagaagcccgccccctccccgaccgcggaggccatcaccgaggccaacaacagctccaacccccggcagcccgagctcagcacccagcccgccatcccgggcctggtgacgtccagcgcccagcccatcctgctccagtccgcgaccagcaccgccgcccaggacatctacccctcccccaccaaccgcagcaagcggaacctggagatggagatcatcctgacgctctcccaggggctgaagaagtactacggcaagatcctgcgcatcctcgacctgaccctggaggaggacaccgaggggctcctggagtggtgcaagcggaacctgggcctgacctgcaacgacaacttcttccaggagcgcatcgaggagttcttcctgaccggcgaggggcacttcaacgaggtgctgcagttcaagacgccgagcaccctctcccccaccgagcccacccacacgcggaccccgaccgtcaagcccttcaagagctacttcgcccgcggcttcctgagcatcgactccgggtacttcagcgccaagtgctactccaagaccagcaactccggcctgcagctcatcaacatcacgcagcaccccgcgcggatcgccgacacccccgggccgaagatcaccaacctgaaggccatcaactgcatcaacctgaaggccagcgtgttcaaggagcaccgcgagatcgagatcaacgtgctcctgccccaggtcgccgtgaacctgtccaactgccacgtgctcatcaagagccacgtctgcgactactccctggacatcgacggcgcggtgcggctgccccacgtgcaccacaagggcaccttcatccccgggacgtacaagatcgtcatcgacaagcgcaacaagcagaacgaccggtgcaccctcgtgaccaactgcgtgatcaagggcaaggagatccgcaaggggcagagcgccctgcggcagtaccgcaccgagatccggatcggcaaggcctccgccgggagccgccggctgctctccgaggagagcggcgacgactgcatctcccgcacgcagctgctgcgcaccgagaccgcggaggtccacaacgacaactacggcgggccgggcgacaagatcaccatctgcaacgggagcacgatcgtggaccagcggctcggctccgagctgggctgctacaccatcaaccgcgtcaagagcttcaagctgtgcgagaacagcgccaccgggaagtcctgcaagatcgacagcacccccgtgaagtgccggcagggcttctgcctgaagatcacgcaggaggggcgcggccacgtgaagctctcccgggggagcgaggtcgtgctggacgcctgcgactccagctgcgagatcatgatccccaagggcaccggcgacatcctggtggactgctccgggggccagcagcacttcctcaaggacaacctgatcgacctggggtgccccaacatcccgctcctgggcaagatggccatctacatctgccgcatgagcaaccaccccaagaccaccatggccttcctgttctggttctccttcgggtacgtcatcacgtgcatcttctgcaaggtgatcttctacctcctgatcgtggtcggcaccctgggcaagaagttcaagcagtaccgggagctcaagccccagacctgcaccatctgcgagacgacccccaccaacgcgatcgacgccgagatgcacgacctgaactgcagctacaacatctgcccgtactgcgcctcccgcctgaccagcgacgggctcgcccggcacgtgacgcagtgccccaagcgcaaggagaaggtggaggagaccgagctgtacctgaacctcgagcggatcccctggatcgtccgcaagctgctccaggtgtccgagagcaccggcgtggccctcaagcggtccagctggctgatcgtcctgctcgtgctgctgaccgtgtccctcagccccgtccagtccgcgccgatcgggcacggcaagaccatcgagacgtaccagacccgcgaggggtacatcagcgtgtgcctgttcgtgctgggcggcatcctcttcgtcgtgagctgcctgatcaaggggctggtggactccgtcggcaacagcttcttccccgggctctccatctgcaagacctgcagcatcggctccgtgaacgggttcgagatcgagagccacaagtgctactgctccctgctgtgctgcccctactgccggcactgcagcaccgaccgcgagatccaccagctccacctgtccatctgcaagaagcggcgcacgggcggcaacgtgatgctggccgtctgcaagcggatgtgcttccgcgccaccatggaggtgagcaacaaggtcctcttcatccgcaacatcatcaacaccaccttcgtgatctgcatcctgatcctggccgtgtgcgtggtctccacgagcgccgtggagatggagtccctccccgcggggacctgggagcgggaggaggacctgaccaacttctgccaccaggagtgccaggtgaccgagacggagtgcctgtgcccgtacgaggccctcgtcctgcgcaagcccctgttcctcaacagcatcgtgaagggcatgaagaacctgctgaactccaccaacctcgagaccagcctgtccatcgaggccccctggggcgccatcaacgtgcagagcaccttcaagccgacggtctccaccgcgaacatcgccctgagctggagctccgtggagcaccgggggaacaagatcctcgtgagcggccgctccgagagcatcatgaagctggaggagcggaccgggatctcctgggacctgggcgtcgaggacgccagcgagtccaagagcctcaccgtgtccgtgatggacctgagccagatgtactcccccgtcttcgagtacctgagcggggaccgccaggtggaggagtggcccaaggccacgtgcaccggcgactgccccgagcggtgcgggtgcacctccagcacgtgcctccacaaggagtggccgcactcccgcaactggcggtgcaaccccacctggtgctggggcgtgggcaccgggtgcacgtgctgcggcctggacgtcaaggacctgttcaccgactacatgttcgtgaagtggaaggtggagtacatcaagaccgaggccatcgtctgcgtggagctcaccagccaggagcgccagtgctccctgatcgaggcggggacccggttcaacctgggccccgtcaccatcacgctcagcgagccccgcaacatccagcagaagctgccgcccgagatcatcaccctgcacccccggatcgaggaggggttcttcgacctcatgcacgtgcagaaggtgctgtccgccagcaccgtctgcaagctgcagagctgcacccacggcgtgcccggcgacctccaggtgtaccacatcgggaacctgctgaagggcgacaagctcaacgggcacatgatccacaagatcgagccgcacttcaacacgtcctggatgagctgggacggctgcgacctggactactactgcaacatgggggactggccctcctgcacctacaccggcgtcacccagcacaaccacgccgccttcgtgaacctgctcaacatcgagaccgactacacgaagaacttccacttccacagcaagcgcgtgaccgcccacggcgacacgccccagctggacctgaaggcgcggcccacctacggggccggcgagatcaccgtcctcgtggaggtggccgacatggagctgcacaccaagaagatcgacatctccgggctgaagttcgccagcctgacctgcgccggctgctacgcgtgctccagcggcatctcctgcaaggtccgcatccacgtggacgagccggacgagctcaccgtgcacgtcaagagcgaggaccccgacatcgtggccgcctccacgagcctgatcgcccggaagctcgagctggggaccgactccaccttcaaggcgttcagcgccatgcccaagacctccctgtgcttctacatcgtggagcgcgagtactgcaagagctgctccaaggaggacacgcagaagtgcgtcaacaccaagctcgagcacccccagggcatcctgatcgagcacaaggggaccatcatcggcaagcagaacgacacgtgcaccgccaaggccgggtgctggctggagagcgtgaagtccttcttctacggcctcaagaacatgctgagcggcatcttcgggaacgtgttcatcggcatcttcctgttcctggccccgttcgtcctcctgatcctgttcttcatgttcgggtggcggctcctgttctgcttcaagtgctgccgccggacccgcggcctgttcaagtaccgccacctcaaggaggacgaggagagcgggtaccggcgcatcatcgagcggctgaacaacaagaagggcaagaacaagctgctcgacggcgagcgcctggcggaccggcgcatcgccgagctgttctccaccaagacccacatcgggtga

SEQ ID NO: 11913 - RNA, 5070 nt, synthetic construct
  misc_feature 1..5070: note = derived and/or modified CDS sequence (opt1) from CCHFV(SPU 431/85)__KJ682812.1__GP
  source 1..5070: mol_type = other RNA
atgcccgtgaacatcatgtacacgcccctggtctgcgccgtgatctgcctccagctgtggaacctgggcgggaccctcgtgagcaccaaccgcacccagcacaacgagaccgggaccgtcgccacccccgaggggaccctgcggccccgcctgcccgtgtccaccgccctccccaccaagagcgaccggccctccgtggggcccgccgccagctccagcgggctggagggctccggcgagcccaacaccagcccctccatcaccaccaaggggctgaccccgcccgagaccacccccgccctcccgaccgccaccgacaccgacgccagctccaccggcgtcgtggacgtgagcacccagatgaccaaggacatccccatgtccaccgcctacaccaacccgcccagcaccccgtccgcccccagcacgccccaggggacgcaccacaccgcccgcggcctgctgtccgtcgcgagcaccaagtccgaggaggtgagcatgagcacctcccccgccaagacgagcaccgagacctccagcccgccgcccgccacctccgagacgcccaccccgagccccaccacccaggtgcccacggggaacaacaaccccaacacctcccggcagccgacccccagcgcccagcccgccatgtccaacccggcgaccagccccgcccagcccaacctctcccagagcgcgccgcccaccgccgaccagggcgtccacccctcccccacgaaccgcagcaagcggaacctggagatcgagatcatcctgaccctctcccagggcctgcgcaagtactacgggaagatcctgaagctcctggacctgaccctcgaggaggacaccgagggcctgctggagtggtgcaagcggaacctcgggctgacgtgcgacgacaacttcttccagaagcgcatcgaggagttcttcctgaccggcgagggctacttcaacgaggtgctccagttcaaggtgcccagcaccctgtccagcaccgagcccacgcacacccggccgcccaccgtcgagcccttcaagtcctacttcgccaaggggttcctgagcatgaacagcggctacttctccgcgaagtgctacccgcgcaccagcaactccgggctccagctgatcaacgtgacgaagcacagcgccaagatcgccgacacccccggccccaagatcaccaacctgaagaccatcaactgcatcaacctccgggcctccgtgttcaaggagcaccgcgaggtcgagatcaacgtgctgctgccccaggtggccgtcaacctcagcaactgccacgcgcagatcaagtcccacgtgtgcgactacagcctggccacggacgggatggtgcggctgccgcacatccaccacgagggcaccttcatccccggcacctacaagatcgtcatcgacaagaagaacaagcagaacgaccgctgcaccctcgtgacgaactgcgtcatcaaggggcgggaggtgcgcaagggccagtccgccctgcggcagtacaagaccgagatccgcatcgggaaggccagctccggcagccggcgcctgctctccgaggagagcgacggggactgcatctcccgcacccagctgctgcggaccgagacgaccgagatccacagcgacaactacggcggccccggggacaagatcaccatctgcaacggctccaccatcgtggaccagcgcctcgggagcgagctgggctgctacacgatcaaccgggtcaagagcttcaagctgtgcgagaactccgccaccggcaagtcctgcgagatcgactccacccccgtgaagtgccgccagggcttctgcctcaagatcacccaggagggccgggggcacgtgaagctgagccgcggctccgagatcgtcctggacgcgtgcgacagcaactgcgagatcatgatcccgaaggggacgggcgacatcctggtggactgctccggcgggcagcagcacttcctcaaggacaacctgatcgacctgggctgccccaacatccccctcctggggaagatggccatctacatctgccggatgagcaaccaccccaagaccaccatggccttcctgttctggttctccttcggctacgtgatcacgtgcatcctctgcaaggtcatcttctacctgctgatcgtggccgggacggtgggcaagaagttcaagcagtaccgcgagctccggccgcagacctgcaccatctgcgagaccatccccgtcaacgcgatcgacgccgagatgcacgacctgaactgcagctacaacatctgcccctactgcgcctcccgcctgaccagcgacggcctcgcccggcacgtgatgcagtgcccgaagcgcaaggagaaggtggaggagacggagctgtacctgaacctcgagcggatcccctgggtcgtgcgcaagctgctccaggtgtccgagagcaccggggtcgccctcaagcggtccagctggctgaccgtgctgctcgtgctgctgatcgtctccctcagccccgtgcagtccgcgcccatcggccacgggaagaccatcgagacgtaccaggcccgcgagggctacaccagcttctgcctgttcatcctggggagcatcctcttcgtggtctcctgcctggtgaagggcctgatcgacagcgtgggcaactccttcttcccggggctcagcatctgcaagacctgctccatcggcagcatcaacgggttcgagatcgagtcccacaagtgctactgcagcctgttctgctgcccctactgccggcactgccccgccgaccgcgagatccacaagctgcacctctccatctgcaagaagcggaagaccggcagcaacgtcatgctggccgtgtgcaagcgcatgtgcttccgcgccacgatcgaggtgtccaaccgggcgctgctcatccgcaacatcatcaacaccaccttcgtcgtgtgcatcctgaccctggccgtgtgcgtcgtgagcacgtccgccgtggagatggagagcctccccgccgggacctgggagaaggaggaggacctgaccaacttctgccaccaggagtgccaggtcaccgagacggagtgcctgtgcccgtacgaggccctcgtgctgcggaagcccctgttcctcgactccatcgtgaagggccgcaagaacctgctgaacagcacctccctcgagaccagcctgtccatcgaggcgccctggggcgccatcaacgtccagagcaccttcaagcccacggtgagcgccgccaacatcgcgctgtcctggagctccgtggagcaccgggggaacaagatcctcgtcagcggccgctccgagagcatcatgaagctggaggagcggaccgggatctcctgggacctgggcgtggaggacgccagcgagtccaagctcctgaccgtgagcgtcatggacctgtcccagatgtacagcccggtgttcgagtacctctccggggaccgccaggtggaggagtggcccaaggcgacctgcacgggcgactgccccgagcggtgcggctgcaccagcagcacgtgcctgcacaaggagtggccccacagccgcaactggcggtgcaacccgacctggtgctggggcgtcggcaccgggtgcacgtgctgcggcctggacgtgaaggacctcttcaccgactacatgttcgtgaagtggaaggtcgagtacatcaagaccgaggccatcgtgtgcgtcgagctgacgtcccaggagcgccagtgcagcctgatcgaggccggcacccggttcaacctcgggcccgtgaccatcaccctgtccgagccccgcaacatccagcagaagctgcccccggagatcatcacgctccacccccggatcgaggagggcttcttcgacctgatgcacgtgcagcgcgtcctgagcgcgagcaccgtgtgcaagctccagtcctgcacccacggggtgcccggcgacctgcaggtctaccacatcgggaacctgctcaagggcgacaaggtgaacggccacctgatccacaagatcgagccccacttcaacaccagctggatgtcctgggacgggtgcgacctggactactactgcaacatgggcgactggccgagctgcacctacacgggggtgacccagcacaaccacgccgccttcgtcaacctcctgaacatcgagaccgactacaccaagaacttccacttccactccaagcgggtgacggcccacggcgacacgccccagctggacctcaaggcccgccccacctacggggcgggcgaggtgaccgtcctggtggaggtggccgacatggagctgcacacgaagaagatcgagatcagcggcctcaagttcgcctccctgacctgcaccgggtgctacgcctgcagctccggcatcagctgcaaggtcaagatccacgtggacgagcccgacgagctgaccgtgcacgtcaagtccgaggacccggacatcgtggccgcggggagctccctcatggcccggaagctggagttcggcgccgacagcacgttcaaggccttctccgcgatgcccaagaccagcctgtgcttctacatcgtggagcgcgagtactgcaagtcctgcagccgggaggacacccgcaagtgcgtcaacaccaagctcgaccgcccccagtccatcctgatcgagcacaaggggacgatcatcggcaagcagaacaacacgtgcaccgccaaggccagctgctggctggagagcgtgaagtccttcttctacggcctcaagaacatgctgagcgggatcttcggcaacgtgttcatcgggatcttcctgttcatcgccccgttcgtcctcctgatcctgttcttcatgttcggctggcggatcctgttctgcttcaagtgctgccgccggacccgcggcctcttcaagtaccggcacctgaaggacgacgaggagacggggtaccgcaagatcatcgagcggctgaacaacaagaagggcaagaacaagctcctggacggggagcgcctggccgaccggaagatcgcggagctgttctccaccaagagccacatcggctga

SEQ ID NO: 11914 - RNA, 5070 nt, synthetic construct
  misc_feature 1..5070: note = derived and/or modified CDS sequence (opt1) from CCHFV(SPU 556/87)__KJ682811.1__GP
  source 1..5070: mol_type = other RNA
atgaccgtgaacaccgtctgcacgcccctggtgtgcgccgtgttctgcctccagctgtggaacctgggcgggaccctcgtcccgaccaaccgcacccagcacaacaagacgggcaccatggccacccccgaggggaccctgggcccccggctgcccgtgagcacggcgctcccgaccaagtccgaccgccccagcgtggggcccgccgccccctccagcggcctggagggctccggggagccgaacaccagcccctccatcaccacgaagggcctggccctccccgagaccacccccgccccgcccaccgcgacggacaccgacgccagctccaccggggtcgtgaacgtgagcacccagatgacgaaggacatccccatgtccaccgcctacaccaacccgcccagcaccccctccgcccccagcacgccccagggcacccaccacaccgcgcgggggctgctgtccgtcgccagcaccaagtccgaggaggtgagcatgtccacgagcccgggcaagaccagcaccgagacctccagcccgccgcccgccacgtccgagacccccgcccccagccccaccacccaggcccccacgggcaacaacaaccccaacacctcccgccagcccacccccagcgcgcagccggccatgtccaaccccaccaccagccccgcccagcccaacctcctgcagaacgccccgcccacggccgaccagggggtgcaccccggccccaccaaccggtccaagcgcaacctggagatggagatcatcctcaccctgagccaggggctgcggaagtactacggcaagatcctcaagttcctggacctgaccctcgaggaggacacggagggcctgctggagtggtgcaagcgcaacctcgggctgacctgcgacgacaacttcttccagaagcggatcgaggagttcttcctgaccggcgaggggtacttcaacgaggtcctccagttcaaggtgccgtccaccctgagctccacggagcccacccacaccggcagccccaccgtggagcccttcaagtcctacttcgcgaaggggttcctgagcatgaactccggctacttcagcgccaagtgctacccgcgcacgtccaacagcggcctccagctgatcaacgtcaccaagcacagcgccaagatcgccgacacccccgggcccaagatcaccaacctgaagacgatcaactgcatcaacctccgggcctccgtgttcaaggagcaccgcgaggtggagatcaacgtcctgctgccccaggtggcggtgaacctcagcaactgccacgcccagatcaagtcccacgtctgcgactacagcctggccaccgacggcatggtgcggctgccgcgcatccaccacgaggggaccttcatccccggcacctacaagatcgtgatcgacaagaagaacaagcagaacgaccggtgcacgctcgtcaccaactgcgtgatcaaggggcgcgaggtccggaagggccagtccgccctgcgccagtacaagaccgagatccggatcggcaaggccagctccgggagccgccggctgctctccgaggagagcgacggcgactgcatctcccgcacccagctgctgcgcacggagaccgcggagatccacagcgacaactacgggggccccggggacaagatcaccatctgcaacggctccaccatcgtggaccagcggctcggcagcgagctggggtgctacacgatcaaccgcgtgaagtccttcaagctgtgcgagaacagcgccaccggcaagtcctgcgagatcgacagcacccccgtcaagtgccggcaggggttctgcctcaagatcacccaggagggccgcggccacgtgaagctgagccgggggtccgagatcgtgctggacgcctgcgacagctcctgcgagatcatgatcccgaagggcacgggggacatcctggtcgactgcagcggcgggcagcagcacttcctcaaggacaacctgatcgacctgggctgccccaacatccccctcctgggccgcatggccatctacatctgccggatgtccaaccaccccaagaccaccatggcgttcctgttctggttcagcttcgggtacgtgatcacgtgcatcctctgcaaggtgatcttctacctgctgatcgtcgccggcaccgtggggaagaagttcaagcagtaccgcgagctccggccgcagacctgcaccatctgcgagaccacccccgtgaacgccatcgacgccgagatgcacgacctgaactgctcctacaacatctgcccctactgcgccagccgcctgacgtccgacggcctcgcgcggcacgtcatgcagtgcccgaagcgcaaggagaagatcgaggagaccgagctgtacctgaacctcgagcggatcccctgggtggtgcgcaagctgctgcaggtcagcgagtccaccggggtggccctcaagcggagctcctggctgaccgtgctgctcgtcctgctgatcgtgagcctctcccccgtgcagagcgcccccatcggccacggcaagacgatcgagacctaccaggcccgcgaggggtacacctccttctgcctgttcatcctgggcagcatcctcttcatcgtctcctgcctggtgaaggggctgatcgacagcgtgggcaacagcttcttcccggggctctccatctgcaagacctgcagcatcggctccgtcaacggcttcgagatcgagagccacaagtgctactgctccctgttctgctgcccctactgccggcactgcagcgccgaccgcgagatccacaagctgcacctctccatctgcaagaagcggaagacggggagcaacgtgatgtccgcggtgtgcaagcgcatgtgcttccgcgccaccatcgaggtcagcaaccgggccctgctgatccgctccatcatcaacaccaccttcgccgtgtgcatcctcacgctggccgtgtgcgtcgtgagcacctccgcggtggagatggagagcctgcccgccggcacctgggagcgggaggaggacctcaccaacttctgccaccaggagtgccaggtcacggagaccgagtgcctgtgcccctacgaggccctggtgctccgcaagccgctgttcctggactccatcgtgaaggggaagaagaacctcctgaacagcacctccctggagaccagcctctccatcgaggccccctggggcgcgatcaacgtccagagcacgttcaagcccaccgtgagcgccgccaacatcgccctgtcctggagctccgtggagcaccgggggaacaagatcctggtcagcggccgctccgagagcatcatgaagctcgaggagcggaccggcatctcctgggacctgggggtggaggacgccagcgagtccaagctgctcaccgtgagcgtcatggacctgtcccagatgtacagccccgtgttcgagtacctgtccggcgaccgccaggtggaggagtggccgaaggcgacgtgcaccggggactgccccgagcggtgcggctgcaccagctccacgtgcctccacaaggagtggccccacagccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcacctcccaggagcgccagtgcagcctgatcgaggccggcacccggttcaacctggggccggtcaccatcacgctctccgagccccgcaacatccagcagaagctgccgcccgagatcatcaccctgcacccccggatcgaggagggcttcttcgacctcatgcacgtgcagaaggtcctgagcgccagcaccgtgtgcaagctgcagtcctgcacccacggcgtgcccggggacctccaggtctaccacatcggcaacctgctgaagggggacaaggtgaacggccacctcatccacaagatcgagccccacttcaacaccagctggatgtcctgggacgggtgcgacctggactactactgcaacatgggcgactggcccagctgcacgtacaccggcgtgacccagcacaaccacgccgcgttcgtcaacctgctcaacatcgagaccgactacacgaagaacttccacttccactccaagcgcgtgaccgcccacggggacaccccgcagctggacctgaaggcccggcccacctacggcgccggggaggtgacggtcctcgtggaggtggccgacatggagctgcacaccaagaagatcgagatcagcggcctgaagttcgcgtccctcagctgcaccgggtgctacgcctgctccagcggcatctcctgcaaggtccgcatccacgtggacgagcccgacgagctgaccgtgcacgtcaagagcgaggaccccgacatcgtggccgccggctccagcctgatggcgcggaagctcgagttcggggccgactccacgttcaaggccttcagcgccatgccgaagacctccctgtgcttctacatcgtggagcgcgagtactgcaagagctgctcccgggaggacacccagaagtgcgtcaacaccaagctggagcgcccccagagcatcctcatcgagcacaagggcacgatcatcgggaagcagaacgacacgtgcaccgccaaggcgagctgctggctggagtccgtcaagagcttcttctacggcctgaagtccatgctcagcggcatcttcgggaacgtgttcatcggcatcttcctgttcatcgcccccttcgtgctgctcatcctgttcttcatgttcgggtggcgcatcctgttctgcttcaagtgctgccggcgcacccggggcctgttcaagtaccgccacctcaaggacgacgaggagaccgggtaccggaagatcatcgagcgcctgaacaacaagaagggcaagaacaagctgctcgacggcgagcggctggccgaccgcaagatcgccgagctgttctccaccaagagccacatcgggtga

SEQ ID NO: 11915 - RNA, 5070 nt, synthetic construct
  misc_feature 1..5070: note = derived and/or modified CDS sequence (opt1) from CCHFV(SPU 18/88)__KJ682810.1__GP
  source 1..5070: mol_type = other RNA
atgcccttcaacatcatgtacaccccgctgctctgcgccatcctgtgcctgcagctctggagcctggagggcatctacgggctgtccaacaagacccagcacaacgacacgagcaccatcaaggtgcccgaggagtcccagaagaccagcctccccgccaacaccgcgtcccccatcacgagcgacccgtccagcgccacctccaccgccctggccagcggccccgaggggtccggcgacaccagcacgtcccccagcgtcaccacccaggggcccaccctgctcgagacgaccccggagccccacaccaccatcgacatcgacgagtccagcacggccatcgcggacatctccacccagaccgtgaaggacatccccacccccacgacccacaccagcctgccgtccacccccagcgcccccacgatcccccaggaggcccaccacaccgcccgcggcctgctcagcgtgacctccaccaagccgggcgagacgagcacccccacctcccccggggaggcgagcaccgaggcctccagcccccagccgacgatctccgagacccccagcccgccgcccaccacccaggcccccacggagatcaacaaccccaacacctcccggcagcccatgcccagcacccagcccgccgcccccaactccgtcaccccgcccgtgcagcccaccttcagccagtccgacgtgagcacggtcgcgcaggacatccacccctccccgaccaaccgcagcaagcggaacctggagatggagatcatcctgaccctctcccagggcctgaagaagtactacgggaaggtgctgaagctcctggacctgaccctcgaggaggacacggagggcctgctggagtggtgcaagcgcaacctcgggctgacctgcgacgacaacttcttccagaagcggatcgaggagttcttcctgaccggcgagggccacttcaacgaggtgctccagttcaagacccccagcacgctgtcccccaccgagcccgcccgcgtcgagagcccgaccgtggagcccttcaagagctacttcgccaaggggttcctgtccatggacagcggctacttctccgccaagtgctaccccaagagctccaacagcgggctccagctgatcaacgtgacccagcactccatccggatcacggacacccccggcccgaagatcaccagcctgaagaccatcaactgcatcaacctcaaggccctggtcttcaaggagcaccgcgagatcgagatcaacgtgctgctcccccaggtggcggtcaacctgtccaactgccacgtgctgatcaagagccacgcctgcgactactccctcgacatcgacggccccgtgcggctgccccgcatccaccacgaggggacgttcatcccgggcacctacaagatcgtcatcgacaagaagaacaagcagaacgaccggtgcaccctggtgaccaactgcgtgatcaaggggcgcgagatccggaagggccagagcgtcctccgccagtaccggacggagatcaagatcgggaaggcctccagcggctcccgccggctgctgagcgaggagtccaacgacgactgcctcagccgcacccagctgctgcggaccgagaacgccgagatccacagcgacaactacggcgggcccggcgacaagatcaccatctgcaacgggtccacgatcgtggaccagcgcctcggcagcgagctggggtgctacaccatcaaccgggtgaagtccttcaagctgtgcgagaacagcgccaccggcaagtcctgcgagatcgacagcacccccgtccgctgccgccagggcttctgcctgaagatcacgcaggaggggcggggccacgtgaagctctcccgcgggagcgaggtcgtgctggacgcgtgcgactccagctgcgagatcatgatccccaagggcaccggggacatcctggtggactgctccggcggccagcagcacttcctcaaggacaacctggtcgacctggggtgcccgaacatccccctcctgggcaagatggccatctacatctgccggatgagcaaccaccccaagaccaccatggggttcctgttctggttctccttcggctacgtgatcacgtgcatcctctgcaaggtgatcttctacctgctgatcgtcgtgggcaccctcgggaagaagttcaagcagtaccgcgagctgaagccccagacctgcaccatctgcgagacgaacccggtgaacgccatcgacgccgagatgcacgacctgaactgcagctacaacatctgcccctactgcgcctcccggctcaccagcgacggcctggcgcgccacgtcatgcagtgccccaagcggaaggagaagatcgaggagaccgagctgtacctcaacctggagcgcatcccgtgggtggtgcggaagctgctccaggtctccgagagcaccggggtggccctgaagcgctccagctggctggtgatcctcctggtcctgctcaccgtgagcctgtcccccgtgcagagcgcccccatctcccacggcgagacggtcgaggtgtaccagacccgggaggggtacaccagcatctgcctgttcgtgctcggctccatcctgttcctggtcagctgcctcatgaagggcctggtggactccgtggggaacagcttctcccccggcctgagcatctgcaagacctgctccatcgggagcatcaacggcttcgagatcgagtcccacaagtgctactgcagcctcttctgctgcccgtactgccgccactgctccgccgacatcgagatccacaagctgcacctgagcatctgcaagaagcggaagacggggtccaacgtcatgctcgcggtgtgcaagcgcatgtgcttccgggccaccgtggaggtcagcaacaaggccctgctgatccgcaacatcatcaacaccaccttcgtggtgtgcatcctcatcctggccgtctgcgtggtgtccacgagcgccgtcgagatggagaacctgcccgcgggcacctgggagaaggaggaggacctcaccaacttctgccaccaggagtgccaggtgaccgagacggagtgcctgtgcccctacgaggccctggtgctccggaagcccctgttcctggacagcatcgtcaagggcaagaagaacctcctgaactccaccagcctggagacctccctcagcatcgaggccccgtggggcgccatcaacgtgcagtccaccttcaagcccacggtgagcgccgcgaacatcgccctgtcctggagctccgtcgagcaccgcgggaacaagatcctggtgagcgggcggtccgagagcatcatgaagctcgaggagcgcaccggcatctcctgggacctgggggtggaggacgccagcgagtccaagctgctcaccgtcagcgtgatggacctgtcccagatgtacagccccgtgttcgagtacctgtccggcgaccgccaggtcgaggagtggcccaaggcgacctgcacgggcgactgcccggagcggtgcgggtgcaccagcagcacgtgcctccacaaggagtggccccactcccgcaactggcggtgcaaccccacctggtgctggggcgtggggaccggctgcacgtgctgcgggctggacgtgaaggacctgttcaccgactacatgttcgtcaagtggaaggtggactacatcaagaccgaggccatcgtgtgcgtcgagctcaccagccaggagcgccagtgctccctgatcgaggccggcacccggttcaacctgggccccgtgaccatcaccctcagcgagccgcgcaacatccagcagaagctgccgcccgagatcgtcacgctgcacccccggatcgaggaggggttcttcgacctcatgcacatccagaaggtgctgtccgccagcaccgtgtgcaagctgcagtcctgcacccacggcgtccccggggacctccagatctaccacatcggcaacctgctgaagggcgacaaggtgaacgggcacctcatccacaagatcgagccccacttcaacaccagctggatgtcctgggacggctgcgacctggactactactgcaacatgggggactggcccagctgctcctacacgggcgtgacccagcacaaccacgccgccttcgtcaacatgctgaacatcgagaccgactacaccaagaacttccacttccacagcaagcgcgtgaccgcgcacggggacacgccccagctcgacctgaaggcccggccgacctacggcgccggcgagatcaccgtgctggtcgaggtggccgacatggagctccacaccaagaagatcgagatctccgggctgaagttcgccagcctgacgtgcaccggctgctacgcgtgctccagcgggatctcctgcaaggtgcgcatccacgtcgacgagcccgacgagctcaccgtgcacgtcaagagcgaggaccccgacatcgtggccgcctccagcagcctgatggcccggaagctggagttcggcaccgactccacgttcaaggccttcagcgcgatgcccaagacctccctctgcttctacatcgtggagcgcgagtactgcaagagctgctccaaggaggacacccagaagtgcgtgaacaccaagctggagcagccgcagagcatcctgatcgagcacaaggggacgatcatcggcaagcagaacgacacgtgcaccggcaaggccgggtgctggctcgagtccatcaagagcttcttctacggcctgaagaacatgctgtccgggatcttcggcaacgtcttcatcgggatcttcctgttcctcgcccccttcatcatgctgatcctgttcttcatgttcggctggcggatcctcttctgcttcaagtgctgccgccggacccgcggcctgttcaagtaccggcacctgaaggacgacgaggagatcgggtaccgcaagatcatcgagcggctcaagaacaagaagggcaagaacaagctgctggacggggagcgcctcgccgaccggaagatcgccgagctgttcagcaccaagacccacatcggctga

SEQ ID NO: 11916 - RNA, 5070 nt, synthetic construct
  misc_feature 1..5070: note = derived and/or modified CDS sequence (opt1) from CCHFV(SPU 497/88)__KJ682808.1__GP
  source 1..5070: mol_type = other RNA
atgcccttcaacatcatgtacaccccgctgctctgcgccatcctgtgcctgcagctctggagcctggagggcatctacgggctgtccaacaagacccagcacaacgacacgagcaccatcaaggtgcccgaggagtcccagaagaccagcctccccgccaacatcgcgtcccccaccacgagcgacccgccctccgccaccagcaccgcctccgccagcggccccgaggggtccggcgacaccagcacgtcccccagcgtcaccacccaggggccgacccccctggagatcacgcccgagccccacaccaccatcgacatcgacaagtccagcacctccatcgccgacatcagcacgcgcaccgtgaaggacatcccgacccccaccacgcacacctccctgcccagcacccccagcgcgccgaccatcccccaggaggtgcaccacacggcccggggcctcctgtccgtcaccagcaccaagcccgaggaggcctccaccctgacgagccccggcgaggcctccaccgaggcgagctccccgcagcccaccatcagcgagaccccctcccccccgcccacgacccaggcccccaccgagatcaacaaccccaacaccagccgccagccgatgccctccacgcagcccgccgccccgaacagcgtgaccccccccgtgcagcccaccttctcccagagcgacgtctccaccgccgcgcaggacatccacccgagccccaccaaccggtccaagcgcaacctcgagatggagatcatcctgacgctgagccaggggctcaagaagtactacggcaaggtgctgaagctgctcgacctgaccctggaggaggacaccgaggggctcctggagtggtgcaagcggaacctgggcctcacctgcgacgacaacttcttccagaagcgcatcgaggagttcttcctgacgggggagggccacttcaacgaggtgctgcagttcaagaccccctccaccctcagccccaccgagccggcccgggtcgagagccccacggtggagcccttcaagtcctacttcgccaagggcttcctgagcatggactccgggtacttcagcgccaagtgctaccccaagtccagcaactccggcctgcagctcatcaacgtgacccagcacctgatccgcatcaccgacaccccggggcccaagatcacgaacctgaagaccatcaactgcatcaacctcaaggccctggtcttcaaggagcaccgggagatcgagatcaacgtgctgctcccccaggtggcggtcaacctgagcaactgccacgtgctgatcaagtcccacgtgtgcgactacagcctcgacatcgacggccccgtccgcctgccgcggatccaccacgagggcaccttcatccccgggacctacaagatcgtgatcgacaagaagacgaagcagaacgaccgctgcaccctggtgaccaactgcgtcatcaagggccgggagatccgcaaggggcagtccgtgctccggcagtaccgcaccgagatcaagatcggcaaggccagctccgggagccggcgcctgctgtccgaggagagcaacgacgactgcctctcccggacgcagctgctgcgcaccgagaacgccgagatccacagcgacaactacggcggccccggggacaagatcaccatctgcaacggcagcaccatcgtggaccagcggctcgggtccgagctgggctgctacacgatcaaccgcgtcaagagcttcaagctgtgcgagaactccgccaccgggaagagctgcgagatcgactccacccccgtgcgctgccggcagggcttctgcctgaagatcacccaggagggcaaggggcacgtcaagctcagccgcggctccgaggtggtgctggacgcctgcgacagctcctgcgagatcatgatcccgaaggggacgggcgacatcctggtcgactgcagcgggggccagcagcacttcctcaaggacaacctggtggacctgggctgccccaacatccccctcctggggaagatggcgatctacatctgccggatgtccaaccaccccaagaccaccatggtgttcctgttctggttcagcttcggctacgtcatcacctgcatcctctgcaaggtgatcttctacctgctgatcgtggtcgggacgctcggcaagaagttcaagcagtaccgcgagctgaagccgcagacctgcaccatctgcgagaccaaccccgtgaacgccatcgacgccgagatgcacgacctgaactgctcctacaacatctgcccctactgcgccagccggctcacgtccgacggcctggcccgccacgtgatgcagtgcccgaagcggaaggagaagatcgaggagaccgagctgtacctcaacctggagcgcatcccctgggtcgtgcggaagctgctccaggtgagcgagtccaccggggtcgcgctgaagcgcagctcctggctggtgatcctcctggtgctgctcaccgtcagcctgagccccgtgcagtccgcccccatcagccacggcgagaccgtggaggtctaccagacgcgggaggggtacacctccatctgcctgttcgtgctcggcgggatcctgttcctggtgagctgcctcatgaagggcctggtcgactccgtgggcaacagcttcttcccggggctgtccatctgcaagacctgcagcatcggctccatcaacgggttcgagatcgagagccacaagtgctactgctccctcttctgctgcccctactgccgccactgcagcgccgacatcgagatccacaagctgcacctgtccatctgcaagaagcggaagacctggagcaacgtgatgctcgccgtctgcaagcgcatgtgcttccgggcgacggtggaggtgtccaacaaggccctgctgatccgcaacatcatcaacaccaccttcgtcgtgtgcatcctcatcctggccatctgcgtggtcagcacctccgccgtggagatggagaacctgcccgccggcacgtgggagaaggaggaggacctcaccaacttctgccaccaggagtgccaggtgaccgagaccgagtgcctgtgcccctacgaggcgctggtcctccggaagccgctgttcctggacagcatcgtgaaggggatgcgcaacctcctgaactccacgagcctggagaccagcctctccatcgaggccccctggggcgccatcaacgtgcagagcaccttcaagcccaccgtctccgccgccaacatcgcgctgagctggtccagcgtggagcaccggggcaacaagatcctggtgtccgggcgcagcgagtccatcatgaagctcgaggagcgcacgggcatcagctgggacctgggggtcgaggacgcctccgagagcaagctgctcaccgtgtccgtgatggacctgagccagatgtactcccccgtcttcgagtacctgagcggcgaccggcaggtggaggagtggccgaaggccacctgcaccggggactgccccgagcgctgcggctgcacgtccagcacctgcctccacaaggagtggccccactcccggaactggcgctgcaaccccacctggtgctggggcgtggggaccggctgcacgtgctgcgggctggacgtcaaggacctgttcaccgactacatgttcgtgaagtggaaggtggactacatcaagaccgaggccatcgtctgcgtggagctcaccagccaggagcggcagtgcagcctgatcgaggccggcacgcgcttcaacctggggccggtcaccatcaccctctccgagccccggaacatccagcagaagctgccccccgagatcgtgaccctgcacccgcgcatcgaggagggcttcttcgacctcatgcacatccagaaggtgctgagcgcgtccacggtctgcaagctgcagagctgcacccacggcgtgcccggggacctccagatctaccacatcggcaacctgctgaagggggacaaggtgaacggccacctcatccacaagatcgagccccacttcaacacctcctggatgagctgggacggctgcgacctggactactactgcaacatgggggactggccctcctgcagctacaccggcgtcacgcagcacaaccacgccgccttcgtgaacatgctgaacatcgagaccgactacaccaagaacttccacttccactccaagcgggtgaccgcccacggggacaccccgcagctcgacctgaaggcgcgccccacgtacggcgccggggagatcaccgtcctggtggaggtggccgacatggagctccacaccaagaagatcgagatcagcggcctgaagttcgcctccctgacctgcacgggctgctacgcctgcagctccgggatcagctgcaaggtccggatccacgtggacgagcccgacgagctcaccgtgcacgtcaagtccgaggaccccgacatcgtggcggccagctccagcctgatggcccgcaagctggagttcggcaccgactccaccttcaaggccttcagcgccatgccgaagacgagcctctgcttctacatcgtggagcgggagtactgcaagtcctgcagcaaggaggacacccagaagtgcgtcaacaccaagctggagcagccccagtccatcctgatcgagcacaaggggaccatcatcggcaagcagaacgacacgtgcaccgcgcgcgccagctgctggctcgagtccatcaagagcttcttctacgggctgaagaacatgctgtccggcatcttcggcaacgtgttcatcgggatcttcctgttcttcgcccccttcatcatgctcatcctgttcttcatgttcggctggcggatcctgttctgcttcaagtgctgccgccggacccgcgggctcttcaagtaccggcacctgaaggacgacgaggaggtgggctaccgcaagatcatcgagcggctgaacaacaagaaggggaagaacaagctcctggacggcgagcgcctggccgaccgcaagatcgccgagctcttcagcaccaagacgcacatcggctga

SEQ ID NO: 11917 - RNA, 5070 nt, synthetic construct
  misc_feature 1..5070: note = derived and/or modified CDS sequence (opt1) from CCHFV(SPU 130/89)__KJ682807.1__GP
  source 1..5070: mol_type = other RNA
atgcccttcaacatcatgtacaccccgctgctctgcgccatcctgtgcctgcagctctggagcctggagggcatctacgggctgtccaacaagacccagcacaacgacaacagcacgaccaaggcccccgaggagtcccacaagaccagcctccccgcgaacaccgcctcccccatcacgagcgacccgccctccaccaccagcaccacgtccgccagcggccccgaggggtccggcgacaccagcacctccccgcccgtgaccacgcaggggcccgccagccccgagaccacccccgagccgcacaccacgatcgacatcgacaagtccagcaccgccatcgcggacatctccacccagaccgtcaaggacatccccacgcccaccacccacaccagcctgccctccacgctgagcgccccgaccatcccccaggaggcccaccacaccgcccgcggcctcctgagcgtgacccggcacaagcccggcgaggcgtccaagcccacgagcccgggggaggcctccaccgaggccagctccagccagcccaccatctccgagacccccagcccgccgcccacgacccaggcccccaccgagatcaacaaccccaacacctcccgccagccgatgcccagcacgcagcccgccgcgccgtccagcgtgacccaccccgcccagcccaccccctcccagagcgacgtcccgaccgccgcccaggacatccacccctcccccaccaaccggagcaagcgcaacctggagatggagatcatcctcacgctgtcccagggcctgaagaagtactacgggaaggtgctcaagctgctggacctcaccctggaggaggacaccgagggcctgctcgagtggtgcaagcggaacctggggctgacctgcgacgacaacttcttccagaagcgcatcgaggagttcttcctcacgggcgagggccacttcaacgaggtgctgcagttcaagacccccagcaccctgtccccgaccgagcccgcccgggtcgagagccccacggtggagcccttcaagagctacttcgcgaaggggttcctctccatggacagcggctacttctccgccaagtgctaccccaagagctccaacagcgggctgcagctgatcaacgtgacccagcacctcatccgcatcaccgacacccccggccccaagatcacgaacctgaagaccatcaactgcatcaacctgaaggccctcgtcttcaaggagcaccgggagatcgagatcaacgtgctgctgccccaggtggccgtcaacctctccaactgccacgtgctgatcaagagccacgtgtgcgactactccctggacatcgacggcccggtccgcctccccagcatccaccacgaggggaccttcatccccggcacctacaagatcgtgatcgacaagaagaacaagcagaacgaccggtgcacgctggtgaccaactgcgtcatcaaggggcgcgagatccggaagggccagtccgtgctgcgccagtaccggaccgagatcaagatcgggaaggccagctccggcagccgccggctcctgtccgaggagcccaactacgactgcctgagccgcacccagctcctgcggacggagaacgcggagatccactccgacaactacggcgggccgggcgacaagatcaccatctgcaacgggagcaccatcgtggaccagcgcctgggcagcgagctcgggtgctacaccatcaaccgggtcaagtccttcaagctgtgcgagaacagcgccacgggcaagtcctgcgagatcgacagcacccccgtgcgctgccgccagggcttctgcctgaagatcacccaggaggggcggggccacgtgaagctgtcccgcgggagcgaggtcgtgctcgacgcctgcgactccagctgcgagatcatgatccccaagggcaccggggacatcctggtcgactgctccggcggccagcagcacttcctgaaggacaacctcgtggacctggggtgccccaacatcccgctgctcggcaagatggccatctacatctgccggatgagcaaccaccccaagacgaccatggccttcctgttctggttctccttcgggtacgtgatcacgtgcatcctgtgcaaggtcatcttctacctcctgatcgtggtgggcaccctgggcaagaagttcaagcagtaccgcgagctcaagccccagacctgcaccatctgcgagaccaacccggtcaacgcgatcgacgccgagatgcacgacctgaactgcagctacaacatctgcccctactgcgcctcccggctgaccagcgacgggctcgcccgccacgtgatgcagtgccccaagcggaaggagaagatcgaggagacggagctgtacctgaacctcgagcgcatcccctgggtggtccggaagctgctccaggtgtccgagagcaccggcgtggcgctgaagcgctccagctggctggtcgtgctgctcgtgctgctgaccgtctccctcagcccggtgcagagcgcccccatctcccacggggagaccgtggaggtctaccagacccgggagggctacacgagcatctgcctgttcgtgctggggtccatcctcttcctggtgagctgcctgatgaagggcctcgtcgactccgtgggcaacagcttcttccccgggctgtccatctgcaagacctgcagcatcggctccatcaacgggttcgagatcgagagccacaagtgctactgctccctgttctgctgcccctactgccgccactgcagcgccgacatcgagatccacaagctccacctgtccatctgcaagaagcggaagaccggcagcaacgtgatgctggccgtctgcaagcgcatgtgcttccgggccaccgtggaggtgtccaacaaggcgctcctgatccgcaacatcatcaacacgaccttcgtcgtgtgcatcctgatcctcgccgtgtgcgtcgtgagcacctccgccgtggagatggagaacctgccggccgggacctgggagaaggaggaggacctgacgaacttctgccaccaggagtgccaggtcaccgagaccgagtgcctctgcccctacgaggccctggtgctgcggaagcccctcagcctggactccatcgtgaagggcatgaagaacctgctcaacagcaccagcctggagacgtccctgagcatcgaggcgccctggggcgccatcaacgtccagtccaccttcaagccgaccgtgagcgccgccaacatcgccctctcctggagctccgtggagcaccgcgggaacaagatcctggtcagcggccggtccgagagcatcatgaagctggaggagcgcaccgggatctcctgggacctcggcgtggaggacgcgagcgagtccaagctgctgacggtgagcgtcatggacctctcccagatgtacagccccgtgttcgagtacctgtccggggaccgccaggtggaggagtggcccaaggcgacctgcaccggcgactgccccgagcggtgcggctgcaccagctccacgtgcctgcacaaggagtggccgcacagccgcaactggcggtgcaaccccacctggtgctggggcgtcgggaccgggtgcacgtgctgcggcctcgacgtgaaggacctgttcaccgactacatgttcgtgaagtggaaggtcgactacatcaagaccgaggccatcgtgtgcgtggagctgaccagccaggagcgccagtgctccctcatcgaggccgggacccggttcaacctgggccccgtcacgatcaccctgagcgagccccgcaacatccagcagaagctcccgcccgagatcgtgaccctgcacccccggatcgaggagggcttcttcgacctgatgcacatccagaaggtcctctccgccagcaccgtgtgcaagctgcagtcctgcacgcacggggtgcccggcgacctgcagatctaccacatcgggaacctcctgaagggcgacaaggtcaacggccacctgatccacaagatcgagccgcacttcaacaccagctggatgtcctgggacgggtgcgacctcgactactactgcaacatgggcgactggcccagctgctcctacaccggggtgacccagcacaaccacgccgccttcgtgaacatgctgaacatcgagacggactacaccaagaacttccacttccacagcaagcgcgtcaccgcccacggcgacacgccccagctggacctcaaggcccggcccacctacggggcgggcgagatcaccgtgctggtggaggtcgccgacatggagctgcacaccaagaaggtggagatctccggcctcaagttcgccagcctgacctgcaccgggtgctacgcctgctccagcggcatctcctgcaaggtgcgcatccacgtcgacgagccggacgagctgacggtgcacgtcaagagcgaggaccccgacatcgtggccgcgtccagctccctcatggcccggaagctggagttcgggaccgacagcaccttcaaggccttcagcgccatgcccaagacctccctgtgcttctacatcgtggagcgcgagcactgcaagagctgctccaaggaggacacgcagcggtgcgtgaacaccaagctcgagcagccgcagagcatcctgatcgagcacaagggcaccatcatcgggaagcagaacgacacgtgcaccgccaaggcgtcctgctggctggagagcatcaagtccttcttctacggcctcaagaacatgctgagcggcatcttcgggaacgtcttcatcggcgtgttcctgttcctggcccccttcatcatcctcatcctgttcttcatgttcgggtggcgcatcctgttctgcttcaagtgctgccggcgcacccggggcctcctgaagtaccgccacctgaaggacgacgaggagatcgggtaccggaagatcatcgagcgcctcaacaacaagaagggcaagaacaagctgctggacggcgagcggctcgccgaccgcaagatcgccgagctgttctccaccaagacccacatcgggtga

SEQ ID NO: 11918 - RNA, 5070 nt, synthetic construct
  misc_feature 1..5070: note = derived and/or modified CDS sequence (opt1) from CCHFV(SPU 383/87)__KJ682806.1__GP
  source 1..5070: mol_type = other RNA
atgcccttcaacatcatgtacacgcccctgctctgcgccatcctgtgcctgcagctctggagcctggaggggatctacgggctgtccaaccgcacccagcacaacgacacctccaccatcaaggtgcccgaggagtcccagaagaccagcctccccgccaacaccgcgtcccccatcaccagcgacccgccctccaccaccagcaccgcctccgccagcggccccgaggggtccggcgacaccagcaccagcccgcccgtcaccacccaggggcccaccccgcccgagaccacccccgagccccacaccaccatcgacatcgacaagagctccaccgccatcgccgacatcagcacccagaccgtgaaggacatccccacgcccaccacccacacctccctgccgagcacgctgtccgcgcccaccatcccccaggaggcccaccacaccgcccggggcctcctgagcatcaccagcacgaagcccggcgaggcctccaccccgatcagccccggggaggcgtccaccgaggccagcagcccccagcccaccatcagcgagacgccgagcccgccgcccaccgcccaggccccgaccgagatcaacagccccaacacctcccgccagcccatgccgagcacgcagcccgccgcgcccaactccgtgacccaccccgcccagccgacccccagccagtccgacgtccccaccgccgcccaggacatccaccccaacccgatcaaccggagcaagcgcaacctggagatggagatcatcctcaccctgtcccagggcctgaagaagtactacgggaaggtgctcaagctgctggacctcacgctggaggaggacaccgagggcctgctcgagagctgcaagcggaacctggggctgacctgcgacgacaacttcttccagaagcgcatcgaggagttcttcctcaccggcgagggccacttcaacgaggtgctgcagttcaagacgccctccaccctgagccccaccgagcccgcccgggtcgagtccccgaccgtggagcccttcaagagctacttcgcgaaggggttcctcagcatggactccggctacttcagcgccaagtgctactccaagagctccaacagcgggctgcagctgatcaacgtgacgcagcacctcatccgcatcaccgacacccccggccccaagatcaccaacctgaagacgatcaactgcatcaacctgaaggccctcgtcttcaaggagcaccgggagatcgagatcaacgtgctgctgccccaggtggccgtcaacctctccaactgccacgtgctgatcaagagccacgtgtgcgactactccctggacatcgacggccccgtccgcctcccccggatccaccacgaggggaccttcatccccggcacctacaagatcgtgatcgacaagaacaacaagcagaacgaccgctgcaccctggtgacgaactgcgtcatcaaggggcgggagatccgcaagggccagagcgtgctgcggcagtaccgcaccgagatcaagatcgggaaggcctccagcggctcccggcgcctcctgagcgaggagtccaacgacgactgcctgagccggacccagctcctgcgcaccgagaacgcggagatccactccgacaactacggcgggccgggcgacaagatcacgatctgcaacgggagcaccatcgtggaccagcggctgggcagcgagctcgggtgctacaccatcaaccgcgtcaagtccttcaagctgtgcgagaacagcgccaccggcaagtcctgcgagatcgacagcacgcccgtgcgctgccggcagggcttctgcctgaagatcacccaggaggggcgcggccacgtgaagctgtcccgggggagcgaggtcgtgctcgacgcctgcgactccagctgcgagatcatgatccccaagggcaccggggacatcctggtcgactgctccggcggccagcagcacttcctgaaggacaacctcgtggacctggggtgccccaacatcccgctgctcggcaagatggccatctacatctgccgcatgagcaaccaccccaagaccacgatggccttcctgttctggttctccttcgggtacgtgatcacgtgcatcctgtgcaaggtcatcttctacctcctggtggtggtcggcaccctgggcaagaagttcaagcagtaccgggagctcaagccccagacctgcacgatctgcgagaccaacccggtgaacgcgatcgacgccgagatgcacgacctgaactgcagctacaacatctgcccctactgcgcctcccgcctgaccagcgacgggctcgcccggcacgtgatccagtgccccaagcgcaaggagaagatcgaggagaccgagctgtacctgaacctcgagcggatcccctgggtcgtgcgcaagctgctccaggtgtccgagagcacgggcgtcgcgctcaagcggtccagctggctggtgatcctgctcgtgctgctgaccgtctccctcagcccggtgcagagcgcccccatctcccacggggagaccgtggaggtctaccagacccgcgagggctacaccagcatctgcctgttcgtgctggggtccatcctcttcctggtgagctgcctgatgaagggcctcgtcgactccgtgggcaacagcttcttccccgggctgtccatctgcaagacgtgcagcatcggctccatcaacgggttcgagatcgagagccacaagtgctactgctccctgttctgctgcccctactgccggcactgcagcgccgacatcgagatccaccgcctccacctgtccatctgcaagaagcggaagaccggcagcaacgtgatgctggccgtctgcaagcgcatgtgcttccgggccaccgtggaggtgtccaacaaggcgctcctgatccgcaacatcatcaacaccacgttcgtcgtgtgcatcctgatcctcgccgtgtgcgtcgtgagcacctccgccgtggagatggagaacctgccggccgggacctgggagaaggaggaggacctgaccaacttctgccaccaggagtgccaggtcacggagaccgagtgcctctgcccctacgaggccctggtgctgcggaagcccctcttcctggacagcatcgtgaagggcatgaagaacctgctcaactccaccagcctggagaccagcctgtccatcgaggcgccctggggcgccatcaacgtccagagcacgttcaagccgaccgtgtccgccgccaacatcgccctcagctggtccagcgtggagcaccgcgggaacaagatcctggtctccggccgcagcgagtccatcatgaagctggaggagcggaccgggatcagctgggacctcggcgtggaggacgcgtccgagagcaagctgctgaccgtgtccgtcatggacctcagccagatgtactcccccgtgttcgagtacctgagcggggaccgccaggtggaggagtggcccaaggccacgtgcaccggcgactgccccgagcggtgcggctgcacctcctccacgtgcctgcacaaggagtggccgcactcccgcaactggcggtgcaaccccacctggtgctggggcgtcggcaccgggtgcacgtgctgcggcctcgacgtgaaggacctgttcaccgactacatgttcgtgaagtggaaggtcgactacatcaagacggaggccatcgtgtgcgtggagctgaccagccaggagcgccagtgcagcctcatcgaggccgggacccggttcaacctgggccccgtcaccatcacgctgtccgagccccgcaacatccagcagaagctcccgcccgagatcgtgaccctgcacccccggatcgaggagggcttcttcgacctgatgcacatccagaaggtcctcagcgcgtccaccgtgtgcaagctgcagagctgcacccacggggtgcccggcgacctgcagatctaccacatcgggaacctcctgaagggcgacaaggtcaacggccacctgatccacaagatcgagccgcacttcaacacgtcctggatgagctgggacgggtgcgacctcgactactactgcaacatgggcgactggccctcctgcagctacaccggggtgacccagcacaaccacgccgccttcgtgaacatgctgaacatcgagaccgactacacgaagaacttccacttccactccaagcgcgtcaccgcccacggcgacacgccccagctggacctcaaggcccggcccacctacggggcgggcgagatcaccgtgctggtggaggtcgccgacatggagctgcacacgaagaagatcgagatcagcggcctcaagttcgcctccctgacctgcaccgggtgctacgcctgcagctccggcatcagctgcaaggtgcgcatccacgtggacgagccggacgagctgaccgtccacgtgaagtccgaggaccccgacatcgtggccgcgagctccagcctcatggcccggaagctggagttcgggacggactccaccttcaaggccttcagcgccatgcccaagaccagcctgtgcttctacatcgtcgagcgcgagtactgcaagtcctgcagcaaggaggacacccagaagtgcgtgaacacgaagctcgagcagccgcagtccatcctgatcgagcacaagggcaccatcttcgggaagcagaacgacacgtgcaccgccaaggcgagctgctggctggagtccgtgaagtccttcttctacggcctcaagaacatgctgtccggcatcttcgggaacgtcttcatcggcgtgttcctgttcctggcccccttcatcatgctcatcctgttcttcatgttcgggtggcggatcctgttctgcttcaagtgctgccgccggacgcgcggcctcttcaagtaccggcacctgaaggacgacgaggagatcgggtaccgcaagatcatcgagcggctgaacaacaagaagggcaagaacaagctcctggacggcgagcgcctggccgaccgcaagatcgccgagctgttcagcaccaagacccacatcgggtga

SEQ ID NO: 11919 - RNA, 5070 nt, synthetic construct
  misc_feature 1..5070: note = derived and/or modified CDS sequence (opt1) from CCHFV(SPU 44/08)__KJ682805.1__GP
  source 1..5070: mol_type = other RNA
atgcccttcaacatcatgtacaccccgctcctctgcgccatcctgtgcctgcagctctggagcctggagggcatctacgggctgtccaacaacacccagcacaacgacacgagcaccatcaaggtgcccgaggagtcccagaagaccagcctccccgccaacaccgcgtcccccatcacgagcgacccgccgcccaccacccccaccgcctccgccagcggcccggaggggtccggcgacacgagcacctccccgcccgtcaccacccaggggcccacgccgcccgagaccacccccgagccccacaccacgatcgacatcgacaagagctccaccgccatcgccgacatcagcacccagaccgtgaagaacatccccacgcccaccgcgcacacctccctgcccagcaccctgtccgcccccacgatgccgcaggaggcccaccacaccgcccgcggcctcctgagcgtgacctccaccaagcccggcgaggcgagcacgcccaccagccccggggaggcctccaccgaggccagctccccgcagcccaccatccgggagacgcccagcccgccgcccaccacccagacccccacggagatcaacaaccccaacacctcccgccagcccatgcccagcacccagcccgccgccccgtccagcgtcacccaccccgcgcagcccaccccctcccagagcgacgtgccgacggccgcccaggacatccacccctcccccaccaaccggagcaagcgcaacctggagatggagatcatcctcaccctgtcccagggcctgaagaagtactacgggaaggtgctcaagctgctggacctcaccctggaggaggacacggagggcctgctcgagtggtgcaagcggaacctggggctgacctgcgacgacaacttcttccagaagcgcatcgaggagttcttcctcaccggcgagggccacttcaacgaggtcctgcagttcaagacccccagcacgctgtccccgaccgagcccgcccgggtggagagccccaccgtggagcccttcaagtcctacttcgccaaggggttcctcctgatggacagcggctacttctccgcgaagtgctaccccaagagcagcaactccgggctgcagctcatcaacgtcacccagcacctgatccgcatcacggacacccccggccccaagatcaccaacctgaagaccatcaactgcatcaacctcaaggccctggtgttcaaggagcaccgggagatcgagatcaacgtgctgctcccccaggtcgccgtgaacctgagcaactgccacgtgctgatcaagtcccacgtctgcgactacagcatcgacatcgacggcccggtgcgcctcccccggatccaccacgaggggacgttcatccccggcacctacaagatcgtgatcgacaagaagaacaagcagaacgaccgctgcaccctggtcaccaactgcgtgatcaaggggcgggagatccgcaagggccagtccgtgctgcggcagtaccgcacggagatcaagatcgggaaggccagctccggcagccggcgcctcctgtccgaggagagcaacgacgactgcctgtcccggacccagctcctgcgcaccgagaacgccgagatccacagcgacaactacggcgggcccggcgacaagatcaccatctgcaacgggtccacgatcgtcgaccagcggctgggcagcgagctcgggtgctacaccatcaaccgcgtgaagtccttcaagctgtgcgagaacagcgcgaccggcaagtcctgcgagatcgacagcaccccggtgcgctgccggcagggcttctgcctgaagatcacgcaggaggggcgcggccacgtcaagctgagccgggggtccgaggtggtcctcgacgcctgcgacagctcctgcgagatcatgatccccaagggcaccggggacatcctggtggactgcagcggcggccagcagcacttcctgaaggacaacctcgtggacctggggtgccccaacatcccgctgctcggcaagatggccatctacatctgccgcatgtccaaccaccccaagaccaccatggccttcctgttctggttcagcttcgggtacgtcatcacgtgcatcctgtgcaaggccatcttctacctcctgatcgtggtgggcaccctgggcaagaagttcaagcagtaccgggagctcaagccccagacctgcaccatctgcgagacgaaccccgtcaacgcgatcgacgccgagatgcacgacctgaactgctcctacaacatctgcccgtactgcgccagccgcctgacctccgacgggctcgcccggcacgtgatgcagtgccccaagcgcaaggagaagatcgaggagaccgagctgtacctgaacctcgagcggatcccctgggtggtccgcaagctgctccaggtgagcgagtccaccggcgtggcgctcaagcggagctcctggctggtcatcctgctcgtgctgctgaccgtgagcctctcccccgtccagagcgccccgatctcccacggggagacggtggaggtgtaccagacccgcgagggctacaccagcatctgcctgttcgtcctggggtccatcctcttcctggtgagctgcctgatgcggggcctcgtggacagcgtctccaacagcttcttccccggcctgtccatctgcaagacctgcagcatcgggtccatcaacggcttcgagatcgagagccacaagtgctactgctccctgttctgctgcccctactgccgccactgcagcgccgacatcgagatccacaagctccacctgtccatctgcaagaagcggaagacggggagcaacgtgatgctggccgtgtgcaagcgcatgtgcttccgggccaccgtcgaggtgtccaacaaggcgctcctgatccgcaacatcatcaacaccaccttcgtggtctgcatcctgatcctcgccgtgtgcgtggtcagcacgtccgccgtggagatggagaacctgcccgccggcacctgggagaaggaggaggacctgaccaacttctgccaccaggagtgccaggtgaccgagacggagtgcctctgcccgtacgaggccctggtcctgcggaagcccctcttcctggacagcatcgtgaaggggatgaagaacctgctcaactccaccagcctggagacctccctgagcatcgaggcgccctggggcgccatcaacgtgcagtccaccttcaagcccacggtcagcgccgccaacatcgccctcagctggtccagcgtggagcaccgcggcaacaagatcctggtgtccgggcgcagcgagtccatcatgaagctggaggagcggaccggcatcagctgggacctcggggtcgaggacgcgtccgagagcaagctgctgaccgtgtccgtgatggacctcagccagatgtactccccggtcttcgagtacctgagcggcgaccgccaggtggaggagtggcccaaggcgacctgcacgggggactgccccgagcggtgcggctgcacctccagcacgtgcctgcacaaggagtggccccactcccgcaactggcggtgcaacccgacctggtgctggggcgtggggaccggctgcacgtgctgcgggctcgacgtcaaggacctgttcaccgactacatgttcgtgaagtggaaggtggactacatcaagaccgaggccatcgtctgcgtggagctgaccagccaggagcgccagtgctccctcatcgaggccggcacccggttcaacctggggcccgtgaccatcaccctgagcgagccccgcaacatccagcagaagctgcccccggagatcgtcacgctgcacccccggatcgaggagggcttcttcgacctgatgcacatccagaaggtgctctccgccagcaccgtctgcaagctgcagagctgcacccacggcgtgcccggggacctgcagatctaccacatcggcaacctcctgaagggggacaaggtgaacggccacctgatccacaagatcgagccccacttcaacacctcctggatgagctgggacggctgcgacctcgactactactgcaacatgggggactggccgtcctgcagctacacgggcgtcacccagcacaaccacgccgccttcgtgaacatgctgaacatcgagaccgactacaccaagaacttccacttccactccaagcgcgtgaccgcccacggggacacgccccagctggacctcaaggcccggcccacctacggcgcgggggagatcaccgtcctggtggaggtggccgacatggagctgcacaccaagaagatcgagatcagcggcctcaagttcgcctccctgacgtgcaccggctgctacgcctgcagctccgggatcagctgcaaggtccgcatccacgtggacgagccggacgagctgaccgtgcacgtcaagtccgaggaccccgacatcgtggccgcgagctccagcctcatggcccggaagctggagttcggcaccgactccacgttcaaggccttcagcgccatgcccaagacctccctgtgcttctacatcgtggagcgcgagtactgcaagagctgctccaaggaggacacccagaagtgcgtcaacaccaagctcgagcagccccagagcatcctgatcgagcacaaggggacgatcatcggcaagcagaacgacacgtgcaccgccaaggcgagctgctggctggagtccatcaagagcttcttctacgggctcaagaacatgctgtccggcatcttcggcaacgtgttcatcgggatcttcctgttcctggccccgttcatcatgctcatcctgttcttcatgttcggctggcggatcctgttctgcttcaagtgctgccgccggacccgcggcctcttcaagtaccggcacctgaaggacgacgaggagatcgggtaccgcaagatcatcgagcggctgaacaacaagaaggggaagaacaagctcctggacggcgagcgcctggccgaccgcaagatcgccgagctgttcagcaccaagacccacatcggctga

SEQ ID NO: 11920 - RNA, 5070 nt, synthetic construct
  misc_feature 1..5070: note = derived and/or modified CDS sequence (opt1) from CCHFV(Matin)__AF467769.2__GP
  source 1..5070: mol_type = other RNA
atgagcttcaacatcatgtacaccctgctgctgtgcgccatcctgtgctcccagctctggagctccgaggggatccacgggctgagcaacgagacccagcacggcaacgcctccaccatcaaggcccccgaggtgagccaggggctgggcctccccgtctccaccgcgccgcccatcaccagcgacccgccctccatcaccagcgccgcctccgtgagcgggcccgagggctccggcgacaccaacacctccccgcccgtgaccacccaggggctgaccctgcccgagaccaccctcgagctgctgaccaccaccaacaccggcgcctccagcaccgtcatcgtggacgtgtccacccagaccgtcaaggacacccccgtgagcaccgcccacaccagcccgcccgggacccccagcgcccccaccacgccccagggcacgcaccacaccgcccgcgggctcctgagcgtgacctccaccaagagcgaggaggcctccacgcagaccaaccccaagaagaccagcatggagaccaactccccgggccccgcgacgagcgagaccccctcccccagccccaccacccaggcccccacggagaacaacaaccccaacacgccccggcagccgacgccgcccacccagcccgccaccccgtcccccgtcacgagccccgccctgctcgcctccagccagggcgacacctccaccgcggtgcaggacgtgcacccgagccccaccaaccgctccaagcggaacctggagatggagatcatcctgacgctcagccaggggctgaagaagtactacggcaagatcctgaagctcctggacctgaccctcgaggaggacaccgaggggctgctggagtggtgcaagcgcaacctcggcctggtctgcgacgactccttcttccagaagcggatcgaggagttcttcctgaccggcgaggggcacttcaacgaggtgctccagttcaagacgcccagcaccctgtcccccaccgagccggcccgcgccggcagccccaccgtggagcccttcaagagctacttcgcccgggggctgctctccatggacagcggctacttctccgccaagtgctacccccgcgcgagcaactccgggctgcagctgatcaacatcacgcagcacagcgcccggatcaccgacaccccgggccccaagatcaccaacctcaagacgatcaactgcatcaacctgaaggcctccaccttcaaggagcaccgcgagatcgagatcaacgtcctgctcccccaggtggccgtgaacctgagctcctgccacgtcctgatcaagagccacgtgtgcgactactccctcgacatcgacggccccgtgcggctgccgcgcatccaccacgaggggaccttcatccccggcacctacaagatcgtcatcgacaagaagaacaagcagaacgaccggtgcacgatcgtgaccaactgcgtgatcaaggggcgcgagatccggaagggccagagcgtcctgcgccagtacaagaccgagatcaagatcgggaaggcctccagcggctcccggcgcctcctgagcgaggagtccggcgacgactgcatcagccggacccagctgctccgcacggagaccgcggagatccacagcgactcctacgggggccccggggacaagatcaccatctgcaacggcagcaccgtggtcgaccagcggctggggtccgagctgggctgctacacgatcaaccgcgtgaagtccttcaagctgtgcgagaactccgccaccggcaagagctgcgagatcgactccacccccgtgaagtgccgccaggggttctgcctcaagatcacccaggagggccgggggcacgtcaagctgagccgcggctccgaggtggtgctggacgcctgcgacagctcctgcgagatcatgatccccaagggcacgggggacatcctcgtcgactgcagcggcgggcagcagcacttcctgaaggacaacctgatcgacctcggctgccccaacatccccctgctggggaagatggccatctacatctgccggatgtccaaccaccccaagaccaccatggtgttcctcttctggttcagcttcggctacgtgatcacgtgcatcctgtgcaaggtcatcttctacctgctcatcgtggtgggcacgctggggaagaagttcaagcagtaccgcgagctgaagccgcagacctgcaccatctgcgagaccacccccgtcaacgccatcgacgcggagatgcacgacctcaactgctcctacaacatctgcccctactgcgccagccggctgacgtccgacggcctggcccgccacgtgatgcagtgccccaagcggaaggagaagatcgaggagaccgagctctacctgaacctggagcgcatcccgtgggtggtccggaagctcctccaggtgagcgagtccaccggggtggccctgaagcgcagcagctggctcgtcgtgctgctggtgctcctgaccgtctccctgagccccgtgcagtccgcgcccatcggccacgggaagacggtggagacctaccagatccgggagggctacaccagcgtctgcctcttcgtgctgggctccatcctgttcatcgtgagctgcctcatgaaggggctggtcgactccgacggcaacagcttcttcccggggctgtccatctgcaagacctgcagcatcggctccatcaacgggttcgagatcgagagccacaagtgctactgctccctcttctgctgcccctactgccgccactgcagcacggaccgggagatccacaagctgcacctgtccatctgcaagaagcgcaagaccggcagcaacgtgatgctcgccgtgtgcaagcggatgtgcttccgcgccaccgtcgaggtgtccaacaaggccctgctgatccggagcatcatcaacaccacgttcgtggtctgcatcctcatcctggccgtgtgcgtggtctccaccagcgcggtggagatggagagcctgcccgccggcacctgggagcgcgaggaggacctcatcaacttctgccaccaggagtgccaggtgaccgagacggagtgcctgtgcccctacgaggccctggtcctccggaagccgctgttcctggactccatcatcaaggggatgaagaacctcctgaacagcacctccctggagaccagcctctccatcgaggccccctggggcgccatcaacgtgcagagcaccttcaagcccacgatgtccgcggccaacatcgccctgagctggtccagcgtggagcaccgcgggaacaagatcctggtctccggccgcagcgagtccatcatgaagctcgaggagcggaccgggatcagctgggacctgggcgtggaggacgcctccgagagcaagctgctcaccgtgtccgtcatggacctgagccagatgtactcccccgtgttcgagtacctgagcggcgaccgccaggtggaggagtggccgaaggcgacctgcacgggggactgccccgagcggtgcggctgcaccagcagcacgtgcctccacaaggagtggccccacagccgcaactggcggtgcaaccccacctggtgctggggcgtgggcaccggctgcacgtgctgcgggctggacgtgaaggacctgttcaccgactacatgttcgtgaagtggaaggtcgagtacatcaagaccgaggtgatcgtctgcgtggagctcacgtcccaggagcgccagtgcagcctgatcgaggcgggcacccggttcaacctggggccggtgaccatcaccctctccgagccccgcaacatccagcagaagctgccgcccgagatcgtcacgctgcacccgcggatcgaggagggcttcttcgacctcatgcacgtgcagaaggtgctgagcgcctccaccgtctgcaagctgcagagctgcacccacggggtgcccggcgacctccaggtgtaccacatcggcaacctgctgaagggggacaaggtcaacggccacctcatccacaagatcgagccccacttcaacacctcctggatgagctgggacgggtgcgacctggactactactgcaacatgggcgactggccctcctgcagctacaccggggtgacgcagcacaaccacgccgccttcgtgaacatgctgtccatcgagaccgactacaccaagaacttccacttccacagcaagcgcgtcaccgcgcacggcgacacgccgcagctcgacctgaaggcccggcccacctacggcgccggggagatcaccgtgctggtggaggtcgccgacatggagctccacaccaagaagatcgagatctccggcctgaagttcgccagcctgacgtgcaccgggtgctacgcgtgctccagcggcatctcctgcaaggtgcgcatccacgtggacgagcccgacgagctcaccgtccacgtcaagtccgaggaccccgacatcgtggccgccagctccagcctgatggcccggaagctggagttcgggaccgactccacgttcaaggccttcagcgcgatgccgaagacctccctctgcttctacatcgtcgagcgcgagtactgcaagagctgctccaaggaggacacccagaagtgcgtgaacaccaagctggagcagccccagagcatcctgatcgagcacaagggcacgatcatcggcaagcagaacgacacgtgcaccgccaaggcctcctgctggctcgagagcgtgaagtccttcttctacgggctgaagaacatgctgagcggcatcttcgggaacgtcttcatcggcatcttcctgttcctcgcccccttcgccctgctgatcctcttcttcatgttcggctggcggatcctgttctgcttcaagtgctgccgccggacccgcgggctgttcaagtaccggcacctcaaggacgacgaggagacgggctaccgcaagatcatcgagcggctgaacaacaagaaggggaagaacaagctgctcgacggcgagcgcctggcggaccgcaagatcgccgagctgttctccaccaagacccacgtggggtga

SEQ ID NO: 11921 - RNA, 5070 nt, synthetic construct
  misc_feature 1..5070: note = derived and/or modified CDS sequence (opt1) from CCHFV(TADJ/HU8966)__AY179962.1__GP
  source 1..5070: mol_type = other RNA
atgcccgtgagcatcatgcacatgctgctcatgtgcgccgtcctgtgcctgcagctctacggcctcgggggcaccctgcgctccaacaacgggaccgagcacaacaagacgaacgtgctcaccaccccgggcgacaagctgagccccgagccgcccgtgtccaccgccctgcccgtcacgcccgacagctccaccgtgacccccaccacgcccgcgagcgggctcgagggctccggcgaggtgtacaccagcccgcccatcaccaccaaggggctgtcccccagcgaggccacgtccgagcccccggccaccaccggcatggggatcagctccgccagcggcgtcgacttctccacccaggccgcgcgggacacgagcaccctgaccgtgctcacctccccgcccaacagccccaacacgccgcccacctcccaggacacccaccaccccgtgcgcagcctgctgagcgtcaccagcccccggcccgaggagacgaccgccccctccaagtccgggaaggagagccccgccgccaactccagccaccccgtgacctcccgcccgagcagccccctcatcaccgtgcggggccccacggagaactcctcccacaacaccaccggccagctggagagcatgacccagtccacgaccctggtccccatggcgagcccgacccagaccgtgctctcccagagcgtgacgtccatcgccgtccaggacgcccaccccagctccaccaaccgcagcaagcggaacctggagatggagatcatcctgaccctcccccaggggctgaagaagtactacggcaaggtgctgcgcctcctgcagctgaccctcgaggaggacaccgaggggctgctggagtggtgcaagcggaacctcggcctggactgcgacgacacgttcttccagaagcgcatcgaggagttcttcatcaccggcgaggggcacttcaacgaggtgctgcagttccggaccccgggcaccctcagcacgaccgagtccacccacgccgggagccccaccgccgagcccttcaagtcctacttcgcgaagggcttcctgagcatcgactccgggtacttcagcgccaagtgctactcccgcacgagcaactccggcctgcggctcatcaacgtcacccgccacagcacccggatcgccgacacccccggcccgaagatcacgaacctgaagaccatctcctgcatcaacctgcgcgccagcatcttcaaggagcaccgggaggtggagatcaacgtgctcctgccccaggtcgccgtgaacctgtccaactgccacgtggcgatcaagagccacgtctgcgactactccctcgacgtggacgggaccgtccgcctgccccacatccaccacggcgggaccttcatccccggcacgtacaagatcgtgatcgacaagaagaacaagctgaacgaccggtgcaccctcttcaccaactgcgtgatcaaggggcgcgaggtccggaagggccagagcatcctgcgccagtacaagaccgagatccgcatcggcaaggcctccacggggagccggcgcctgctcagcgaggagtccggcgacgactgcatcagccggacccagctgctgcgcaccgagaccgccgagatccacggggacgactacggcgggccgggcgacaagatcacgatctgcaacggctccaccatcgtggaccagcggctggggagcgagctcggctgctacaccatcaaccgcgtgaagtccttcaagctgtgcgagaacagcgccaccgggaagaactgcgagatcgactccgtccccgtgaagtgccggcagggctactgcctgaagatcacgcaggagggccgcgggcacgtgaagctcagccggggctccgaggtcgtgctggacgcctgcgacagctcctgcgaggtgatgatccccaaggggaccggcgacatcagcgtcgactgctccgggggccagcagcacttcctgaaggacaacctcatcgacctgggctgccccaagatcccgctgctcgggaagatggcgatctacatctgccgcatgagcaaccaccccaagaccaccatggccttcctgttctggttctccttcggctacgtgatcacgcggatcctgtgcaaggccatcttctacctcctgatcatcgtggggaccctgggcaagcgcttcaagcagtaccgggagctcaagccccagacctgcaccatctgcgagacgacccccgccaacgccatcgacgcggagatgcacgacctgaactgcagctacaacatctgcccgtactgcgcctcccgcctgaccagcgacgggctcgcccggcacgtcacccagtgccccaagcgcaaggagcgggtggaggagaccgagctgtacctgaacctcgagcgcatcccctggatcgtgcggaagctgctgcaggtctccgagagcacgggcgtggccctcaagcgcagctcctggctgatcgtgctgctcgtcctgttcaccgtgagcctgtcccccgtgcagagcgcgccgatcggctacgggaacaccatcgagacctaccaggcccgcgaggagtacacgtccatctgcctcttcgtcctgggcagcatcctgttcatcgtgtcctgcctcatgaaggggctggtggacagcatcggcaacatcttcttccccgggctgaccatctgcaagacctgctccatcggcagcatcaacggcttcgagatcgagtcccacaagtgctactgcagcctcctgtgctgcccctactgccggcactgctccgccgaccgcgagatccaccagctgcacctcagcatctgcaagaagcggaagaccgggtccaacgtcatgctggccgtgtgcaagcgcatgtgcttccgggccacgatggaggtgagcaacaaggcgctgctcatccgctccatcatcaacaccaccttcgtcgtgtgcatcctgatcctggccgtgtgcatcgtcagcacctccgccgtggagatggagagcctccccgccggcacgtgggagcgggaggaggacctgaccaacttctgccaccaggagtgccaggtgaccgagaccgagtgcctgtgcccgtacgaggccctcgtcctgcgccggcccctgttcctcgacagcatcgtgaaggggatgaagaaccccctgaactccacgagcctggagacctccctcagcatcgaggcgccgtggggcgccatcaacgtgcagtccacctacaagcccaccgtcagcacggccaacatcgccctgtcctggagctccatcgagcaccgcgggaacaacatcctggtgagcggccggtccgagagcatcatgaagctcgaggagcgcaccggcatctccggggacctgggcgtggaggacgccagcgagtccaagctgctcaccgtcagcgtgatggacctgtcccagatgtacagccccgtgttcgagtacctgtccggggaccggcaggtcgaggagtggcccaaggcgacctgcacgggcgactgcccggagcgctgcggctgcaccagcagcacgtgcctccacaaggagtggccccactcccggaactggcgctgcaaccccacctggtgctggggcgtggggaccgggtgcacgtgctgcggcctggacgtgaaggacctgttcatcgactacatgttcgtcaagtggaaggtggactacatcaagaccgaggccatcgtgtgcgtcgagctcaccagccaggagcggcagtgctccctggtggaggccgggacccgcttcaacctgggccccgtcaccatcaccctcagcgagccgcggaacatccagcagaagctgccgcccgagatcatcaccctgcacccccgcatcgaggagggcttcttcgacctcatgcacgtgcagaaggtgctgtccgccagcacggtctgcaagctgcagtcctgcacccacggggtgcccggcgacctccaggtgtaccacatcgggaacctgctgaagggcgacaaggagaacgggcacctcatccacaagatcgagccccacttcaacaccagctggatgtcctgggacggctgcgacctggactactactgcaacatgggcgactggcccagctgcacctacaccggggtcacgcagcacaaccacgcgtccttcgtgaacctgctcaacatcgagaccgactacaccaagagcttccacttccactccaagcgggtgaccgcccacggcgacacgccccagctggacctgaaggcccgcccgacctacggggccggcgagatcaccgtcctcgtggaggtggccgacatggagctgcacaccaagaagatcgagatcacggggctgaagttcgcgagcctgacctgcaccggctgctacgcctgctccagcggcatctcctgcaaggtccgcatccacgtggacgagcccgacgagctgaccgtgcacgtcaagagcgacgaccccgacgtggtggccgcctccagcagcctgatggcccggaagctcgagttcgggacggactccaccttcaaggcgttcagcgccatgcccaagacctccctgtgcttctacatcgtcgagcgcgagtaccgcaagagctgctccaaggaggacacccagaagtgcgtgaacacgaagctggagcagccgcagagcatcctcatcgagcacaagggcaccatcatcgggaagcagaacaacacgtgcaccgccaaggcctcctgctggctggagagcgtgaagtccttcttctacggcctgaagaacatgctgagcggcatcttcgggaacgtcttcgtgggcatcttcctcttcctggcccccttcatcctgctcatcctgttcttcatgttcgggtggcggatcctgtcctgcttcaagtgctgccggcgcacccggggcctcctgaagcaccgccacctgaaggacgacgaggagaccgggtaccggcgcatcatcgagcggctcaacaacaagaagggcaagaacaagctgctggacggcgagcgcctcgcggaccggcgcatcgccgagctgttcagcaccaagacccacatcgggtga

SEQ ID NO: 11922 - RNA, 5070 nt, synthetic construct
  misc_feature 1..5070: note = derived and/or modified CDS sequence (opt1) from CCHFV(88166)__AB069675.1__GP
  source 1..5070: mol_type = other RNA
atgagcttctccgtgatgtacacgcccctgctctgcgccgtcctgtgcctgcagctctggagcctggagggctcccacgggctgagcaacaagacccagcactccaacaccagcaccaccaaggccccggaggtgtcccaggagctcggcctgcccgtgagcaccgtctccacgatcaccagcgacccgccctccatcaccagcgcggtgtccgtgagcgggtccgagggcagcggggacaccaacacgtcccccagcgtcaccacccagggccccaccctgcccgagacgaccctcgagcccctgaccaccacggacaccgacgcctccagcaccgtggtggtcgacgtgagcacccagacggtgaaggacaccccgatctccaccacctacacgagcctgccctccacccccagcgagcccaccaccccgcagggcacgcaccacaccgcccgcgggctcctgtccgtcaccagcaccaagcccgaggaggcctccacgcaggccaaccccggcaagatcagcatggagaccaacagcccccggctggcgatcagcgagaccccgtccttcagccccaccacgcaggcccccaccgagaactccaaccccatcaccagcaagcagctcatgctgtccgcccagccggtgacccccaaccccatgaccagccccgtgcagccggccctgtcccagagcgacacgtccaccgcgatccaggacatccaccccagccccaccgggcgcagcaagcggaacctcgagatggagatcatcctgaccctgtcccagggcctcaagaagtactacgggaagatcctgaagctgctcgacctgacgctggaggaggacaccgagggcctcctggagtggtgcaagcgcaacctgggcctcgtctgcgacgacaacttcttccagaagcggatcgaggagttcttcctgaccgggaagggccacttcaacgaggtgctgcagttcaagacccccagcacgctctccccgaccgggcccgcccgcaccggcagccccaccgtggagccgttcaagtcctacttcgccaagggcttcctgagcatggactccgggtacttcagcgccaagtgctacccccgggcctccaacagcggcctgcagctcatcaacgtcacgcagcactccacccgcatcaccgacacccccgggcccaagatcacgaacctgaagaccatcaactgcatcaacctgaaggcgagcgtgttcaaggagcaccgggagatcgagatcaacgtgctcctgccgcaggtcgccgtgaacctgtccagctgccacgtgctcatcaagtcccacgtctgcgactacagcctggacatcgacggccccgtgcgcctgccccggatccaccacgaggggaccttcatccccggcacctacaagatcgtcatcgacaagaagaacaagcagaacgaccgctgcacgctcgtgaccaactgcgtgatcaagggccgggagatccgcaaggggcagtccgtcctgcggcagtaccgcaccgagatcaagatcggcaaggccagcagcgggtcccggcgcctgctcagcgaggagtccggcgacgactgcatcagccggacccagctgctgcgcacggagaccgccgagatccactccgacaactacgggggcccgggcgacaagatcaccatctgcaacgggagcaccgtggtggaccagcggctgggctccgagctcgggtgctacacgatcaaccgcgtcaagagcttcaagctgtgcgagaactccgccaccggcaagagctgcgagatcgactccacccccgtgaagtgccgccaggggttctgcctgaagatcacccaggagggccggggccacgtgaagctcagccgcgggtccgaggtcgtgctggacgcgtgcgacagctcctgcgagatcatgatccccaagggcacgggggacatcctggtggactgcagcggcggccagcagcacttcctcaaggacaacctgatcgacctggggtgccccaacatcccgctcctgggcaagatggccatctacatctgccggatgtccaaccaccccaagaccaccatggggttcctgttctggttcagcttcggctacgtcgtgacctgcatcctctgcaaggtgatcttctacctgctgatcgtcgtggggacgctcggcaagaagttcaagcagtaccgcgagctgaagccccagacctgcaccatctgcgagaccacccccgtgaacgccatcgacgccgagatgcacgacctgaactgctcctacaacatctgcccgtactgcgccagccggctcacgagcgacggcctggcgcgccacgtcatgcagtgccccaagcggaaggagaagatcgaggagaccgagctgtacctcaacctggagcgcatcccctgggtggtgcggaagctgctccaggtctccgagagcaccggggtggccctgaagcgctccagctggctggtggtcctcctggtgctgctcaccgtgtccctgagccccgtccagtccgccccgatcggccacgggaagacggtggagacctaccagacccgggagggctacaccagcatctgcctgttcgtgctcgggtccatcctgttcatcgtcagctgcctgatgaagggcctcgtggactccgtgggcaacagcttcttccccgggctgtccatctgcaagacgtgcagcatcggctccgtcaacgggttcgagatcgagagccacaagtgctactgctccctgttctgctgcccctactgccgccactgcagcgccgaccgggagatccaccgcctccacctgtccatctgcaagaagcggaagacctggagcaacgtgatgctggccgtgtgcaagcgcatgtgcttccgggcgaccgtcgaggtgagcaacaaggccctcctgatccgcaacatcatcaacaccacgttcgtgctgtgcatcctcatcctggccgtctgcgtggtgtccaccagcgccgtcgagatggagtccctgcccgcgggcacctgggagcgggaggaggacctcaccaacttctgccaccaggagtgccaggtgacggagaccgagtgcctgtgcccgtacgaggccctggtgctccgcaagcccctgttcagcgactccatcgtcaaggggatgaagaacctgctcaacagcacctccctggagaccagcctgtccatcgaggccccctggggcgccatcaacgtgcagagcacgttcaagccgaccatgtccgccgcgaacatcgccctcagctggtccagcgtggagcaccgcggcaacaagatcctggtctccgggcggagcgagtccatcatgaagctggaggagcgcaccggcatcagctggaacctcggggtggaggacgcctccgagagcaagctgctgaccgtgagcgtcatggacctctcccagatgtacagccccgtgttcgagtacctgtccggcgaccggcaggtcgaggagtggcccaaggccacgtgcaccggggactgccccgagcgctgcggctgcaccagctccacgtgcctgcacaaggagtggccgcacagccggaactggcgctgcaaccccacctggtgctggggcgtggggaccggctgcacgtgctgcgggctcgacgtgaaggacctgttcaccgactacatgttcatcaagtggaaggtcgagtacatcaagaccgaggccatcgtgtgcgtggagctgacctcccaggagcggcagtgcaccctcatcgaggcgggcacccgcttcaacctgggccccgtcacgatcaccctgagcgagccccggaacatccagcagaagctcccgcccgagatcgtgaccctgcacccccgcatcgaggaggggttcttcgacctgatgcacgtgcagaaggtcctctccgccagcaccgtgtgcaagctgcagtcctgcacccacggcgtgcccggggacctgcaggtctaccacatcggcaacctcctgaagggggacaaggtgaacggccacctgatccacaagatcgagccgcacttcaacacgagctggatgtcctgggacggctgcgacctcgactactactgcaacatgggggactggcccagctgcacctacaccggcgtgacccagcacaaccacgccgccttcgtcaacatgctgaacatcgagacggactacaccaagaacttccacttccactccaagcgggtgaccgcccacggggacacgccccagctggacctcaaggcgcgccccacctacggcgccggggagatcaccgtgctggtcgaggtggccgacatggagctgcacaccaagaagatcgagatcagcggcctcaagttcgcctccctgacctgcacgggctgctacgcgtgcagctccgggatcagctgcaaggtgcggatccacgtcgacgagccggacgagctgaccgtgcacgtgaagtccgaggaccccgacctcgtcgccgcctccagctccctgatggcccgcaagctggagttcggcaccgacagcaccttcaaggccttctccgcgatgcccaagacgagcctctgcttctacatcgtggagcgggagtactgcaagtcctgcagcaaggaggacacccagaagtgcgtgaacaccaagctggagcagccccagtccatcctgatcgagcacaaggggaccatcatcggcaagcagaacaacacgtgcaccgccaaggccagctgctggctggagtccgtcaagagcttcttctacgggctcaagaacatgctgtccggcatcttcggcaacgtgttcatcggggtgttcctgttcttcgccccgttcatcctcctgatcctgttcttcatgttcggctggcgcatcctcttctgcttcaagtgctgccggcgcacccgggggctgttcaagtaccgccacctgaaggacgacgaggagaccggctaccggaagatcatcgagcgcctcaacaacaagaagggcaagaacaagctgctggacggggagcgcctcgccgaccggaagatcgcggagctgttcagcacgaagacccacatcggctga

SEQ ID NO: 11923 - RNA, 5070 nt, synthetic construct
  misc_feature 1..5070: note = derived and/or modified CDS sequence (opt1) from CCHFV(8402)__AB069674.1__GP
  source 1..5070: mol_type = other RNA
atgagcttctccgtgatgtacacgcccctgctctgcgccgtcctgtgcctgcagctctggagcctggagggctcccacgggctgagcaacaagacccagcactccaacaccagcaccaccaaggccccggaggtgtcccaggagctcggcctgcccgtgagcaccgtctccacgatcaccagcgacccgccctccatcaccagcgcggtgtccgtgagcgggtccgagggcagcggggacaccaacacgtccccgagcgtcaccacccagggccccaccctgcccgagacgaccctcgagcccctgaccaccacggacaccgacgcctccagcaccgtggtggtcgacgtgagcacccagacggtgaaggacaccccgatctccaccacctacacgagcctgccctccacccccagcgagcccaccaccccgcagggcacgcaccacaccgcccgcgggctcctgtccgtcaccagcaccaagcccgaggaggcctccacgcaggccaaccccggcaagatcagcatggagaccaacgggccccggctggcgatctccgagaccccgagcttctcccccaccacgcaggcccccaccgagaacagcaaccccatcacctccaagcagctcatgctgagcgcccagccggtgacccccaaccccatgacctcccccgtgcagccggccctgagccagtccgacacgagcaccgcgatccaggacgtccacccctcccccaccggccgcagcaagcggaacctcgagatggagatcatcctgaccctgagccaggggctcaagaagtactacggcaagatcctgaagctgctcgacctgacgctggaggaggacaccgagggcctcctggagtggtgcaagcgcaacctggggctcgtgtgcgacgacaacttcttccagaagcggatcgaggagttcttcctgaccggcaaggggcacttcaacgaggtgctgcagttcaagaccccctccacgctcagcccgaccggccccgcccgcaccggctcccccaccgtcgagccgttcaagagctacttcgccaaggggttcctgtccatggacagcggctacttctccgccaagtgctacccccgggccagcaactccgggctgcagctcatcaacgtgacgcagcacagcacccgcatcaccgacacccccggccccaagatcacgaacctgaagaccatcaactgcatcaacctgaaggcgtccgtgttcaaggagcaccgggagatcgagatcaacgtcctcctgccccaggtggccgtgaacctgagctcctgccacgtcctcatcaagagccacgtgtgcgactactccctggacatcgacgggcccgtccgcctgccccggatccaccacgagggcaccttcatccccggcacctacaagatcgtgatcgacaagaagaacaagcagaacgaccgctgcacgctcgtgaccaactgcgtcatcaaggggcgggagatccgcaagggccagagcgtgctgcggcagtaccgcaccgagatcaagatcgggaaggcctccagcggcagccggcgcctgctctccgaggagagcggggacgactgcatctcccggacccagctgctgcgcacggagaccgccgagatccacaacgacaactacggcggcccgggggacaagatcaccatctgcaacggcagcaccgtggtcgaccagcggctggggtccgagctcggctgctacacgatcaaccgcgtcaagagcttcaagctgtgcgagaactccgccaccggcaagagctgcgagatcgactccacccccgtgaagtgccgccaggggttctgcctgaagatcacccaggagggccgggggcacgtgaagctcagccgcggctccgaggtggtgctggacgcgtgcgacagctcctgcgagatcatgatccccaaggggacgggcgacatcctggtcgactgcagcggcgggcagcagcacttcctcaaggacaacctgatcgacctgggctgccccaacatcccgctcctggggaagatggccatctacatctgccggatgtccaaccaccccaagaccaccatggccttcctgttctggttcagcttcggctacgtggtgacctgcatcctctgcaaggtcatcttctacctgctgatcgtggtggggacgctcggcaagaagttcaagcagtaccgcgagctgaagccccagacctgcaccatctgcgagaccacccccgtcaacgccatcgacgccgagatgcacgacctgaactgctcctacaacatctgcccgtactgcgcgagccggctcacgtccgacggcctggcccgccacgtgatgcagtgccccaagcggaaggagaagatcgaggagaccgagctgtacctcaacctggagcgcatcccctgggtggtccggaagctgctccaggtgagcgagagcaccggggtggccctgaagcgctccagctggctggtcgtgctcctggtgctgctcaccgtctccctgagccccgtgcagtccgccccgatcggccacgggaagacggtggagacctaccagacccgggagggctacaccagcatctgcctgttcgtcctcgggtccatcctgttcatcgtgagctgcctgatgaagggcctcgtggactccgtcggcaacagcttcttccccgggctgtccatctgcaagacgtgcagcatcggctccgtgaacgggttcgagatcgagagccacaagtgctactgctccctgttctgctgcccctactgccgccactgcagcgccgaccgggagatccaccgcctccacctgtccatctgcaagaagcggaagaccggcagcaacgtgatgctggcggtctgcaagcgcatgtgcttccgggccaccgtggaggtgtccaacaaggccctcctgatccgcaacatcatcaacaccacgttcgtcctgtgcatcctcatcctggccgtgtgcgtggtcagcaccagcgcggtggagatggagtccctgcccgccgggacctgggagcgggaggaggacctcaccaacttctgccaccaggagtgccaggtgacggagaccgagtgcctgtgcccgtacgaggccctggtcctccgcaagcccctgttcagcgactccatcgtgaagggcatgaagaacctgctcaacagcacctccctggagaccagcctgtccatcgaggccccctggggcgccatcaacgtgcagagcacgttcaagccgaccgtctccgcggccaacatcgccctcagctggtccagcgtggagcaccgcgggaacaagatcctggtgtccggccggagcgagtccatcatgaagctggaggagcgcaccgggatcagctgggacctcggcgtcgaggacgcctccgagagcaagctgctgaccgtgtccgtcatggacctcagccagatgtacagccccgtgttcgagtacctgtccggggaccgccaggtggaggagtggcccaaggccacgtgcaccggcgactgccccgagcggtgcggctgcaccagctccacgtgcctgcacaaggagtggccgcacagccggaactggcgctgcaaccccacctggtgctggggcgtcgggaccgggtgcacgtgctgcggcctcgacgtgaaggacctgttcaccgactacatgttcatcaagtggaaggtggagtacatcaagaccgaggcgatcgtctgcgtggagctgacctcccaggagcggcagtgcaccctcatcgaggccggcacccgcttcaacctggggcccgtgacgatcaccctgagcgagccccggaacatccagcagaagctcccgcccgagatcgtcaccctgcacccccgcatcgaggagggcttcttcgacctgatgcacgtgcagaaggtgctctccgccagcaccgtctgcaagctgcagtcctgcacccacggggtgcccggcgacctccaggtgtaccacatcgggaacctcctgaagggcgacaaggtcaacggccacctgatccacaagatcgagccgcacttcaacacgagctggatgtcctgggacgggtgcgacctcgactactactgcaacatgggcgactggcccagctgcacctacaccggggtgacccagcacaaccacgccgccttcgtgaacatgctgaacatcgagacggactacaccaagaacttccacttccactccaagcgggtcaccgcgcacggcgacacgccccagctggacctcaaggcccgccccacctacggggccggcgagatcaccgtgctggtggaggtcgccgacatggagctgcacaccaagaagatcgagatcagcggcctcaagttcgcgtccctgacctgcacggggtgctacgcctgcagctccggcatcagctgcaaggtgcggatccacgtggacgagccggacgagctgaccgtccacgtgaagtccgaggaccccgacatcgtggccgccagcagctccctcatggcccgcaagctggagttcgggaccgacagcaccttcaaggcgttctccgccatgcccaagacgagcctgtgcttctacatcgtcgagcgggagtactgcaagtcctgcagcaaggaggacacccagaagtgcgtgaacaccaagctcgagcagccccagtccatcctgatcgagcacaagggcaccatcatcgggaagcagagcaacacgtgcaccgccaaggcctcctgctggctggagagcgtgaagtccttcttctacggcctgaagaacatgctcagcggcatcttcgggaacgtcttcatcggcgtgttcctgttcttcgccccgttcatcctgctcatcctgttcttcatgttcgggtggcgcatcctgttctgcttcaagtgctgccggcgcacccggggcctcttcaagtaccgccacctgaaggacgacgaggagaccggctaccggaagatcatcgagcgcctgaacaacaagaaggggaagaacaagctcctggacggcgagcgcctggcggaccggaagatcgccgagctgttctccacgaagacccacatcgggtga

SEQ ID NO: 11924 - RNA, 5070 nt, synthetic construct
  misc_feature 1..5070: note = derived and/or modified CDS sequence (opt1) from CCHFV(7803)__AB069672.1__GP
  source 1..5070: mol_type = other RNA
atgcccgtgagcatcatgcacatctccctgatgtgcgccgtcctctgcctgcagctgtacggcctcggggagacccacggcagctccaacgagaccgagcacaacaagacgaacgtggtgaccaccccgggggacagccagtcccccgagcccctggtcagcaccacgctgcccgtgaccctcgactccagcaccgtgaccccgacgacccccgcctccgagcccgagggcagcggggaggtctacacctccccgcccatcaccacggagggcctgagcccctccgaggcgaccagcgagctgcccgtgaccaccggcatcgggatctccagcgcctccgacgtggacagctccacgcaggccgccggcgacaccagcacccccaccgtccgcacgagcccgcccaactcccccagcacgcccccgacctcccaggacacccaccaccccatgcggaacctcctgagcgtgacctccctcaagagcgaggagacctccgcccccagcaagtccgggaaggagagccccgcggcctccagcccgcaccccgtggcctcccgcccgcccacccaccccatcaccgcccagggccccacggagaacaacagccacaacaccaccgggcagctcgagtccgtcacccagagcgcgacgctgggccccatggcctcccccacccagaccgtgctgagccagaacgtgacctccatcgccatccaggacacgcacccgagccccaccaaccggagcaagcgcaacctcgagatggagatcatcctgaccctgccccagggcctcaagaagtactacgggaaggtcctgcggctgctccagctgaccctggaggaggacaccgagggcctcctggagtggtgcaagcgcaacctggggctcgactgcgacgacacgttcttccagaagcggatcgaggagttcttcatcaccggcgagggccacttcaacgaggtgctgcagttccgcaccccggggaccctgtccacgaccgagagcacccacgccgagtcccccaccgccgagcccttcaagagctacttcgcgaagggcttcctctccatcgacagcgggtacttctccgccaagtgctacagccggacgtccgacagcggcctgcagctgatcaacgtgacccgccactccacccggatcgccgacacccccgggccgaagatcacgaacctcaagaccatcagctgcatcaacctgaaggcctccgtcttcaaggagcaccgcgaggtggagatcaacgtgctgctcccccaggtcgccgtgaacctgagcaactgccacgtgaccatcaagtcccacgtctgcgactacagcctggacatcgacggcaccgtgcggctcccccacatccaccacgagggcacgttcatccccgggacctacaagatcgtcatcgacaagaagaacaagctgaacgaccgctgcaccctgttcaccaactgcgtgatcaagggccgggaggtgcgcaaggggcagtccgtcctccggcagtacaagacggagatccgcatcggcaaggcgagcaccgggagccggcgcctgctgtccgaggagagcggcgacgactgcatctcccggacccagctcctgcgcaccgagacggccgagatccacggcgacaactacgggggcccgggggacaagatcaccatctgcaacggcagcaccatcgtggaccagcgcctggggtccgagatgggctgctacaccatcaaccgggtgaagtccttcaagctgtgcgagaactccgccacgggcaagagctgcgagatcgactccatccccgtgaagtgccgccaggggtactgcctgaagatcacccaggagggccgggggcacgtgaagctgagccgcggctccgaggtgatcctggacgcctgcgacagctcctgcgaggtcatgatccccaagggcaccggggacatcctcgtggactgcagcggcgggcagcagcacttcctgaaggacaacctgatcgacctcggctgcccctccatcccgctgctggggaagatggccatctacatctgccggatgagcaaccaccccaagaccacgatggcgttcctcttctggttctccttcggctacgtgatcacgtgcatcctgtgcaaggccatcttctacctgctcatcatcgtcggcaccctggggaagcgcttcaagcagtaccgggagctgaagccccagacctgcaccatctgcgagaccacccccgccaacgccatcgacgccgagatgcacgacctcaactgcagctacaacatctgcccgtactgcgcgtcccgcctgaccagcgacggcctggcccggcacgtgacccagtgccccaagcgcaaggagaaggtggaggagacggagctctacctgaacctggagcggatcccctgggtcgtgcgcaagctcctccaggtgagcgagtccaccggggtcgccctgaagcggagctcctggctgatcgtgctgctggtcctcttcgccatcagcctgtcccccgtgcagagcgcgccgatctcccacggcaagaccatcgagacctaccaggcccgcgaggagtacacgagcatctgcctgttcgtgctcgggtccatcctgttcatcgtgagctgcctgatgaagggcctcgtcgactccatcggcaacatcttcttccccgggctgagcatctgcaagacctgctccatcggcagcatcaacgggttcgagatcgagtcccacaagtgctactgcagcctgctctgctgcccctactgccggcactgctccgccgaccgcgagatccaccagctgcacctgagcatctgcaagaagcggaagaccggctccaacgtgatgctcgccgcctgcaagcgcatgtgcttccgggcgaccatggaggtgagcaacaaggccctgctgatccgcagcatcatcaacacgaccttcgtcgtgtacatcctcatcctggccgtgtgcgtcgtgtccaccagcgccgtggagatggagtccctgcccgccgggacctgggagcgcgaggaggacctcacgaacttctgccaccaggagtgccaggtcaccgagaccgagtgcctgtgcccgtacgaggcgctggtgctccggcgccccctgttcctggacagcatcgtgcggggcatgaagaaccccctcaactccaccagcctggagacgtccctgagcatcgaggccccgtggggcgccatcaacgtccagtccacctacaagcccaccgtgagcaccgccaacatcgccctctcctggagctccgtggagcaccgcgggaacaagatcctggtcagcggccggtccgagagcatcatgaagctggaggagcgcacggggatctcctgggacctcggcgtggaggacgcgagcgagtccaagctgctgaccgtgagcgtcatggacctcagccagatgtactcccccgtgttcgagtacctgagcggggaccgccaggtggaggagtggcccaaggcgacctgcaccggcgactgcccggagcggtgcggctgcacgaccagcacgtgcctgcacaaggagtggccccacagccggaactggcgctgcaaccccacctggtgctggggcgtcgggaccgggtgcacgtgctgcggcctcgacgtgaaggacctgttcaccgactacatgatcgtgaagtggaaggtcgagtacatcaagacccggggcatcgtgtgcgtggagctgacctcccaggagcgccagtgcagcctcatcgaggccgggacccggttcaacctgggctccgtcaccatcaccctgagcgagccccgcaacatccagcagaagctcccgcccgagatcatcacgctgcacccccggatcgaggaggggttcttcgacctgatgcacgtgcagaaggtcctctccgccagcaccgtgtgcaagctgcagtcctgcacccacggcgtgcccggggacctgcaggtctaccacgtgggcaacctcctgaagggcgacaaggtgaacgggcacctgatccacaagatcgagccgcacctcaacaccagctggatgtcctgggacggctgcgacctggactactactgcaacatgggggactggcccagctgcacctacacgggcgtcacccagcacaaccacgcctccttcgtgaacctgctcaacatcgagaccgactacaccaagagcttccacttccactccaagcgcgtgacggcccacggggacacgccccagctggacctgaaggcccggcccacctacggcgccggcgagatcaccgtcctcgtggaggtggccgacatggagttcaccccgaagaagatcgagatcagcgggctgaagttcgcgtccctgacctgcaccggctgctacgcctgcagcagcgggatctcctgcaaggtccgcatccacgtggacgagcccgacgagctcaccgtgcacgtcaagagcgacgaccccgacgtggtggccgcctccagctccctgatggcccggaagctggagttcggcacggacagcaccttcaaggcgttctccgccatgcccaagaccagcctctgcttctacatcgtcgagcgcgagtactgcaagtcctgcagcaaggaggacacccagaagtgcgtgaacacgaagctggagcagccgcagtccatcctgatcgagcacaaggggaccatcatcggcaagcagaacaacacgtgcaccgccaaggccagctgctggctcgagtccgtcaagagcttcttctacggcctgaagaacatgctgtccgggatcttcggcaacttcttcatggggatcttcctcttcctggcccccttcatcctgctgatcctcttcttcatgttcggctggcggatcctgttctgcttcaagtgctgccgccgcacccggggcctgttcaagtaccgccacctcaaggacgacgaggagaccgggtaccggcgcatcatcgagcggctgaacaacaagaagggcaagaacaagctgctcgacggggagcgcctggcggaccggcgcatcgccgagctgttcagcaccaagacccacatcggctga

SEQ ID NO: 11925 - RNA, 5070 nt, synthetic construct
  misc_feature 1..5070: note = derived and/or modified CDS sequence (opt1) from CCHFV(75024)__AB069671.1__GP
  source 1..5070: mol_type = other RNA
atgcccgtgagcatcatgcacatcagcctgatgtgcgccgtgctctgcctgcagctgtacgggctcggggagacccacgggagctccaacgagaccgagcacaacaagaccaacgtggtgaccacccccggggacagccagtcccccgagcccctggtcagcaccaccctgcccgtgaccctcgactccagcaccgtgaccccgaccacccccgcctccggccccgaggggagcggcgaggtctacaccagcccgcccatcaccaccgagggcctgagcccctccgaggccaccagcgagctgcccgccaccaccgggatcggcatctccagcgcctccgacgtggacagctccacccaggccgccggggacaccagcacccccaccgtgcgcacgagcccgcccaactccagctccacgccgcccaccagccaggacacccaccacccgatgcgcaacctcctgtccgtcacgagcctgaagcccgaggagacctccgcgcccagcaagtccggcaaggagagccccgccgcctccagcccgcaccccgtggcctcccggccgcccaccccgcccaccacggcgcaggggcccatcgagaacaacagccacaacaccaccggccagctcgagtccgtgacccagagcgccacgctgggccccatggcctccccgacccagaccgtcctgagccagaacgtgacctccatcgccatccaggacacgcaccccagccccaccaaccggagcaagcgcaacctcgagatggagatcatcctgaccctgccgcaggggctcaagaagtactacggcaaggtgctgcggctgctccagctgaccctggaggaggacaccgaggggctcctggagtggtgcaagcgcaacctgggcctcgactgcgacgacacgttcttccagaagcggatcgaggagttcttcatcaccggcgaggggcacttcaacgaggtcctgcagttccgcacccccggcaccctgtccacgaccgagagcacccacgccgagtcccccaccgcggagcccttcaagagctacttcgccaaggggttcctctccatcgacagcggctacttctccgccaagtgctacagccggacgtccaacagcgggctgcagctgatcaacgtgacccgccactccacccggatcgccgacaccccgggccccaagatcacgaacctcaagaccatcagctgcatcaacctgaaggcctccgtgttcaaggagcaccgcgaggtcgagatcaacgtgctgctcccccaggtggcggtcaacctgagcaactgccacgtgaccatcaagtcccacgtgtgcgactacagcctggacatcgacggcaccgtccggctcccccacatccaccacgaggggacgttcatcccgggcacctacaagatcgtgatcgacaagaagaacaagctgaacgaccgctgcaccctgttcaccaactgcgtcatcaaggggcgggaggtgcgcaagggccagtccgtgctccggcagtacaagacggagatccgcatcgggaaggccagcaccggcagccggcgcctgctgtccgaggagagcggcgacgactgcatctcccggacccagctcctgcgcaccgagacggccgagatccacggggacaactacggcgggcccggcgacaagatcaccatctgcaacgggagcaccatcgtcgaccagcgcctgggctccgagatgggctgctacaccatcaaccgggtcaagagcttcaagctctgcgagaactccgccacggggaagtcctgcgagatcgactccatccccgtgaagtgccgccagggctactgcctgaagatcacccaggaggggcggggccacgtgaagctgagccgcggctccgaggtggtgctggacgcctgcgacagctcctgcgaggtcatgatccccaaggggaccggcgacatcctcgtggactgcagcgggggccagcagcacttcctgaaggacaacctgatcgacctcgggtgcccctccatccccctgctgggcaagatggcgatctacatctgccggatgagcaaccaccccaagaccacgatggccttcctcttctggttctccttcggctacgtgatcacgtgcatcctgtgcaaggccatcttctacctgctcatcatcgtcgggaccctgggcaagcgcttcaagcagtaccgggagctgaagccccagacctgcacgatctgcgagaccaccccggccaacgccatcgacgcggagatgcacgacctcaactgcagctacaacatctgcccctactgcgcctcccgcctgaccagcgacgggctggcccggcacgtgacccagtgccccaagcgcaaggagaaggtggaggagacggagctctacctgaacctggagcggatcccctgggtcgtgcgcaagctcctccaggtgagcgagtccaccggcgtcgccctgaagcggagctcctggctcatcgtgctgctggtcctgttcgcgatcagcctgtccccggtccagagcgcccccatcgggcacggcaagaccatcgagacctaccaggcccgcgaggagtacacgtccatctgcctgttcgtgctcggcagcatcctgttcatcgtgtcctgcctgatgaaggggctcgtcgacagcatcggcaacatcttcttccccgggctgtccatctgcaagacctgcagcatcggctccatcaacgggttcgagatcgagagccacaagtgctactgctccctgctctgctgcccctactgccggcactgcagcgccgaccgcgagatccaccagctgcacctgtccatctgcaagaagcggaagaccggcagcaacgtgatgctcgccgtgtgcaagcgcatgtgcttccgggcgaccatggaggtctccaacaaggccctgctgatccgcagcatcatcaacacgaccttcgtggtgtgcatcctcatcctggccgtctgcgtggtgagcacctccgccgtcgagatggagagcctgccggccggcacctgggagcgcgaggaggacctcacgaacttctgccaccaggagtgccaggtgaccgagaccgagtgcctgtgcccctacgaggcgctggtgctccggcgccccctgttcctggactccatcgtccgggggatgaagaaccagctcaacagcacctccctggagacgagcctgtccatcgaggccccgtggggcgccatcaacgtgcagagcacctacaagcccaccgtgtccaccgccaacatcgccctcagctggtccagcgtcgagcaccgcgggaacaagatcctggtgtccggccggagcgagtccatcatgaagctggaggagcgcacggggatcagctgggacctcggcgtggaggacgcgtccgagagcaagctgctgaccgtctccgtgatggacctcagccagatgtacagccccgtgttcgagtacctgtccggcgaccggcaggtcgaggagtggcccaaggcgacctgcaccggggactgcccggagcgctgcggctgcacgacctccacgtgcctgcacaaggagtggccccactcccggaactggcgctgcaaccccacctggtgctggggcgtgggcaccggctgcacgtgctgcgggctcgacgtgaaggacctgttcaccgactacatgatcgtcaagtggaaggtggagtacatcaagaccgaggccatcgtgtgcgtcgagctgacgagccaggagcggcagtgctccctcatcgaggccggcacccgcttcaacctggggagcgtgaccatcaccctgtccgagccccggaacatccagcagaagctcccgcccgagatcatcacgctgcacccccgcatcgaggagggcttcttcgacctgatgcacgtccagaaggtgctcagcgcgtccaccgtgtgcaagctgcagagctgcacccacggggtccccggcgacctccaggtgtaccacgtgggcaacctcctgaagggggacaaggtcaacggccacctgatccacaagatcgagccgcacctcaacacctcctggatgagctgggacgggtgcgacctggactactactgcaacatgggcgactggccctcctgcacctacacgggggtgacccagcacaaccacgccagcttcgtgaacctgctcaacatcgagaccgactacaccaagtccttccacttccacagcaagcgggtcacggcccacggcgacacgccccagctggacctgaaggcccgccccacctacggcgccggggagatcaccgtgctcgtggaggtcgcggacatggagttcacgccgaagaagatcgagatctccggcctgaagttcgccagcctgacctgcaccgggtgctacgcctgctccagcggcatcagctgcaaggtgcggatccacgtggacgagcccgacgagctcaccgtccacgtgaagtccgacgaccccgacgtggtcgccgccagctccagcctgatggcgcgcaagctggagttcgggacggactccaccttcaaggccttcagcgccatgcccaagacctccctctgcttctacatcgtggagcgggagtactgcaagagctgctccaaggaggacacccagaagtgcgtgaacacgaagctggagcagccgcagagcatcctgatcgagcacaagggcaccatcatcggcaagcagaacaacacgtgcaccgccaaggcctcctgctggctcgagagcgtcaagtccttcttctacgggctgaagaacatgctgagcggcatcttcgggaacctcttcatgggcatcttcctgttcctggcgcccttcatcctgctcatcctgttcttcatgttcggctggcgcatcctgttctgcttcaagtgctgccggcgcacgcgcggcctcttcaagtaccggcacctgaaggacgacgaggagaccggctaccgccggatcatcgagcgcctgaacaacaagaaggggaagaacaagctcctggacggcgagcggctggccgaccgccggatcgccgagctgttctccaccaagacccacatcgggtga

SEQ ID NO: 11926 - RNA, 5070 nt, synthetic construct
  misc_feature 1..5070: note = derived and/or modified CDS sequence (opt1) from CCHFV(66019)__AB069669.1__GP
  source 1..5070: mol_type = other RNA
atgcccgccaacatcatgtacaccctgctcgtgtgcgccgtcctgtgcccgcagctgtggagcctcgagggcacccacgtgccccacaacgagacgaagcacaacgggaccggcatcaccgcggcccccggggagtcccagggccccatgagcccggcctccaccgccgtgcccctgacgcccgagcccccgaacaccaagcccgccgcgagcgcctccgagctggagagctccggggagggccacaccagcctcctggccaccacgcagggcctgacctcccccgaggccacccccgagctcccgaccacgaccgacaccggggtcagctccaccagcgtggtggacatcggcacgcagatggcgaaggacacccccacctccaccgcccacacgagcctgccctccaaccccagcgccccgtccaccgcccaggggacccaccacaccatccgcggcctgctcagcgtcacgtccaccaagcccgaggaggccagcacccccaccgaccccgggaaggcgggcgccgagacgggcagcccgcggcccgccatctcccgcaagcccaccctgagccccaccgccgaggccccgaccgagatcaacaactccagcacgcccaagcagcccgagccctccatccagccggcgacccccagcctggtgatctcccccgcccagccggccttcccccagagcgccacctccaccgccgcgcaggacatctacagctcccccacgaaccggagcaagcgcaacctcaagatggagatcatcctgaccctgtcccaggggctcaagaagtactacggcaagatccagaagaccctggggctgaccctcgaggaggacaccgagggcctgctggagtggtgcaagcggaacctcggcctgacgtgcgacgacaacttcttccagaagcgcatcgaggagttcttcctgaccggggagggctacttcaacgaggtgctccagttcaagacccccagcaccccggggtccacggagcccacccacaccgaggcccccaccgtcaagcccttcaagagctacttcgcccggggcttcctgacgatcgactccgggtacttcagcgccaagtgctactcccgcaccagcaacagcggcctgcagctcatcaacgtgacccagcacccggcccggatcgcggacacccccggccccaagatcacgaacctgaagaccatcaactgcatcaacctgaaggcctccgtgttcaaggagcaccgcgagatcgagatcaacgtcctcctgccccaggtggccgtgaacctgagcaactgccacgtcctcatcaagtcccacgtgtgcgactacagcctggacatcgacgggaccatccggctgccgcgcatctaccacgagggcaccttcatccccgggacgtacaagatcgtgatcgacaagcgggacaagcagaacgaccgctgcaccctcgtcaccaactgcgtgatcaagggccgggaggtgcgccgggggcagtccgccctgcgccagtaccggaccgagatccgcatcggcaaggcgagcgccggctcccggcgcctgctcagcgaggagtccggggacgactgcatcagccgcacgcagctgctgcggaccgagaccgccgaggtccacggcgacaactacgggggccccggggacaagatcaccatctgcaacggctccacgatcgtggaccagcgcctcggcagcgagctggggtgctacaccatcaaccgggtgaagtccttcaagctgtgcgagaacagcggcaccgggaagtcctgcaagatcgacaacacccccgtcaagtgccgccagggcttctgcctcaagatcacgcaggagggccgggggcacgtgaagctgagccgcggctccgaggtcgtgctggacgcctgcgacagcagctgcgagatcatgatcccgaaggggaccggcgacatcctggtggactgctccgggggccagcagcacttcctcaaggacaacctggtcgacctgggctgccccaacatccccctcctggggaagatggccatctacatctgccggatgagcaaccaccccaagaccaccatggcgttcctgttctggttctccttcggctacgtgatcacgtgcatcttctgcaagatcatcttctacctcctgatcgtggtcgggaccctgggcaagaagttcaagcagtaccgcgagctcaagccgcagacctgcaccatctgcgagacgacccccaccaacgccatcgacgccgagatgcacgacctgaagtgcagctacaacatctgcccctactgcgcctcccggctgaccagcgacgggctcgcccgccacgtgacccagtgccccaagcggaaggagaaggtggaggagacggagctgtacctgaacctcgagcgcatcccgtggatcgtccggaagctgctgcaggtgtccgagagcaccggcgtggcgctcaagcgctccagctggctgatcgtcctgctcgtgctgctgaccgtgtccctcagccccgtccagtccgcccccatcggccacgggaagaccatcgaggcctaccagacgcgggagggctacaccagcgtgtgcctgttcatgctggggggcatcctcttcgtggtctcctgcctgatgaaggggctggtggacagcgtgtccaacagcttcttcccgggcctctccatctgcaagacctgcagcatcggcagcgtcaacgggttcgagatcgagtcccacaagtgctactgcagcctgctgtgctgcctctactgccgccactgctccgccgaccgggagatccaccagctgcacctgagcatctgcaagaagcgccgggccggcgggaacgtgatgctcgcggtgtgcaagcgcatgtgcctgcgcgccaccatggaggtctccaacaaggtgctgttcatccggagcatcatcaacacgaccttcgtgatctgcatcctcgtcctggccgtgtgcatcgtgtccaccagcgccgtcgagatggagtccctgcccgcgggcacctgggagcgcgaggaggacctcacgaacttctgccaccaggagtgccaggtgaccgagaccgagtgcctgtgcccctacgaggccctggtgctccggaagcccctgttcagcgactccatcgtcaaggggatgaagaacctgctcaacagcacctccctggagacgagcctgtccatcgaggccccgtggggcgccatcaacgtgcagagcaccttcaagcccaccgtgtccaccgccaacatcgcgctcagctggtccagcgtcgagcaccgcggcaacaagatcctggtgagcgggcggtccgagagcatcatgaagctggaggagcgcacgggcatctcctgggacctcggggtggaggacgccagcgagtccaagctgctgaccgtcagcgtgatggacctctcccagatgtacagccccgtgttcgagtacctgtccggcgaccggcaggtcgaggagtggcccaaggccacctgcaccggcaactgcccggaccgctgcgggtgcacgagctccacctgcctgcacaaggagtggccccacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaactcccaggagcggcagtgcagcctcatcgaggccggcacccgcttcaacctgggccccgtgacgatcaccctgtccgagccgcggaacatccagcagaagctccccagcgagatcatcaccctgcacccccgcatcgaggaggggttcttcgacctgatgcacgtgcagaaggtcctctccgcgagcaccgtgtgcaagctgcagtcctgcacgcacggcgtccccggggacctgcagatctaccacatcggcaacctcctgaagggggaccgggtgaacggccacctgatccacaagatcgagccgcacttcaacaccagctggatgagctgggacggctgcgacctcgactactactgcaacatgggggactggccctcctgcacctacaccggcgtgacccagcacaaccacgccgccttcgtcaacctgctgaacatcgagacggactacaccaagaacttccacttccacagcaagcgcgtgaccgcccacggggacaccccccagctcgacctgaaggcccggcccacgtacggcgcgggggagatcaccgtgctggtcgaggtggccgacatggagctccacaccaagaagatcgccatctccggcctgaagttcgccagcctgacctgcacgggctgctacgcgtgctccagcgggatctcctgcaaggtgcgcatccacgtcgacgagccggacgagctcaccgtgcacgtgaagagcgaggaccccgacatcgtcgccgcctccagctccctgatggcccggaagctggagttcggcaccgacagcaccttcaaggccttctccgcgatgcccaagacgagcctctgcttctacatcgtggagcgcgagtactgcgagtcctgcagcaaggaggacacccagaagtgcgtgaacaccaagctggagcagccccagtccatcctgatcgagcacaaggggaccatcatcggcaagcagaacgacacgtgcaccgccaaggccagctgctggctcgagtccgtcaagagcttcttctacggcctgaagaacatgctgagcgggatcttcggcaacgtgttcatcgggatcttcctcttcctggccccgttcatcctgctgatcctcttcttcatgttcggctggcggatcctgttctgcttcaagtgctgccgccgcacccgggggctgttcaagtaccgctacctcaaggacgacgaggagtccggctaccggcgcatcatcgagcggctgaacaacaagaagggcaagaacaagctgctcgacggggagcgcctggccgaccggcgcatcgcggagctgttcagcaccaagacgcacatcggctga

SEQ ID NO: 11927 - RNA, 5070 nt, synthetic construct
  misc_feature 1..5070: note = derived and/or modified CDS sequence (opt1) from CCHFV(BA8402)__AF350449.1__GP
  source 1..5070: mol_type = other RNA
atgagcttctccgtgatgtacacgcccctgctctgcgccgtcctgtgcctgcagctctggagcctggagggctcccacgggctgagcaacaagacccagcactccaacaccagcaccaccaaggccccggaggtgtcccaggagctcggcctgcccgtgagcaccgtctccacgatcaccagcgagccgccctccatcaccagcgcggtgtccgtgagcgggtccgagggcagcggggacaccaacacgtccccgagcgtcaccacccagggccccaccctgcccgagacgaccctcgagcccctgaccaccacggacaccgacgcctccagcaccgtggtggtcgacgtgagcacccagacggtgaaggacaccccgatctccaccacctacacgagcctgccctccacccccagcgagcccaccaccccgcagggcacgcaccacaccgcccgcgggctcctgtccgtcaccagcaccaagcccgaggaggccagcccccaggccaaccccggcaagatcagcatggagacgaacgggccgcggctggcgatctccgagacccccagcttctcccccaccacccaggcccccacggagaacagcaacccgatcacctccaagcagctcatgctgagcgcccagcccgtgacccccaaccccatgacctccccggtgcagcccgccctgagccagtccgacaccagcacggcgatccaggacgtccacccctcccccaccggccgcagcaagcggaacctcgagatggagatcatcctgaccctgagccaggggctcaagaagtactacggcaagatcctgaagctgctcgacctgaccctggaggaggacacggagggcctcctggagtggtgcaagcgcaacctggggctcgtgtgcgacgacaacttcttccagaagcggatcgaggagttcttcctgaccggcaaggggcacttcaacgaggtgctgcagttcaagaccccgtccaccctcagccccacgggccccgcccgcaccggctccccgaccgtcgagcccttcaagagctacttcgccaaggggttcctgtccatggacagcggctacttctccgccaagtgctacccccgggccagcaactccgggctgcagctcatcaacgtgacccagcacagcacgcgcatcaccgacacccccggcccgaagatcaccaacctgaagacgatcaactgcatcaacctgaaggcgtccgtgttcaaggagcaccgggagatcgagatcaacgtcctcctgccccaggtggccgtgaacctgagctcctgccacgtcctcatcaagagccacgtgtgcgactactccctggacatcgacgggcccgtccgcctgccccggatccaccacgagggcaccttcatcccgggcacctacaagatcgtgatcgacaagaagaacaagcagaacgaccgctgcaccctcgtgacgaactgcgtcatcaaggggcgggagatccgcaagggccagagcgtgctgcggcagtaccgcaccgagatcaagatcgggaaggcctccagcggcagccggcgcctgctctccgaggagagcggggacgactgcatctcccggacccagctgctgcgcaccgagacggccgagatccacaacgacaactacggcggccccggggacaagatcaccatctgcaacggcagcaccgtggtcgaccagcggctggggtccgagctcggctgctacaccatcaaccgcgtgaacagcttcaacctgtgcgagaacacggccaccgggaagtcctgcgagatcgacagcacccccgtgaagtgccgccagggcttctgcctgaagatcacccaggagggccgggggcacgtcaagctctcccgcggcagcgaggtggtgctggacgcgtgcgagtccagctgcgagatcatgatccccaaggggacgggcgacatcctggtcgactgctccggcgggcagcagcacttcctcaaggacaacctgatcgacctgggctgcccgaacatccccctcctggggaagatggccatctacatctgccggatgagcaaccaccccaagaccaccatggccttcctgttctggttctccttcggctacgtggtgacctgcatcctctgcaaggtcatcttctacctgctgatcgtggtggggacgctcggcaagaagttcaagcagtaccgcgagctgaagccccagacctgcaccatctgcgagaccaccccggtcaacgccatcgacgccgagatgcacgacctgaactgcagctacaacatctgcccctactgcgcgtcccggcccacgagcgacggcctcgcccgccacgtgatgcagtgccccaagcggaaggagaagatcgaggagaccgccctgtacctgaacctcgagcgcatcccgtgggtggtccggaagctgctccaggtgtccgagagcaccggggtggccctcaagcgcagctcctggctggtcgtgctgctcgtgctgctgaccgtcagcctctcccccgtgcagagcgcccccatcggccacgggaagacggtggagacctaccagacccgggagggctacacctccatctgcctgttcgtcctggggagcatcctcttcatcgtgtcctgcctgatgaagggcctggtggacagcgtcggcaactccttcttccccgggctcagcatctgcaagacgtgctccatcggcagcgtgaacgggttcgagatcgagtcccacaagtgctactgcagcctgttctgctgcccgtactgccgccactgctccgcggaccgggagatccaccgcctgcacctcagcatctgcaagaagcggaagaccggctccaacgtgatgctggccgtctgcaagcgcatgtgcttccgggccaccgtggaggtgagcaacaaggccctgctcatccgcaacatcatcaacaccacgttcgtcctgtgcatcctgatcctcgcggtgtgcgtggtctccaccagcgccgtggagatggagagcctgcccgccgggacctgggagcgggaggaggacctgaccaacttctgccaccaggagtgccaggtgacggagaccgagtgcctctgcccctacgaggccctggtcctgcgcaagcccctcttctccgacagcatcgtgaagggcatgaagaacctgctgaactccaccagcctcgagacctccctgagcatcgaggccccctggggcgcgatcaacgtgcagtccacgttcaagcccaccgtcagcgccgccaacatcgccctgtcctggagctccgtggagcaccgcgggaacaagatcctcgtgagcggccggtccgagagcatcatgaagctggaggagcgcaccgggatctcctgggacctgggcgtcgaggacgccagcgagtccaagctcctgaccgtgagcgtcatggacctgtcccagatgtacagccccgtgttcgagtacctcagcggggaccgccaggtggaggagtggccgaaggcgacgtgcaccggcgactgccccgagcggtgcggctgcacctccagcacgtgcctgcacaaggagtggccccactcccggaactggcgctgcaaccccacctggtgctggggcgtcgggaccgggtgcacgtgctgcggcctggacgtgaaggacctcttcaccgactacatgttcatcaagtggaaggtggagtacatcaagaccgaggccatcgtctgcgtggagctgaccagccaggagcggcagtgcaccctgatcgaggccggcacccgcttcaacctcgggccggtgacgatcaccctgtccgagccccggaacatccagcagaagctgccgcccgagatcgtcaccctccacccccgcatcgaggagggcttcttcgacctgatgcacgtgcagaaggtgctgagcgcctccaccgtctgcaagctccagagctgcacccacggggtgcccggcgacctccaggtgtaccacatcgggaacctgctgaagggcgacaaggtcaacggccacctgatccacaagatcgagccccacttcaacacgtcctggatgagctgggacgggtgcgacctgcactactactgcaacatgggcgactggccctcctgcacctacaccggggtgacccagcacaaccacgccgcgttcgtgaacatgctcaacatcgagacggactacaccaagaacttccacttccacagcaagcgggtcaccgcccacggcgacaccccgcagctggacctgaaggcccgccccacgtacggggccggcgagatcaccgtgctcgtggaggtcgcggacatggagctgcacaccaagaagatcgagatctccggcctgaagttcgccagcctgacctgcacggggtgctacgcctgctccagcggcatctcctgcaaggtgcggatccacgtggacgagcccgacgagctgaccgtccacgtgaagtccgaggaccccgacatcgtggccgcctccagcagcctgatggcgcgcaagctcgagttcgggaccgactccaccttcaaggccttcagcgccatgccgaagacgtccctgtgcttctacatcgtcgagcgggagtactgcgagagctgctccaaggaggacacccagaagtgcgtgaacaccaagctggagcagccccagagcatcctcatcgagcacaagggcaccatcatcgggaagcagtccaacacgtgcaccgccaaggccagctgctggctggagtccgtcaagagcttcttctacggcctgaagaacatgctgtccggcatcttcgggaacgtgttcatcggcgtgttcctcttcttcgcgcccttcatcctgctgatcctcttcttcatgttcgggtggcgcatcctgttctgcttcaagtgctgccggcgcacccggggcctgttcaagtaccgccacctcaaggacgacgaggagaccggctaccggaagatcatcgagcgcctgaacaacaagaaggggaagaacaagctgctcgacggcgagcgcctggccgaccggaagatcgccgagctgttcagcacgaagacccacatcgggtga

SEQ ID NO: 11928 - RNA, 5070 nt, synthetic construct
  misc_feature 1..5070: note = derived and/or modified CDS sequence (opt1) from CCHFV(BA66019)__AF350448.1__GP
  source 1..5070: mol_type = other RNA
atgcccgccaacatcatgtacaccctgctcgtgtgcgccgtcctgtgcccgcagctgtggagcctcgagggcacccacgtgccccacaacgagacgaagcacaacgggaccggcatcaccgcggcccccggggagtcccagggccccatgagcccggcctccaccgccgtgcccctgacgcccgagcccccgaacaccaagcccgccgcgagcgcctccgagctggagagctccggggagggccacaccagcctcctggccaccacgcagggcctgacctcccccgaggccacccccgagctcccgaccacgaccgacaccggggtcagctccaccagcgtggtggacatcggcacgcagatggcgaaggacacccccacctccaccgcccacacgagcctgccctccaaccccagcgccccgtccaccgcccaggggacccaccacaccatccgcggcctgctcagcgtcacgtccaccaagcccgaggaggccagcacccccaccgaccccgggaaggcgggcgccgagacgggcagcccgcggcccgccatctcccgcaagcccaccctgagccccaccgccgaggccccgaccgagatcaacaactccagcacgcccaagcagcccgagccctccatccagccggcgacccccagcctggtgatctcccccgcccagccggccttcccccagagcgccacctccaccgccgcgcaggacatctacagctcccccacgaaccggagcaagcgcaacctcaagatggagatcatcctgaccctgtcccaggggctcaagaagtactacggcaagatccagaagaccctggggctgaccctcgaggaggacaccgagggcctgctggagtggtgcaagcggaacctcggcctgacgtgcgacgacaacttcttccagaagcgcatcgaggagttcttcctgaccggggagggctacttcaacgaggtgctccagttcaagacccccagcaccccggggtccacggagcccacccacgccgaggcccccaccgtcaagcccttcaagagctacttcgcccggggcttcctgaccatcaactccgggtacttcagcgccaagtgctactcctggacgagcaacagcggcctgcagctcatcaacgtgacccagcacccggcgcgcatcgccgacacccccggccccaagatcaccaacctgaagacgatcaactgcatcaacctgaaggcctccgtgttcaaggagcaccgggagatcgagatcaacgtcctcctgccccaggtggccgtgaacctgagcaactgccacgtcctcatcaagtcccacgtgtgcgactacagcctggacatcgacgggaccatccgcctgccgcggatctaccacgagggcaccttcatccccgggacctacaagatcgtgatcgacaagcgcgacaagcagaacgaccggtgcacgctcgtcaccaactgcgtgatcaagggccgcgaggtgcggaaggggcagtccgcgctgcgccagtaccggaccgagatccgcatcggcaaggccagcgccggctcccggcgcctgctcagcgaggagtccggggacgactgcatcagccggacccagctgctgcgcacggagaccgccgaggtccacggcgacaactacgggggccccggggacaagatcaccatctgcaacggctccaccatcgtggaccagcgcctcggcagcgagctggggtgctacacgatcaaccgggtgaagtccttcaagctgtgcgagaacagcggcaccgggaagtcctgcaagatcgacaagcaccccgtcaagtgccgccagggcttctgcctcaagatcacccaggagggccgggggcacgtgaagctgagccgcggctccgaggtcgtgctggacgcctgcgacagcagctgcgagatcatgatcccgaaggggaccggcgacatcctggtggactgctccgggggccagcagcacttcctcaaggacaacctggtcgacctgggctgccccaacatccccctcctggggaagatggcgatctacatctgccggatgagcaaccaccccaagacgaccatggccttcctgttctggttctccttcggctacgtgatcacgtgcatcttctgcaagatcatcttctacctcctgatcgtggtcgggaccctgggcaagaagttcaagcagtaccgcgagctcaagccgcagacctgcaccatctgcgagaccacccccacgaacgccatcgacgccgagatgcacgacctgaagtgcagctacaacatctgcccctactgcgcctcccggctgaccagcgacgggctcgcgcgccacgtgacccagtgccccaagcggaaggagaaggtggaggagaccgagctgtacctgaacctcgagcgcatcccgtggatcgtccggaagctgctccaggtgtccgagagcaccggcgtggccctgaagcgctccagctggctgatcgtcctgctcgtgctgctgacggtgtccctcagccccgtccagtccgcccccatcggccacgggaagaccatcgaggcctaccagacccgggagggctacaccagcgtgtgcctgttcatgctcgggggcatcctgttcgtggtctcctgcctgatgaaggggctggtggacagcgtgtccaacagcttcttcccgggcctctccatctgcaagacgtgcagcatcggcagcgtcaacgggttcgagatcgagtcccacaagtgctactgcagcctgctgtgctgcctctactgccgccactgctccgccgaccgggagatccaccagctgcacctgagcatctgcaagaagcgccgggcgggcgggaacgtgatgctcgccgtgtgcaagcgcatgtgcctgcgggccaccatggaggtctccaacaaggtgctgttcatccgcagcatcatcaacaccaccttcgtgatctgcatcctcgtcctggccgtgtgcatcgtgtccacgagcgcggtcgagatggagtccctgcccgccggcacctgggagcgcgaggaggacctcaccaacttctgccaccaggagtgccaggtgaccgagacggagtgcctgtgcccctacgaggccctggtgctccggaagcccctgttcagcgactccatcgtcaaggggatgaagaacctgctcaacagcacctccctggagaccagcctgtccatcgaggccccgtggggcgccatcaacgtgcagagcaccttcaagcccacggtgtccaccgcgaacatcgccctcagctggtccagcgtcgagcaccgcggcaacaagatcctggtgagcgggcggtccgagagcatcatgaagctggaggagcgcaccggcatctcctgggacctcggggtggaggacgccagcgagtccaagctgctgaccgtcagcgtgatggacctctcccagatgtacagccccgtgttcgagtacctgtccggcgaccggcaggtcgaggagtggcccaaggccacgtgcaccggcgactgcccggaccgctgcgggtgcaccagctccacgtgcctgcacaaggagtggccccacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaactcccaggagcggcagtgcagcctcatcgaggcgggcacccgcttcaacctgggccccgtgaccatcaccctgtccgagccgcggaacatccagcagaagctcccgcccgagatcatcacgctgcacccccgcatcgaggaggggttcttcgacctgatgcacgtgcagaaggtcctcagcgcctccaccgtgtgcaagctgcagagctgcacccacggcgtccccggggacctgcagatctaccacatcggcaacctcctgaagggggaccgggtgaacggccacctgatccacaagatcgagccccacttcaacacctcctggatgagctgggacggctgcgacctcgactactactgcaacatgggggactggcccagctgcacgtacaccggcgtgacccagcacaaccacgccgccttcgtcaacctgctgaacatcgagaccgactacaccaagaacttccacttccactccaagcgcgtgacggcccacggggacacgccccagctcgacctgaaggcgcggccgacctacggcgccggggagatcaccgtgctggtcgaggtggccgacatggagctccacaccaagaagatcgccatcagcggcctgaagttcgcgtccctgacctgcaccggctgctacgcctgcagctccgggatcagctgcaaggtgcgcatccacgtcgacgagcccgacgagctcaccgtgcacgtgaagtccgaggaccccgacatcgtcgccgccagctccagcctgatggcccggaagctggagttcggcacggactccaccttcaaggcgttcagcgccatgcccaagacctccctctgcttctacatcgtggagcgcgagtactgcgagagctgctccaaggaggacacccagaagtgcgtgaacacgaagctggagcagccgcagagcatcctgatcgagcacaaggggaccatcatcggcaagcagaacgacacgtgcaccgccaaggcctcctgctggctcgagagcgtcaagtccttcttctacggcctgaagaacatgctgagcgggatcttcggcaacgtgttcatcgggatcttcctcttcctggcccccttcatcctgctgatcctcttcttcatgttcggctggcggatcctgttctgcttcaagtgctgccgccggacccgcgggctgttcaagtaccgctacctcaaggacgacgaggagagcggctaccggcgcatcatcgagcggctgaacaacaagaagggcaagaacaagctgctcgacggggagcgcctggcggaccggcgcatcgccgagctgttctccaccaagacccacatcggctga

SEQ ID NO: 11929 - RNA, 5070 nt, synthetic construct
  misc_feature 1..5070: note = derived and/or modified CDS sequence (opt1) from CCHFV(BA88166)__AF338470.1__GP
  source 1..5070: mol_type = other RNA
atgagcttctccgtgatgtacacgcccctgctctgcgccgtcctgtgcctgcagctctggagcctggagggctcccacgggctgagcaacaagacccagcactccaacaccagcaccaccaaggccccggaggtgtcccaggagctcggcctgcccgtgagcaccgtctccacgatcaccagcgacccgccctccatcaccagcgcggtgtccgtgagcgggtccgagggcagcggggacaccaacacgtcccccagcgtcaccacccagggccccaccctgcccgagacgaccctcgagcccctgaccaccacggacaccgacgcctccagcaccgtggtggtcgacgtgagcacccagacggtgaaggacaccccgatctccaccacctacacgagcctgccctccacccccagcgagcccaccaccccgcagggcacgcaccacaccgcccgcgggctcctgtccgtcaccagcaccaagcccgaggaggcctccacgcaggccaaccccggcaagatcagcatggagaccaacagcccccggctggcgatcagcgagaccccgtccttcagccccaccacgcaggcccccaccgagaactccaaccccatcaccagcaagcagctcatgctgtccgcccagccggtgacccccaaccccatgaccagccccgtgcagccggccctgtcccagagcgacacgtccaccgcgatccaggacatccaccccagccccaccgggcgcagcaagcggaacctcgagatggagatcatcctgaccctgtcccagggcctcaagaagtactacgggaagatcctgaagctgctcgacctgacgctggaggaggacaccgagggcctcctggagtggtgcaagcgcaacctgggcctcgtctgcgacgacaacttcttccagaagcggatcgaggagttcttcctgaccgggaagggccacttcaacgaggtgctgcagttcaagacccccagcacgctctccccgaccgggcccgcccgcaccggcagccccaccgtggagccgttcaagtcctacttcgccaagggcttcctgagcatggactccgggtacttcagcgccaagtgctacccccgggcctccaacagcggcctgcagctcatcaacgtcacgcagcactccacccgcatcaccgacacccccgggcccaagatcacgaacctgaagaccatcaactgcatcaacctgaaggcgagcgtgttcaaggagcaccgggagatcgagatcaacgtgctcctgccgcaggtcgccgtgaacctgtccagctgccacgtgctcatcaagtcccacgtctgcgactacagcctggacatcgacggccccgtgcgcctgccccggatccaccacgaggggaccttcatccccggcacctacaagatcgtcatcgacaagaagaacaagcagaacgaccgctgcacgctcgtgaccaactgcgtgatcaagggccgggagatccgcaaggggcagtccgtcctgcggcagtaccgcaccgagatcaagatcggcaaggccagcagcgggtcccggcgcctgctcagcgaggagtccggcgacgactgcatcagccggacccagctgctgcgcacggagaccgccgagatccactccgacaactacgggggcccgggcgacaagatcaccatctgcaacgggagcaccgtggtggaccagcggctgggctccgagctcgggtgctacacgatcaaccgcgtcaagagcttcaagctgtgcgagaactccgccaccggcaagagctgcgagatcgactccacccccgtgaagtgccgccaggggttctgcctgaagatcacccaggagggccggggccacgtgaagctcagccgcgggtccgaggtcgtgctggacgcgtgcgacagctcctgcgagatcatgatccccaagggcacgggggacatcctggtggactgcagcggcggccagcagcacttcctcaaggacaacctgatcgacctggggtgccccaacatcccgctcctgggcaagatggccatctacatctgccggatgtccaaccaccccaagaccaccatggggttcctgttctggttcagcttcggctacgtcgtgacctgcatcctctgcaaggggatcttctacctgctgatcgtggtcggcacgctcggcaagaagttcaagcagtaccgcgagctgaagccccagacctgcaccatctgcgagaccacccccgtgaacgccatcgacgccgagatgcacgacctgaactgctcctacaacatctgcccgtactgcgccagccggctcacgagcgacgggctggcgcgccacgtgatgcagtgccccaagcggaaggagaagatcgaggagaccgagctgtacctcaacctggagcgcatcccctgggtcgtgcggaagctgctccaggtgtccgagagcaccggcgtcgccctgaagcgctccagctggctggtggtgctcctggtcctgctcaccgtgtccctgagccccgtgcagtccgccccgatcgggcacggcaagacggtcgagacctaccagacccgggaggggtacaccagcatctgcctgttcgtgctcggctccatcctgttcatcgtgagctgcctgatgaagggcctcgtcgactccgtggggaacagcttcttccccggcctgtccatctgcaagacgtgcagcatcgggtccgtgaacggcttcgagatcgagagccacaagtgctactgctccctgttctgctgcccctactgccgccactgcagcgccgaccgggagatccaccgcctccacctgtccatctgcaagaagcggaagacctggagcaacgtcatgctggccgtgtgcaagcgcatgtgcttccgggcgaccgtggaggtcagcaacaaggccctcctgatccgcaacatcatcaacaccacgttcgtgctgtgcatcctcatcctggccgtgtgcgtcgtgtccaccagcgccgtggagatggagtccctgcccgcggggacctgggagcgggaggaggacctcaccaacttctgccaccaggagtgccaggtcacggagaccgagtgcctgtgcccgtacgaggccctggtgctccgcaagcccctgtacctggacagcatcgtgaagggcatgaagaacctcctgaactccaccagcctggagacctccctcagcatcgaggccccctggggcgccatcaacgtccagtccacgttcaagccgaccatgagcgccgcgaacatcgccctgtcctggagctccgtggagcaccgcgggaacaagatcctggtgagcggccggtccgagagcatcatgaagctcgaggagcgcaccgggatctcctggaacctgggcgtcgaggacgccagcgagtccaagctgctcaccgtgagcgtgatggacctgagccagatgtactcccccgtcttcgagtacctgagcggggaccgccaggtggaggagtggcccaaggccacgtgcaccggcgactgccccgagcggtgcggctgcacctccagcacgtgcctccacaaggagtggccgcactcccggaactggcgctgcaaccccacctggtgctggggcgtcgggaccgggtgcacgtgctgcggcctggacgtgaaggacctgttcaccgactacatgttcatcaagtggaaggtggagtacatcaagaccgaggccatcgtctgcgtggagctcaccagccaggagcggcagtgcaccctgatcgaggcgggcacccgcttcaacctggggcccgtgatcatcacgctctccgagccccggaacatccagcagaagctgccgcccgagatcgtcaccctgcacccccgcatcgaggagggcttcttcgacctcatgcacgtgcagaaggtgctgagcgcctccaccgtctgcaagctgcagagctgcacccacggggtgcccggcgacctccaggtgtaccacatcgggaacctgctgaagggcgacaaggtcaacggccacctcatccacaagatcgagccgcacttcaacacctcctggatgagctgggacgggtgcgacctggactactactgcaacatgggcgactggccctcctgcacgtacaccggggtgacccagcacaaccacgccgccttcgtgaacatgctgaacatcgagaccgactacacgaagaacttccacttccacagcaagcgggtcaccgcccacggcgacacgccccagctcgacctgaaggcgcgccccacctacggggccggcgagatcaccgtgctggtggaggtcgccgacatggagctccacaccaagaagatcgagatctccggcctgaagttcgccagcctgacctgcaccgggtgctacgcgtgctccagcggcatctcctgcaaggtgcggatccacgtggacgagccggacgagctcacggtccacgtgaagtccgaggaccccgacatcgtggccgccagctccagcctgatggcccgcaagctggagttcgggaccgactccaccttcaaggccttcagcgcgatgcccaagacctccctctgcttctacatcgtcgagcgggagtactgcaagagctgctccaaggaggacacgcagaagtgcgtgaacaccaagctggagcagccccagagcatcctgatcgagcacaagggcaccatcatcgggaagcagaacaacacgtgcaccgccaaggcctcctgctggctggagagcgtgaagtccttcttctacggcctcaagaacatgctgagcggcatcttcgggaacgtcttcatcggcgtgttcctgttcttcgccccgttcatcctcctgatcctgttcttcatgttcgggtggcgcatcctcttctgcttcaagtgctgccggcgcacccggggcctgttcaagtaccgccacctgaaggacgacgaggagaccggctaccggaagatcatcgagcgcctcaacaacaagaaggggaagaacaagctgctggacggcgagcgcctcgccgaccggaagatcgcggagctgttctccaccaagacgcacatcgggtga

SEQ ID NO: 11930 - RNA, 5070 nt, synthetic construct
  misc_feature 1..5070: note = derived and/or modified CDS sequence (opt1) from CCHFV(UCCR4459)__KY484032.1__GP
  source 1..5070: mol_type = other RNA
atgagcttctccatcatgtacacgcccctcctctgcgccgtgctgtgcctgcagctctggagcctggagggctcccacgggctgagcaacaagacccagcactccaacaccagcaccaccaaggccccggaggtctcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtcagcacccagacggtgaaggacacccccatctccaccacccacacgagcctcccctccaccccgagcgccaccaccacgccccagggcacccaccacaccgcccgcgggctgctgtccgtgaccagcacgaagcccgagggcgcctccacccaggcgaaccccgagaagatcagcatggagaccaactccccgcggctcgccatcagcgagaccccctccttcagccccacgacccaggcccccaccgagaactccaacccgatcaccagcaagcagctgatcttctccgcccagcccgtcacccccaaccccgtgacgccgcccgtgcagcccgcgctgagccagtccgacaccagcaccgccatccaggacatccacccctccccgaccagccgcagcaagcggaacctcgagatggagatcatcctgacgctgtcccaggggctcaagaagtactacggcaagatcctgaagctgctcgacctgaccctggaggaggacaccgaggggctcctggagtggtgcaagcgcaacctgggcctcgtctgcgacgacgacttcttccagaagcggatcgaggagttcttcctgaccggcgaggggcacttcaacgaggtgctgcagttcaagacgcccagcaccctctcccccaccggccccgcccgcaccgggagcccgacggtggagcccttcaagtcctacttcgccaagggcttcctgagcatggactccggctacttcagcgccaagtgctacccccgggcgtccaacagcgggctgcagctcatcaacgtcacccagcactccacccgcatcaccgacacgccgggccccaaggtgaccaacctgaagaccatcaactgcatcaacctgaaggccagcgtgttcaaggagcaccgggagatcgagatcaacgtcctcctgccccaggtggccgtgaacctgtccagctgccacgtcctcatcaagtcccacgtgtgcgactacagcctggacatcgacgggcccgtccgcctgccgcggatccaccacgagggcaccttcatccccgggacgtacaagctcgtgatcgacaagaagaacaagcagaacgaccgctgcaccctgatcaccaactgcgtgatcaagggccgggagatccgcaagggccagtccgtcctgcggcagtaccgcaccgagatcaagatcgggaaggccagcagcggctcccggcgcctcctgagcgaggagtccggggacgactgcatcagccggacgcagctgtcccgcaccgagaccgccgagatccacagcgacaactacggcgggcccggcgacaagatcaccatctgcaacggctccacgatcgtggaccagcggctggggagcgagctcggctgctacaccatcaaccgcgtgaagtccttcaagctgtgcgagaacagcgcgaccgggaagtcctgcgagatcgacagcacccccatcaagtgccgccagggcttctgcctgaagatcacgcaggaggggcggggccacgtcaagctctcccgcggcagcgaggtggtgctggacgcctgcgactccagctgcgagatcatgatcccgaaggggaccggcgacatcctggtcgactgctccgggggccagcagcacttcctcaaggacaacctgatcgacctgggctgccccaacatccccctcctggggaagatggccatctacatctgccggatgagcaaccaccccaagaccaccatggccttcctgttctggttctccttcggctacgtgatcacgtgcatcctctgcaaggtgatcttctacctgctgatcgtcgtggggaccctcggcaagaagttcaagcagtaccgcgagctgaagccgcagacctgcaccatctgcgagaccacgcccgtgaacgccatcgacgcggagatgcacgacctgaactgcagctacaacatctgcccctactgcgccagccggctcacctccgacgggctggcccgccacgtcatgcagtgccccaagcggaaggagaaggtggaggagaccgagctgtacctcaacctggagcgcatcccgtgggtggtccggaagctgctccaggtgagcgagtccaccggcgtggccctgaagcgcagctcctggctggtcgtgctcctggtgctgctcacggtcagcctgtcccccgtgcagagcgcccccatcggccacgggaagaccgtggagacctaccagacccgggagggctacacgtccatctgcctgttcgtcctcgggagcatcctgttcatcgtgtcctgcctgatgaagggcctcgtggacagcgtcgggaactccttcttccccggcctgagcatctgcaagacctgctccatcggcagcatcaacgggttcgagatcgagtcccacaagtgctactgcagcctgttctgctgcccgtactgccgccactgctccgcggaccgggagatccacaagctccacctgagcatctgcaagaagcgcaagaccggcagcaacgtgatgctggccgtgtgcaagcggatgtgcttccgcgccaccgtcgaggtgtccaacaaggccctcctgatccggaacatcatcaacacgaccttcgtggtctgcatcctgatcctcgcggtgtgcgtggtcagcacctccgccgtggagatggagagcctgcccgccgggacctgggagcgcgaggaggacctgacgaacttctgccaccaggagtgccaggtgaccgagaccgagtgcctctgcccctacgaggccctggtcctgcggaagcccctcttctccgacagcatcgtgaagggcatgaagaacctgctgaactccaccagcctcgagacgtccctgagcatcgaggccccgtggggcgcgatcaacgtgcagtccaccttcaagcccaccgtcagcgccgccaacatcgccctgtcctggagctccgtggagcaccgcgggaacaagatcctcgtgagcggccgctccgagagcatcatgaagctggaggagcggaccgggatctcctgggacctgggcgtcgaggacgccagcgagagcaagctcctgacggtgtccatcatggacctgagccagatgtactcccccgtgttcgagtacctcagcggggaccgccaggtcgaggagtggccgaaggcgacctgcaccggcgactgccccgagcggtgcgggtgcacctccagcacgtgcctgcacaaggagtggccccactcccgcaactggcggtgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggcccggtgacgatcaccctgagcgagccccgcaacatccagcagaagctgccgcccgagatcgtcaccctccacccccggatcgaggagggcttcttcgacctgatgcacgtgaagaaggtgctgtccgccagcaccgtctgcaagctccagtcctgcacccacggggtgcccggcgacctccaggtgtaccacatcgggaacctgctcaagggcgacaaggtcaacgggcacctgatccacaagatcgagccccacttcaacacgagctggatgtcctgggacggctgcgacctggactactactgcaacatgggcgactggcccagctgctcctacaccggggtgacccagcacaaccacgccgcgttcgtgaacatgctcaacatcgagaccgactacacgaagatcttccacttccacagcaagcgcgtcaccgcccacggcgacaccccgcagctggacctgaaggcccggcccacctacggggccggcgagatcacggtgctcgtggaggtcgcggacatggagctgcacaccaagaagatcgagatctccgggctgaagttcgccagcctgacctgcaccggctgctacgcctgcagctccggcatcagctgcaaggtgcgcatccacgtggacgagcccgacgagctgacggtccacgtgaagtccgaggaccccgacatcgtggccgccagctccagcctgatggcgcggaagctcgagttcgggaccgactccaccttcaaggccttcagcgccatgccgaagacctccctgtgcttctacatcgtcgagcgcgagtactgcaagagctgctccaaggaggacacgcagaagtgcgtgaacaccaagctggagcagccccagagcatcctcatcgagcacaagggcaccatcatcgggaagcagaacgacacgtgcacctccaaggccggctgctggctggagagcgtgaagtccttcttctacgggctgaagaacatgctgagcggcatcttcggcaacgtcttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggggagcgcctggcggaccgcaagatcgccgagctgttctccaccaagacgcacatcggctga

SEQ ID NO: 11931 - RNA, 5070 nt, synthetic construct
  misc_feature 1..5070: note = derived and/or modified CDS sequence (opt1) from CCHFV(K168_125)__KX013460.1__GP
  source 1..5070: mol_type = other RNA
atgcccatcagcaccatgcacatctccctgatgtgcgccgtgctctgcctgcagctgtacggcctcgggggcacccacgggctgcacaacggcacggagcacaacaagaccaacgccgtcaccaccagctccaacagccagtccagcgagtccccggcgcgcacggccccgcccgtgacccccgacagccccaccgtgacccccacgacccccgcctccgcccccgaggggagcggcgaggcccactccagcccgcccaacaacaccgagggcccctccctgcccgagagcacctccgagccgcccgcggccacgagcaccgggatcccctccgccagcgacgtcaactccagcacccaggccgcgcgggacaccagcacgcccaccgtgcgcacctccccgcccaacagcccctccaccccgcccacgccccaggagacccaccaccccgtgcggaacctcctgagcgtcacctcccacaagcccgaggagaccagcgccccgtccgagagcggcaaggagtcccccgccgccaacagcccccaccccgtggcctcccgcccgcccacgcccagcaccaccgcgcaggggccgaccgagaacaacaactacaacacgaccggccagctggagtccctcacccagagcaccacgctggggcccatgacctccctgacccagaccgacctcccccagagcgtgacgtccatcgccgtccaggacacccaccccagcccgaccaaccggtccaagcgcaacctggagatggagatcatcctgaccctcccccagggcctgaagaagtactacggcaaggtgctgcggctcctgcagctgaccctcgaggaggacacggaggggctgctggagtggtgcaagcgcaacctcggcctggactgcgacgacaccttcttccagaagcggatcgaggagttcttcatcaccggggagggccacttcaacgaggtgctgcagttccgcacccccggcacgctcagcaccaccgagagcacccacgccgggctgcccacggccgagccgttcaagtcctacttcgccaagggcttcctgagcatcgactccgggtacttcagcgcgaagtgctactcccggaccagcaactccggcctccagctgatcaacgtcacccgccacagcacccggatcgccgacacgcccgggctgaagatcaccaacctcaagaccatctcctgcatcaacctgaaggccagcgtgttcaaggagcaccgcgaggtggagatcaacgtcctgctcccccaggtggccgtgaacctgtccaactgccacgtcaccatcaagagccacgtgtgcgactactccctggacatcgacggcacggtgcggctcccccacatccaccacgacggcaccttcatcccggggacctacaagatcgtcatcgaccgcaagaacaagctgaacgaccggtgcaccctgttcacgaactgcgtgatcaagggccgcgaggtgcggaaggggcagagcgtcctccgccagtacaagaccgagatccggatcggcaaggcctccaccgggagccgccgcctgctgtccgacgagagcggcgacgactgcatcagccggacccagctcctgcgcacggagaccgcggagatccacggcgacaactacgggggccccggggacaagatcaccatctgcaacggctccaccatcgtggaccagcggctggggagcgagctcggctgctacacgatcaaccgcgtcaagtccttcaagctgtgcgagaacagcgccaccggcaagtcctgcgaggtggacagcatccccgtgaagtgccggcaggggtactgcctgaagatcacccaggagggccgcgggcacgtcaagctgtcccggggcagcgaggtggtgctcgacgcctgcgactccagctgcgaggtcatgatccccaagggcaccggggacatcctggtggactgctccggcgggcagcagcacttcctgaaggacaacctcatcgacctgggctgcccgaaggtgcccctgctcgggaagatggccatctacatctgccgcatgagcaaccaccccaagacgaccatggccttcctgttctggttctccttcggctacgtcatcacgtgcatcgtgtgcaaggcgatcttctacctgctcatcatcgtgggcaccctggggaagcggttcaagcagtaccgcgagctgaagccccagacctgcaccatctgcgagaccaccccgaccaacgccatcgacgccgagatgcacgacctcaactgcagctacaacatctgcccctactgcgcctcccggctgacgagcgacggcctggcgcgccacgtcacccactgccccaagcggaaggagaaggtggaggagaccgagctctacctgaacctggagcgcatcccctgggtggtccggaagctcctccaggtgtccgagagcaccggggtggccctgaagcgctccagctggctgatcgtcctgctggtcctcttcgccgtgagcctgtccccggtgcagagcgcccccatcggccacgggaagacgatcgagacctaccaggtgcgggaggagtacacctccatctgcctgttcgtgctcggcagcatcctgttcatcgtctcctgcctgatgaagggcctcgtgaacagcgtggggaacatcttcttccccggcctgtccatctgcaagacctgcagcatcgggtccatcaacggcttcgagatcgagagccacaagtgctactgctccctgctctgctgcccgtactgccgccactgcagcgccgaccgggagatccaccagctgcacctgtccatctgcaagaagcgcaagacggggagcaacgtcatgctcgcggtgtgcaagcgcatgtgcttccgggccaccgtggaggtctccaacaaggccctgagcatccgctccatcatcaacaccaccttcgtggtgtgcatcctgatcctcgccgtctgcgtggtgagcacgtccgccgtcgagatggagagcctgcccgcgggcacctgggagcgggaggaggacctgaccaacttctgccaccaggagtgccaggtgaccgagacggagtgcctctgcccctacgaggccctggtgctgcgccggcccctcttcctggacagcatcgtcaagggcaagaagaacctgctcaactccaccagcctggagacctccctgagcatcgaggccccgtggggcgccatcaacgtgcagtccacctacaagcccacggtgagcgccgcgaacatcgccctctcctggagctccgtcgagcaccgcgggaacaagatcctggtgagcgggcggtccgagagcatcatgaagctggaggagcgcaccggcatctcctgggacctcggggtggaggacgccagcgagtccaagctgctgaccgtcagcgtgatggacctctcccagatgtacagccccgtgttcgagtacctgtccggcgaccggcaggtcgaggagtggcccaaggcgacctgcacgggcgactgcccggagcgctgcgggtgcaccagctccacgtgcctgcacaaggagtggccccacagccggaactggcgctgcaaccccacctggtgctggggcgtggggaccggctgcacgtgctgcggcctcgacgtgaaggacctgttcaccgactacatgttcgtcaagtggaaggtggagtacatcaagaccgaggccatcgtctgcgtggagctgaccagccaggagcggcagtgctccctcatcgaggccgggacccgcttcaacctgggccccgtgaccatcaccctgagcgagccgcggaacatccagcagaagctcccgcccgagatcatcacgctgcacccccgcatcgaggaggggttcttcgacctgatgcacgtccagaaggtgctctccgccagcaccgtgtgcaagctgcagtcctgcacccacggcgtccccggggacctccaggtgtaccacatcggcaacctgctgaagggcgacaaggtgaacgggcacctgatccacaagatcgagccccacttcaacaccagctggatgtcctgggacggctgcgacctcgactactactgcaacatgggggactggcccagctgcacctacacgggcgtcacccagcacaaccacgcctccttcatcaacctgctgaacatcgagaccgactacaccaagagcttccacttccactccaagcgggtgacggcccacggggacacgccccagctcgacctgaaggcgcgcccgaactacggcgccggcgagatcaccgtgctggtcgaggtggccgacatggagctccacaccaagaagatcgagatcagcgggctgaagttcgcctccctgacctgcaccggctgctacgcctgcagctccgggatcagctgcaaggtgcggatccacgtcgacgagcccgacgagctcaccgtgcacgtgaagtccgacgaccccgacgtcgtggcggccagcagctccctgatggcccgcaagctggagttcggcaccgacagcacgttcaaggccttctccgccatgcccaagaccagcctctgcttctacatcgtggagcgggagtactgcaagtcctgcagcaaggaggacacccagaagtgcgtcaacaccaagctggagcacccgcagtccatcctgatcgagcacaaggggacgatcatcggcaagcagaacaacacgtgcaccgcgaagaccagctgctggctcgagtccgtcaagagcttcttctacggcctgaagaacatgctgtccgggatcttcggcaacgtgttcgtggggatcttcctcttcctggcccccttcatcctgctgatcctcttcttcatgttcggctggcgcatcctgttctgcttcaagtgctgccgccggacccgcggcctgttccggtacaagcacctcgaggacgacgaggagaccgggtaccgccggatcatcgagcgcctgaacaacaagaagggcaagaacaagctgctcgacggggagcggctggccgaccgccggatcgccgagctgttcagcaccaagacccacatcggctga

SEQ ID NO: 11932 - RNA, 5070 nt, synthetic construct
  misc_feature 1..5070: note = derived and/or modified CDS sequence (opt1) from CCHFV(K168_40)__KX013457.1__GP
  source 1..5070: mol_type = other RNA
atgcccatcagcaccatgcacatctccctgatgtgcgccgtgctctgcctgcagctgtacggcctcgggggcacccacgggctgcacaacggcacggagcacaacaagaccaacgccgtcaccaccagctccaacagccagtccagcgagtccccggcgcgcacggccccgcccgtgacccccgacagccccaccgtgacccccacgacccccgcctccgcccccgaggggagcggcgaggcccactccagcccgcccaacaacaccgagggcccctccctgcccgagagcacctccgagccgcccgcggccacgagcaccgggatcccctccgccagcgacgtcaactccagcacccaggccgcgcgggacaccagcacgcccaccgtgcgcacctccccgcccaacagcccctccaccccgcccacgccccaggagacccaccaccccgtgcggaacctcctgagcgtcacctcccacaagcccgaggagaccagcgccccgtccgagagcggcaaggagtcccccgccgccaacagcccccaccccgtggcctcccgcccgcccacgcccagcaccaccgcgcaggggccgaccgagaacaacaactacaacacgaccggccagctggagtccctcacccagagcaccacgctggggcccatgacctccctgacccagaccgacctcccccagagcgtgacgtccatcgccgtccaggacacccaccccagcccgaccaaccggtccaagcgcaacctggagatggagatcatcctgaccctcccccagggcctgaagaagtactacggcaaggtgctgcggctcctgcagctgaccctcgaggaggacacggaggggctgctggagtggtgcaagcgcaacctcggcctggactgcgacgacaccttcttccagaagcggatcgaggagttcttcatcaccggggagggccacttcaacgaggtgctgcagttccgcacccccggcacgctcagcaccaccgagagcacccacgccgggctgcccacggccgagccgttcaagtcctacttcgccaagggcttcctgagcatcgactccgggtacttcagcgcgaagtgctactcccggaccagcaactccggcctccagctgatcaacgtcacccgccacagcacccggatcgccgacacgcccgggcccaagatcaccaacctgaagaccatctcctgcatcaacctcaaggccagcgtgttcaaggagcaccgcgaggtggagatcaacgtcctgctgccccaggtggccgtgaacctctccaactgccacgtcaccatcaagagccacgtgtgcgactactccctggacatcgacggcacggtgcggctgccgcacatccaccacgacggcaccttcatccccgggacctacaagatcgtcatcgaccgcaagaacaagctcaacgaccggtgcaccctgttcacgaactgcgtgatcaagggccgcgaggtgcggaaggggcagagcgtcctgcgccagtacaagaccgagatccggatcggcaaggcctccaccgggagccgccgcctcctgtccgacgagagcggcgacgactgcatcagccggacccagctgctccgcacggagaccgcggagatccacggcgacaactacgggggccccggggacaagatcaccatctgcaacggctccaccatcgtggaccagcggctggggagcgagctgggctgctacacgatcaaccgcgtcaagtccttcaagctctgcgagaacagcgccaccggcaagtcctgcgaggtggacagcatccccgtgaagtgccggcaggggtactgcctgaagatcacccaggagggccgcgggcacgtcaagctgtcccggggcagcgaggtggtgctggacgcctgcgactccagctgcgaggtcatgatcccgaagggcaccggggacatcctcgtggactgctccggcgggcagcagcacttcctgaaggacaacctgatcgacctcggctgccccaagatccccctgctggggaagatggccatctacatctgccgcatgagcaaccaccccaagacgaccatggccttcctcttctggttctccttcggctacgtgatcacgtgcatcgtctgcaaggcgatcttctacctgctgatcatcgtgggcaccctcgggaagcggttcaagcagtaccgcgagctgaagccgcagacctgcaccatctgcgagaccacccccaccaacgccatcgacgccgagatgcacgacctgaactgcagctacaacatctgcccctactgcgcctcccggctcacgagcgacggcctggcgcgccacgtgacccactgccccaagcggaaggagaaggtcgaggagaccgagctgtacctcaacctggagcgcatcccgtgggtggtgcggaagctgctccaggtctccgagagcaccggggtggccctgaagcgctccagctggctgatcgtgctcctggtcctgttcgccgtgagcctctcccccgtgcagagcgcccccatcggccacgggaagacgatcgagacctaccaggtccgggaggagtacacctccatctgcctgttcgtgctgggcagcatcctcttcatcgtgtcctgcctgatgaagggcctggtcaacagcgtggggaacatcttcttcccgggcctctccatctgcaagacctgcagcatcgggtccatcaacggcttcgagatcgagagccacaagtgctactgctccctgctgtgctgcccctactgccgccactgcagcgccgaccgggagatccaccagctccacctgtccatctgcaagaagcgcaagacggggagcaacgtgatgctggcggtctgcaagcgcatgtgcttccgggccaccgtggaggtgtccaacaaggccctcagcatccgctccatcatcaacaccaccttcgtcgtgtgcatcctgatcctggccgtgtgcgtcgtgagcacgtccgccgtggagatggagagcctccccgcgggcacctgggagcgggaggaggacctgaccaacttctgccaccaggagtgccaggtcaccgagacggagtgcctgtgcccctacgaggccctcgtgctgcgccggccgctgttcctcgacggcatcgtgaaggggatgaagaacctgctgaacagcacctccctcgagaccagcctgtccatcgaggccccctggggcgccatcaacgtccagagcacctacaagcccacggtgtccgccgcgaacatcgccctgagctggtccagcgtggagcaccgcgggaacaagatcctcgtctccggccggagcgagtccatcatgaagctggaggagcgcaccgggatcagctgggacctgggcgtggaggacgcctccgagagcaagctcctgaccgtgtccgtcatggacctgagccagatgtactcccccgtgttcgagtacctcagcggcgaccgccaggtggaggagtggccgaaggcgacctgcacgggggactgccccgagcggtgcggctgcacctccagcacgtgcctgcacaaggagtggccccacagccggaactggcgctgcaaccccacctggtgctggggcgtcgggaccggctgcacgtgctgcgggctggacgtgaaggacctcttcaccgactacatgttcgtgaagtggaaggtcgagtacatcaagaccgaggccatcgtgtgcgtcgagctgacctcccaggagcggcagtgcagcctgatcgaggccggcacccgcttcaacctcgggccggtgaccatcaccctgtccgagccccggaacatccagcagaagctgccgcccgagatcatcacgctccacccccgcatcgaggagggcttcttcgacctgatgcacgtgcagaaggtcctgagcgcctccaccgtgtgcaagctccagagctgcacccacggggtgcccggcgacctgcaggtctaccacatcggcaacctgctcaagggggacaaggtgaacggccacctgatccacaagatcgagccccacttcaacacctcctggatgagctgggacgggtgcgacctggactactactgcaacatgggcgactggccctcctgcacctacacgggggtgacccagcacaaccacgccagcttcatcaacctcctgaacatcgagaccgactacaccaagtccttccacttccacagcaagcgggtcacggcccacggcgacaccccgcagctggacctcaaggcgcgccccaactacggcgccggggagatcaccgtgctggtggaggtcgccgacatggagctgcacaccaagaagatcgagatctccggcctcaagttcgccagcctgacgtgcaccgggtgctacgcctgctccagcggcatctcctgcaaggtgcggatccacgtggacgagcccgacgagctgaccgtccacgtcaagagcgacgaccccgacgtggtggcggcctccagcagcctcatggcccgcaagctggagttcgggaccgactccacgttcaaggccttcagcgccatgccgaagacctccctgtgcttctacatcgtggagcgggagtactgcaagagctgctccaaggaggacacccagaagtgcgtgaacaccaagctcgagcacccccagagcatcctgatcgagcacaagggcacgatcatcggcaagcagaacaacacgtgcaccgcgaagacctcctgctggctggagagcgtcaagtccttcttctacgggctcaagaacatgctgagcggcatcttcgggaacgtgttcgtgggcatcttcctgttcctcgcccccttcatcctgctgatcctgttcttcatgttcggctggcgcatcctcttctgcttcaagtgctgccgccggacccgcgggctgttccggtacaagcacctggaggacgacgaggagaccggctaccgccggatcatcgagcgcctcaacaacaagaaggggaagaacaagctgctggacggcgagcggctcgccgaccgccggatcgccgagctgttctccaccaagacccacatcgggtga

SEQ ID NO: 11933 - RNA, 5070 nt, synthetic construct
  misc_feature 1..5070: note = derived and/or modified CDS sequence (opt1) from CCHFV(K128_76)__KX013454.1__GP
  source 1..5070: mol_type = other RNA
atgcccatcagcgtgatgcacatctccctgatgtgcgccgtcctctgcctgcagctgtacggcctcgggggcacccacgggagccacaacgagaccgagcacaacaagacgaacgccgtgaccacctccagcgactcccagagcccggagccccccacccgcacgaccctgcccgtgaccccggactcccccaccgtcacgcccaccacccccgcgagcgccccggagggctccggggaggtgcacaccagcccccccaacacgaccgagggcccctccctgccggagagcacccccgagccccccaccgccacgtccaccggcatcccgagcgcctccgacgtgaacagctccacccaggccgcgcgggacaccagcacgcccaccgtccacacctccccccccaacagcccgagcaccccccccacgctccaggagacccaccaccccatgcgcaacctgctgtccgtgaccagccacaagccggaggagacctccgcccccagcgagtccgggaaggagagccccgccgccaactccccccacccggtggcggaccggcccagcacgtccagcaccaccgcccagggccccaccgagaacaactcctacaacacgaccgagcagctcgagagcctgacccagtccaccacgctggggccgatgaccagcctcacccagaccgtcctgtcccagagcgtgacctccatcgccgtgcaggacacgcacctgagccccaccaaccgctccaagcggaacctcgagatggagatcatcctgaccctgccccagggcctcaagaagtactacgggaaggtcctgcgcctgctccagctgaccctggaggaggacacggagggcctcctggagtggtgcaagcggaacctggacctcgactgcgacgacaccttcttccagaagcgcatcgaggagttcttcatcaccggcgaggggtacttcaacgaggtgctgcagttccggacccccggcacgctgagcaccaccgagagcacccacgccgggctcccgacggccgagcccttcaagtcctacttcgcgaagggcttcctgagcatcgactccggctacttcagcgccaagtgctactcccgcaccagcaactccgggctgcagctcatcaacgtgacccggcacagcacccgcatcgccgacacgcccggccccaagatcaccaacctgaagaccatctcctgcatcaacctgaaggccagcgtcttcaaggagcaccgggaggtggagatcaacgtgctcctgccgcaggtcgccgtgaacctgtccaactgccacgtgaccatcaagagccacgtctgcgactactccctcgacatcgacgggacggtgaagctgccccacatccaccacgacggcaccttcatccccgggacctacaagatcgtgatcgaccgcaagaacaagctgaacgaccggtgcaccctcttcacgaactgcgtcatcaagggccgcgaggtgcggaagggccagagcgtcctgcgccagtacaagaccgagatccggatcgggaaggcgtccaccggcagccgccggctgctctccgacgagagcggggacgactgcatcagccgcacccagctgctgcgcacggagaccgccgagatccacggcgacaactacgggggccccggcgacaagatcaccatctgcaacgggtccaccatcgtggaccagcggctcggcagcgagctggggtgctacacgatcaaccgcgtgaagtccttcaagctgtgcgagaacagcgccaccggcaagtcctgcgagatcgacagcatcccggtcaagtgccggcaggggtactgcctgaagatcacccaggagggccgcggccacgtgaagctctcccgggggagcgaggtggtcctggacgcctgcgactccagctgcgaggtgatgatccccaagggcaccggggacatcctggtggactgctccggcggccagcagcacttcctcaaggacaacctgatcgacctggggtgccccaagatccccctcctgggcaagatggccatctacatctgccgcatgagcaaccacccgaagacgaccatggcgttcctgttctggttctccttcgggtacgtcatcacctgcatcgtgtgcaaggccatcttctacctcctgatcatcgtgggcaccctggggaagcggttcaagcagtaccgcgagctcaagccccagacctgcacgatctgcgagaccacccccaccaacgccatcgacgccgagatgcacgacctgaactgcagctacaacatctgcccctactgcgcctcccggctgacgagcgacggcctcgcgcgccacgtcacccactgcccgaagcggaaggagaaggtggaggagaccgagctgtacctgaacctcgagcgcatcccctgggtggtccggaagctgctgcaggtgtccgagagcaccggcgtggccctcaagcgctccagctggctgatcgtcctgctcgtgctgttcgccgtgagcctgtcccccgtccagagcgcccccatctcccacgggaagacgatcgagacctaccaggtgcgggaggagtacaccagcatctgcctcttcgtgctgggctccatcctgttcatcgtcagctgcctcatgaaggggctggtgaactccgtgggcaacatcttcttcccggggctgagcatctgcaagacctgctccatcggcagcatcaacggcttcgagatcgagtcccacaagtgctactgcagcctcctgtgctgcccctactgccgccactgctccgcggaccgggagatccaccagctgcacctcagcatctgcaagaagcgcaagacggggtccaacgtcatgctggccgtgtgcaagcggatgtgcttccgcgccaccatggaggtgagcaacaaggccctgttcatccgctccatcatcaacaccaccttcgtcgtgtgcatcctcatcctggccgtgtgcgtcgtgagcacgtccgcggtggagatggagagcctgcccgccggcacctgggagcgggaggaggacctcaccaacttctgccaccaggagtgccaggtcaccgagacggagtgcctgtgcccgtacgaggccctggtgctccgccggcccctgttccaggacagcatcgtgaaggggatgaagaacctgctcaactccaccagcctggagacctccctgagcatcgaggccccctggggcgccatcaacgtccagtccacctacaagcccgcggtgagcgccgccaacatcgccctctcctggagctccgtggagcaccgcgggagcaagatcctggtctccggccggagcgagtccatcatgaagctggaggagcgcacgggcatcagctgggacctcggggtggaggacgcctccgagagcaagctgctgaccgtgtccgtcatggacctcagccagatgtactccccggtgttcgagtacctgagcggcgaccggcaggtggaggagtggcccaaggcgacctgcaccggggactgccccgagcgctgcggctgcacgagctccacctgcctgcacaaggagtggccccacagccggaactggcgctgcaacccgacctggtgctggggggtcggcaccggctgcacgtgctgcgggctcgacgtgaaggacctgttcaccgactacatgttcgtgaagtggaaggtcgagtacatcaagaccgaggccatcgtgtgcgtcgagctgacctcccaggagcggcagtgcagcctcatcgaggccggcacgcgcttcaacctggggcccgtgaccatcaccctgtccgagccccggaacatccagcagaagctccccccggagatcatcaccctgcacccccgcatcgaggagggcttcttcgacctgatgcacgtgcagaaggtcctcagcgcctccaccgtgtgcaagctgcagagctgcacgcacggcgtgcccggggacctgcaggtctaccacatcggcaacctcctgaagggggaccgggtgaacggccacctgatccacaagatcgagccccacttcaacacctcctggatgagctgggacgggtgcgacctcgactactactgcaacatgggcgactggccgtcctgcacctacaccggcgtgacgcagcacaaccacgcgagcttcgtcaacctgctgaacatcgagaccgactacaccaagtccttccacttccacagcaagcgcgtgaccgcccacggggacacgccccagctcgacctgaaggcccggcccaactacggcgccggggagatcaccgtgctggtcgaggtggccgacatggagctccacaccaagaagatcgagatctccggcctgaagttcgcgagcctgacctgcacggggtgctacgcctgctccagcggcatctcctgcaaggtgcgcatccacgtcgacgagcccgacgagctcaccgtgcacgtgaagagcgacgacccggacgtcgtggccgccagctccagcctgatggcccggaagctggagttcggcaccgactccaccttcaaggcgttcagcgccatgcccaagacgtccctctgcttctacatcgtggagcgcgagtactgcaagagctgctccaaggaggacacccagaagtgcgtcaacaccaagctggagcagccccagagcatcctgatcgagcacaaggggaccatcatcggcaagcagaacaacacgtgcaccgccaagacctcctgctggctcgagagcgtgaagtccttcttctacgggctgaagaacatgctgagcggcatcttcgggaacgtgttcgtcggcatcttcctcttcctggcccccttcatcctgctgatcctcttcttcatgttcggctggcggatcctgttctgcttcaagtgctgccgccgcacccgggggctgttccgctacaagcacctcgagaacgacgaggagacgggctaccggcgcatcatcgagcggctgaacaacaagaaggggaagaacaagctgctcgacggcgagcgcctggccgaccggcgcatcgcggagctgttctccaccaagacccacatcggctga

SEQ ID NO: 11934 - RNA, 5070 nt, synthetic construct
  misc_feature 1..5070: note = derived and/or modified CDS sequence (opt1) from CCHFV(Hodzha)__KX013448.1__GP
  source 1..5070: mol_type = other RNA
atgcccgtgagcatcatgcacatcctgctcatgtgcgccgtcctgtgcctgcagcagtacggcctcggggagacccaccgcccgaacaacggcaccgagcacaacaagacgaacgtgctgaccaccccctccgacaagctgagccccgagcccccggtgtccaccgccctcagcgtcacgcccgactccagcaccgtgacccccaccacgcccgtgtccgggctggagggcagcggggaggtctacacctccccgcccgtgaccaccaagggcctgagcccctccaaggcgacgagcgagctccccgccaccaccggcatcgacacctccagcgcctccgacgtggacagctccacgcaggccgcccgggacaccagcaccctgaccgtccgcacgtccccgcccagcagcccctccacgcccccgaccagccaggacacctaccacctggtgcggaacctcctgtccgtgacgagcccccgccccgaggagaccaccgcgccctccaagagcgggaaggagtccccggtcgccaacagcccccaccccgtgacctcccggcccagctccccgcccatcacggtgcagggccccaccgagaacagctcccacaacaccaccgggcagctggagagcatggcccagtccacgaccctcgtccccatggccagcccgacccagaccgtgctgtcccagagcgtgacgtccctggcggtccaggacgcccaccccagccccaccaaccgcagcaagcggaacctcgagatggagatcatcctgaccctgccgcagggcctcaagaagtactacgggaaggtgctgcgcctgctccagctgaccctggaggaggacaccgagggcctcctggagtggtgcaagcggaacctgggcctcgactgcgacgacacgttcttccagaagcgcatcgaggagttcttcatcaccggggagggccacttcaacgaggtgctgcagttcaagaccccctccaccctgagcacgaccgagtccacccacgccgtcagccccaccgccgagcccttcaagtcctacttcgccaaggggttcctcagcatcgactccggctacttcagcgcgaagtgctactccaagacgagcaactccggcctgcagctgatcaacgtgacccggcacagcacccgcatcgccgacaccccggggcccaagatcacgaacctcaagaccatctcctgcatcaacctgaaggccagcgtgttcaaggagcaccgggaggtcgagatcaacgtgctgctcccccaggtcgccgtgaacctgtccaactgccacgtgaccatcaagagccacgtctgcgactactccctggacgtggacggcaccgtgcgcctcccccacatccaccacgggggcacgttcatcccggggacctacaagatcgtcatcgacaagaagaacaagctgaacgaccggtgcaccctgtacaccaactgcgtgatcaagggccgcgaggtgcggaagggccagagcatcctccgccagtacaagacggagatccggatcgggaaggccagcaccggctcccgccggctgctgagcgaggagtccggggacgactgcatcagccgcacccagctcctgcgcaccgagacggcggagatccacggcgacgactacgggggccccggcgacaagatcaccatctgcaacgggtccaccatcgtcgaccagcggctgggcagcgagctggggtgctacaccatcaaccgcgtgaagtccttcaagctctgcgagaacagcgccacgggcaagtcctgcgagatcgacagcacccccgtgaagtgccggcaggggtactgcctgaagatcacccaggagggccgcggccacgtcaagctgtcccgggggagcgaggtggtgctcgacgcctgcgactccagctgcgaggtcatgatccccaagggcaccggggacatcctggtggactgctccggcggccagcagcacttcctgaaggacaacctcatcgacctggggtgcccgcgcatccccctgctcggcaagatggccatctacatctgccggatgagcaaccaccccgagacgaccatggccttcctgttctggttctccttcgggtacgtgatcacgtgcatcctgtgcaaggcgatcttctacctcctgatcatcgtcggcaccctggggaagcgcttcaagcagtaccgggagctcaagccccagacctgcaccatctgcgagaccaccccggccaacgccatcgacgccgagatgcacgacctgaactgcagctacaacatctgcccctactgcgcctcccgcctgaccagcgacggcctcgcgcggcacgtgacgcagtgccccaagcgcaaggagaaggtggaggagaccgagctgtacctgaacctcgagcggatcccctggatcgtccgcaagctgctccaggtgagcgagtccaccggcgtggccctgaagcggagctcctggctgatcgtcctgctcgtgctgttcgccgtgagcctgtccccggtccagagcgcccccatcgggcacggcaagaccatcgagacgtaccaggcgcgcgaggagtacacctccatctgcctcttcgtgctggggagcatcctgttcatcgtgtcctgcctcatgaagggcctggtcgacagcatcgggaacatcttcttccccggcctgaccatctgcaagacctgctccatcggcagcatcaacgggttcgagatcgagtcccacaagtgctactgcagcctcctgtgctgcccctactgccggcactgcccggccgaccgcgagatccaccagctgcacctctccatctgcaagaagcggaagacgggcagcaacgtgatgctggccgtgtgcaagcgcatgtgcttccgcgccaccatggaggtctccaacaaggccctgctcatccggagcatcatcaacaccaccttcgtggtgtgcatcctgatcctggcggtctgcgtggtgtccacgagcgccgtcgagatggagagcctccccgccgggacctgggagcgcgaggaggacctgaccaacttctgccaccaggagtgccaggtgaccgagacggagtgcctgtgcccctacgaggccctcgtgctgcggcgcccgctgttcctcgactccatcgtcaagggcaagaagaacctgctgaacagcacctccctcgagaccagcctgtccatcgaggccccctggggcgcgatcaacgtgcagagcacctacaagcccacggtgtccaccgccaacatcgccctgagctggtccagcgtcgagcaccgggggaacaagatcctcgtgtccggccgcagcgagtccatcatgaagctggaggagcggaccgggatcagctgggacctgggcgtggaggacgcctccgagagcaagctcctgaccgtctccgtgatggacctgagccagatgtactcccccgtgttcgagtacctcagcggggaccgccaggtcgaggagtggccgaaggccacgtgcaccggcgactgcagcgagcggtgcgggtgcacctccagcacgtgcctgcacaaggagtggccccactcccgcaactggcggtgcaaccccacctggtgctggggcgtgggcaccgggtgcacgtgctgcggcctggacgtcaaggacctcttcaccgactacatgttcgtgaagtggaaggtggactacatcaagaccgaggcgatcgtctgcgtggagctgaccagccaggagcgccagtgctccctggtggaggccgggacccggttcaacctcggccccgtcaccatcacgctgagcgagccgcgcaacatccagcagaagctgccgcccgagatcatcaccctccacccccggatcgaggagggcttcttcgacctgatgcacgtgcagaaggtgctgtccgccagcaccgtctgcaagctccagtcctgcacccacggggtgcccggcgacctccaggtgtaccacatcgggaacctgctgaagggcgacaaggtcaacgggcacctgatccacaagatcgagccccacttcaacaccagctggatgtcctgggacggctgcgacctggactactactgcaacatgggcgactggcccagctgcacgtacaccggggtgacccagcacaaccacgcctccttcgtgaacctcctgaacatcgagaccgactacaccaagagcttccacttccactccaagcgcgtcaccgcgcacggcgacacgccccagctggacctcaaggcccggccgacctacggggccggcgagatcaccgtgctggtggaggtcgccgacatggagctgcacaccaagaagatcgagatcaccgggctcaagttcgccagcctgacctgcacgggctgctacgcgtgctccagcggcatctcctgcaaggtgcgcatccacgtggacgagcccgacgagctgaccgtccacgtcaagagcgacgaccccgacgtggtggccgccagctccagcctcatggcccggaagctggagttcgggaccgactccaccttcaaggccttcagcgcgatgcccaagacgtccctgtgcttctacatcgtggagcgcgagtactgcaagagctgctccaaggaggacacccagaagtgcgtgaacaccaagctcgagcagccgcagagcatcctgatcgagcagaagggcaccatcatcgggaagcagaacaacacgtgcaccgccaaggcctcctgctggctggagagcgtcaagtccttcttctacggcctgaagaacatgctcagcgggatcttcggcaacgtgttcgtgggcatcttcctgttcctggcccccttcatcctcctgatcctgttcttcatgttcgggtggcggatcctcttctgcttcaagtgctgccgccgcacccggggcctgttcaagtacaagcacctgaaggacgacgaggagaccgggtaccgccggatcatcgagcgcctcaacaacaagaagggcaagaacaagctgctggacggcgagcggctcgccgaccgccggatcgcggagctgttctccacgaagacccacatcgggtga

SEQ ID NO: 11935 - RNA, 5070 nt, synthetic construct
  misc_feature 1..5070: note = derived and/or modified CDS sequence (opt1) from CCHFV(Hy13)__AY900145.1__GP
  source 1..5070: mol_type = other RNA
atgagcttctccatcatgtacacgcccctgctctgcgccgtgctgtgcctgcagctctggagcctggagggctcccacgggctgagcaacaagacccagcactccaacaccagcaccaccaaggccccggaggtgtcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtcagcacccagacggtgaaggacacccccatctccaccacccacacgagcctcccctccaccccgagcgccaccaccacgccccagggcacccaccacaccgcccgcgggctgctgtccgtgaccagcacgaagcccgagggcgcctccacccaggcgaaccccgagaagatcagcatggagaccaactccccgcggctcgccatcagcgagaccccctccttcagccccacgacccaggcccccaccgagaactccaacccgatcaccagcaagcagctgatcttctccgcccagcccgtcacccccaaccccgtgacgccgcccgtgcagcccgcgctgagccagtccgacaccagcaccgccatccaggacatccacccctccccgaccagccgcagcaagcggaacctcgagatggagatcatcctgacgctgtcccaggggctcaagaagtactacggcaagatcctgaagctgctcgacctgaccctggaggaggacaccgaggggctcctggagtggtgcaagcgcaacctgggcctcgtctgcgacgccgacttcttccagaagcggatcgaggagttcttcctgaccggcgaggggcacttcaacgaggtgctgcagttcaagacgcccagcaccctctcccccaccggccccgcccgcaccgggagcccgacggtggagcccttcaagtcctacttcgccaagggcttcctgagcatggactccggctacttcagcgcgaagtgctacccccgggcctccaacagcgggctgcagctcatcaacgtcacccagcactccacccgcatcaccgacacgccgggccccaaggtgaccaacctgaagaccatcaactgcatcaacctgaaggccagcgtgttcaaggagcaccgggagatcgagatcaacgtcctcctgccccaggtggccgtgaacctgtccagctgccacgtcctcatcaagtcccacgtgtgcgactacagcctggacatcgacgggcccgtccgcctgccgcggatccaccacgagggcaccttcatccccgggacgtacaagctcgtgatcgacaagaagaacaagcagaacgaccgctgcaccctgatcaccaactgcgtgatcaagggccgggagatccgcaagggccagtccgtcctgcggcagtaccgcaccgagatcaagatcgggaaggccagcagcggctcccggcgcctcctgagcgaggagtccggggacgactgcatcagccggacgcagctgtcccgcaccgagaccgcggagatccacagcgacaactacggcgggcccggcgacaagatcaccatctgcaacggctccacgatcgtggaccagcggctggggagcgagctcggctgctacaccatcaaccgcgtgaagtccttcaagctgtgcgagaacagcgccaccgggaagtcctgcgagatcgacagcacccccatcaagtgccgccagggcttctgcctgaagatcacgcaggaggggcggggccacgtcaagctctcccgcggcagcgaggtggtgctggacgcctgcgactccagctgcgagatcatgatcccgaaggggaccggcgacatcctggtcgactgctccgggggccagcagcacttcctcaaggacaacctgatcgacctgggctgccccaacatccccctcctggggaagatggccatctacatctgccggatgagcaaccaccccaagaccaccatggccttcctgttctggttctccttcggctacgtgatcacgtgcatcctctgcaaggtgatcttctacctgctgatcgtcgtggggaccctcggcaagaagttcaagcagtaccgcgagctgaagccgcagacctgcaccatctgcgagaccacgcccgtgaacgcgatcgacgccgagatgcacgacctgaactgcagctacaacatctgcccctactgcgccagccggctcacctccgacgggctggcccgccacgtcatgcagtgccccaagcggaaggagaaggtggaggagaccgagctgtacctcaacctggagcgcatcccgtgggtggtccggaagctgctccaggtgagcgagtccaccggcgtggccctgaagcgcagctcctggctggtcgtgctcctggtgctgctcacggtcagcctgtcccccgtgcagagcgcgcccatcggccacgggaagaccgtggagacctaccagacccgggagggctacacgtccatctgcctgttcgtcctcgggagcatcctgttcatcgtgtcctgcctgatgaagggcctcgtggacagcgtcgggaactccttcttccccggcagctccatctgcaagacctgcagcatcggctccatcaacgggttcgagatcgagagccacaagtgctactgctccctgttctgctgcccgtactgccgccactgcagcgccgaccgggagatccacaagctgcacctcagcatctgcaagaagcgcaagaccggctccaacgtgatgctggccgtgtgcaagcggatgtgcttccgcgccaccgtcgaggtgagcaacaaggcgctgctcatccggaacatcatcaacacgaccttcgtggtctgcatcctgatcctggccgtgtgcgtggtctccaccagcgccgtggagatggagtccctccccgccgggacctgggagcgcgaggaggacctgacgaacttctgccaccaggagtgccaggccaccgagaccgagtgcctgtgcccctacgaggcgctcgtgctgcggaagcccctgttcagcgactccatcgtcaagggcatgaagaacctcctgaacagcacctccctggagacgagcctctccatcgaggccccgtggggcgccatcaacgtgcagagcaccttcaagcccaccgtgtccgccgccaacatcgcgctgagctggtccagcgtcgagcaccgcgggaacaagatcctggtgtccggccgcagcgagtccatcatgaagctcgaggagcggaccgggatcagctgggacctgggcgtggaggacgccagcgagtccaagctgctcacggtcagcatcatggacctgtcccagatgtacagccccgtgttcgagtacctgtccggggaccgccaggtggaggagtggccgaaggcgacctgcaccggcgactgccccgagcggtgcgggtgcaccagctccacgtgcctccacaaggagtggccccacagccgcaactggcggtgcaaccccacctggtgctggggcgtcggcaccgggtgcacgtgctgcggcctggacgtgaaggacctgttcaccgaccacatgttcgtcaagtggaaggtggagtacatcaagaccgaggccatcgtgtgcgtcgagctcacctcccaggagcgccagtgcagcctgatcgaggccgggacccggttcaacctgggcccggtgacgatcaccctctccgagccccgcaacatccagcagaagctgccgcccgagatcgtgaccctgcacccccggatcgaggagggcttcttcgacctcatgcacgtcaagaaggtgctgagcgcctccaccgtgtgcaagctgcagagctgcacccacggggtccccggcgacctccaggtgtaccacatcgggaacctgctgaagggcgacaaggtgaacgggcacctcatccacaagatcgagccccacttcaacacgtcctggatgagctgggacggctgcgacctggactactactgcaacatgggcgactggccctcctgcagctacaccggggtcacccagcacaaccacgccgccttcgtgaacatgctgaacatcgagaccgactacacgaagatcttccacttccactccaagcgcgtgaccgcccacggcgacaccccgcagctcgacctgaaggcgcggcccacctacggggccggcgagatcacggtcctggtggaggtggccgacatggagctccacaccaagaagatcgagatcagcgggctgaagttcgccagcctgacctgcaccggctgctacgcctgctccagcggcatctcctgcaaggtccgcatccacgtggacgagcccgacgagctcacggtgcacgtcaagagcgaggaccccgacatcgtggcggcctccagctccctgatggcccggaagctggagttcgggaccgacagcaccttcaaggccttctccgccatgccgaagaccagcctctgcttctacatcgtggagcgcgagtactgcaagtcctgcagcaaggaggacacgcagaagtgcgtcaacaccaagctggagcagccccagtccatcctgatcgagcacaagggcaccatcatcgggaagcagaacgacacgtgcaccagcaaggcgggctgctggctcgagtccgtcaagagcttcttctacgggctgaagaacatgctgtccggcatcttcggcaacgtgttcatcgggatcttcctgttcctcgcccccttcatcctgctgatcctcttcttcatgttcggctggcggatcctgttctgcttcaagtgctgccgccggacccgcgggctgttcaagtaccggcacctcaaggacgacgaggagaccggctaccgcaagatcatcgagcggctgaacaacaagaagggcaagaacaagctgctcgacggggagcgcctggccgaccgcaagatcgccgagctgttcagcaccaagacgcacatcggctga

SEQ ID NO: 11936 - RNA, 5070 nt, synthetic construct
  misc_feature 1..5070: note = derived and/or modified CDS sequence (opt1) from CCHFV(SPU415/85)__DQ211635.1__GP
  source 1..5070: mol_type = other RNA
atgcccgtgaacatcatgtacaccccgctggtctgcgccgtgatctgcctccagctgtggaacctgggcgggaccctcgtgttcatcaaccgcacgcagcacaacgagaccggcaccgtcgccacccccgaggggacgctgcggccccgcctgcccgtgagcaccgcgctcccgaccaagtccgaccggcccagcgtgggccccgccgcctccagctccgggctggagggcagcggcgagcccaacacctccccgagcatcacgaccaaggggctgaccccccccgagaccacgcccgccctcccgaccgccaccgacaccgacgcgtccagcacgggcgtcgtggacgtgtccacccagatgaccaaggacatccccatgagcaccgcctacacgaaccccccctccaccccgagcgccccctccaccccccaggggacccaccacacggcccgcggcctgctgagcgtcgcgtccaccaagagcgaggaggtgtccatgagcaccagccccgccaagacctccacggagaccagctccccgccccccgccaccagcgagacccccacgccgtcccccaccacccaggtgcccaccgggaacaacaaccccaacacgagccggcagccgaccccctccgcccagcccgccatgagcaacccggcgacctcccccgcccagcccaacctcagccagtccgcccccccgaccgccgaccagggcgtccaccccagccccaccaaccgctccaagcggaacctggagatcgagatcatcctgacgctcagccagggcctgcgcaagtactacgggaagatcctgaagctcctggacctgaccctcgaggaggacaccgagggcctgctggagtggtgcaagcggaacctcgggctgacctgcgacgacaacttcttccagaagcgcatcgaggagttcttcctgacgggcgagggctacttcaacgaggtgctccagttcaaggtgccctccaccctgagctccaccgagccgacccacacgcggccccccaccgtcgagcccttcaagagctacttcgccaaggggttcctgtccatgaacagcggctacttcagcgcgaagtgctacccgcgcacctccaacagcgggctccagctgatcaacgtgaccaagcactccgccaagatcgccgacacgcccggccccaagatcaccaacctgaagaccatcaactgcatcaacctccgggccagcgtgttcaaggagcaccgcgaggtcgagatcaacgtgctgctgccccaggtggccgtcaacctctccaactgccacgcgcagatcaagagccacgtgtgcgactactccctggccaccgacgggatggtgcggctgccgcacatccaccacgagggcacgttcatccccggcacctacaagatcgtcatcgacaagaagaacaagcagaacgaccgctgcaccctcgtgaccaactgcgtcatcaaggggcgggaggtgcgcaagggccagagcgccctgcggcagtacaagacggagatccgcatcgggaaggcctccagcggctcccggcgcctgctcagcgaggagtccgacggggactgcatcagccgcacccagctgctgcggaccgagaccacggagatccactccgacaactacggcggccccggggacaagatcaccatctgcaacggcagcaccatcgtggaccagcgcctcgggtccgagctgggctgctacaccatcaaccgggtcaagagcttcaagctgtgcgagaacagcgccacggggaagtcctgcgagatcgacagcacccccgtgaagtgccgccagggcttctgcctcaagatcacccaggagggccgggggcacgtgaagctgtcccgcggcagcgagatcgtcctggacgcgtgcgactccaactgcgagatcatgatcccgaaggggaccggcgacatcctggtggactgcagcggcgggcagcagcacttcctcaaggacaacctgatcgacctgggctgccccaacatccccctcctggggaagatggccatctacatctgccggatgtccaaccaccccaagacgaccatggccttcctgttctggttcagcttcggctacgtgatcacctgcatcctctgcaaggtcatcttctacctgctgatcgtggccgggaccgtgggcaagaagttcaagcagtaccgcgagctccggccgcagacgtgcaccatctgcgagaccatccccgtcaacgcgatcgacgccgagatgcacgacctgaactgctcctacaacatctgcccctactgcgccagccgcctgacctccgacggcctcgcccggcacgtgatgcagtgcccgaagcgcaaggagaaggtggaggagaccgagctgtacctgaacctcgagcggatcccctgggtcgtgcgcaagctgctgcaggtgagcgagtccacgggggtcgccctcaagcggagctcctggctgaccgtgctgctcgtgctgctgatcgtcagcctctcccccgtgcagagcgcgcccatcggccacgggaagaccatcgagacctaccaggcccgcgagggctacacgtccttctgcctgttcatcctggggagcatcctcttcgtggtcagctgcctggtgaagggcctgatcgactccgtgggcaacagcttcttcccggggctctccatctgcaagacctgcagcatcggctccatcaacgggttcgagatcgagagccacaagtgctactgctccctgttctgctgcccctactgccggcactgcagcgccgaccgcgagatccacaagctgcacctctccatctgcaagaagcggaagaccggcagcaacgtcatgctggccgtgtgcaagcgcatgtgcttccgcgccaccatcgaggtgtccaaccgggcgctgctcatccgcaacatcatcaacacgaccttcgtcgtgtgcatcctgaccctggccgtgtgcgtcgtgagcacctccgccgtggagatggagagcctccccgccgggacgtgggagaaggaggaggacctgaccaacttctgccaccaggagtgccaggtcaccgagaccgagtgcctgtgcccctacgaggccctcgtgctgcggaagccgctgttcctcgactccatcgtgaagggcatgaagaacctgctgaacagcacgtccctcgagaccagcctgtccatcgaggcgccctggggcgccatcaacgtccagagcaccttcaagcccaccgtgagcgccgccaacatcgcgctgtcctggagctccgtggagcaccgcgggaacaagatcctcgtcagcggccggtccgagagcatcatgaagctggaggagcgcacggggatctcctgggacctgggcgtggaggacgccagcgagtccaagctcctgaccgtgagcgtcatggacctgtcccagatgtacagccccgtgttcgagtacctctccggggaccggcaggtggaggagtggccgaaggccacctgcaccggcgactgccccgagcgctgcggctgcacgagctccacctgcctgcacaaggagtggccccacagccggaactggcgctgcaaccccacctggtgctggggggtcggcaccgggtgcacgtgctgcggcctggacgtgaaggacctcttcaccgactacatgttcgtgaagtggaaggtcgagtacatcaagaccgaggccatcgtgtgcgtcgagctgacctcccaggagcggcagtgcagcctgatcgaggccggcacgcgcttcaacctcgggccggtgaccatcaccctgtccgagccccggaacatccagcagaagctgccccccgagatcatcaccctccacccgcgcatcgaggagggcttcttcgacctgatgcacgtgcagcgggtcctgagcgcgagcacggtgtgcaagctccagtcctgcacccacggggtgcccggcgacctgcaggtctaccacatcgggaacctgctcaagggcgacaaggtgaacggccacctgatccacaagatcgagccccacttcaacaccagctggatgtcctgggacgggtgcgacctggactactactgcaacatgggcgactggcccagctgcacctacaccggggtgacgcagcacaaccacgccgccttcgtcaacctcctgaacatcgagaccgactacaccaagaacttccacttccactccaagcgcgtgaccgcccacggcgacacgccgcagctggacctcaaggcccggcccacctacggggcgggcgaggtgaccgtcctggtggaggtggccgacatggagctgcacaccaagaagatcgagatcagcggcctcaagttcgcctccctgacgtgcaccgggtgctacgcctgcagctccggcatcagctgcaaggtcaagatccacgtggacgagcccgacgagctgaccgtgcacgtcaagtccgaggaccccgacatcgtggccgcggggagctccctcatggcccgcaagctggagttcggcgccgacagcaccttcaaggccttctccgcgatgccgaagacgagcctgtgcttctacatcgtggagcgggagtactgcaagtcctgcagccgcgaggacacccggaagtgcgtcaacaccaagctcgaccgcccccagtccatcctgatcgagcacaaggggaccatcatcggcaagcagaacaacacgtgcaccgccaaggccagctgctggctggagagcgtgaagtccttcttctacggcctcaagaacatgctgagcgggatcttcggcaacgtgttcatcgggatcttcctgttcatcgcccccttcgtcctcctgatcctgttcttcatgttcggctggcgcatcctgttctgcttcaagtgctgccggcgcacccggggcctcttcaagtaccgccacctgaaggacgacgaggagaccgggtaccggaagatcatcgagcgcctgaacaacaagaagggcaagaacaagctcctggacggggagcggctggccgaccgcaagatcgcggagctcttctccacgaagagccacatcggctga

SEQ ID NO: 11937 - RNA, 5070 nt, synthetic construct
  misc_feature 1..5070: note = derived and/or modified CDS sequence (opt1) from CCHFV(SPU97/85)__DQ211633.1__GP
  source 1..5070: mol_type = other RNA
atgaccgtgaacaccgtctgcacgcccctcgtgtgcgccgtgttctgcctccagctgtggaacctgggcgggaccctcgtcccgaccaaccgcacccagcacaacaagacgggcaccatggccacccccgaggggaccctgggcccccggctgcccgtgagcacggcgctcccgaccaagtccgaccgccccagcgtggggcccgccgccccctccagcggcctggagggctccggggagccgaacaccagcccctccatcaccacgaagggcctggccctccccgagaccacccccgccccgcccaccgcgacggacaccgacgccagctccaccggggtcgtgaacgtgagcacccagatgacgaaggacatccccatgtccaccgcctacaccaacccgcccagcaccccctccgcccccagcacgccccagggcacccaccacaccgcgcgggggctgctgtccgtcgccagcaccaagtccgaggaggtgagcatgtccacgagcccgggcaagaccagcaccgagacctccagcccgccgcccgccacgtccgagacccccgcccccagccccaccacccaggcccccacgggcaacaacaaccccaacacctcccgccagcccacccccagcgcgcagccggccatgtccaaccccaccaccagccccgcccagcccaacctcctgcagaacgccccgcccacggccgaccagggggtgcaccccggccccaccaaccggtccaagcgcaacctggagatggagatcatcctcaccctgagccaggggctgcggaagtactacggcaagatcctcaagttcctggacctgaccctcgaggaggacacggagggcctgctggagtggtgcaagcgcaacctcgggctgacctgcgacgacaacttcttccagaagcggatcgaggagttcttcctgaccggcgaggggtacttcaacgaggtcctccagttcaaggtgccgtccaccctgagctccacggagcccacccacaccggcagccccaccgtggagcccttcaagtcctacttcgcgaaggggttcctgagcatgaactccggctacttcagcgccaagtgctacccgcgcacgtccaacagcggcctccagctgatcaacgtcaccaagcacagcgccaagatcgccgacacccccgggcccaagatcaccaacctgaagacgatcaactgcatcaacctccgggcctccgtgttcaaggagcaccgcgaggtggagatcaacgtcctgctgccccaggtggcggtgaacctcagcaactgccacgcccagatcaagtcccacgtctgcgactacagcctggccaccgacggcatggtgcggctgccgcgcatccaccacgaggggaccttcatccccggcacctacaagatcgtgatcgacaagaagaacaagcagaacgaccggtgcacgctcgtcaccaactgcgtgatcaaggggcgcgaggtccggaagggccagtccgccctgcgccagtacaagaccgagatccggatcggcaaggccagctccgggagccgccggctgctctccgaggagagcgacggcgactgcatctcccgcacccagctgctgcgcacggagaccgcggagatccacagcgacaactacgggggccccggggacaagatcaccatctgcaacggctccaccatcgtggaccagcggctcggcagcgagctggggtgctacacgatcaaccgcgtgaagtccttcaagctgtgcgagaacagcgccaccggcaagtcctgcgagatcgacagcacccccgtcaagtgccggcaggggttctgcctcaagatcacccaggagggccgcggccacgtgaagctgagccgggggtccgagatcgtgctggacgcctgcgacagctcctgcgagatcatgatcccgaagggcacgggggacatcctggtcgactgcagcggcgggcagcagcacttcctcaaggacaacctgatcgacctgggctgccccaacatccccctcctgggccgcatggccatctacatctgccggatgtccaaccaccccaagaccaccatggcgttcctgttctggttcagcttcgggtacgtgatcacgtgcatcctctgcaaggtgatcttctacctgctgatcgtcgccggcaccgtggggaagaagttcaagcagtaccgcgagctccggccgcagacctgcaccatctgcgagaccacccccgtgaacgccatcgacgccgagatgcacgacctgaactgctcctacaacatctgcccctactgcgccagccgcctgacgtccgacggcctcgcgcggcacgtcatgcagtgcccgaagcgcaaggagaagatcgaggagaccgagctgtacctgaacctcgagcggatcccctgggtggtgcgcaagctgctgcaggtcagcgagtccaccggggtggccctcaagcggagctcctggctgaccgtgctgctcgtcctgctgatcgtgagcctctcccccgtgcagagcgcccccatcggccacggcaagacgatcgagacctaccaggcccgcgaggggtacacctccttctgcctgttcatcctgggcagcatcctcttcatcgtctcctgcctggtgaaggggctgatcgacagcgtgggcaacagcttcttcccggggctctccatctgcaagacctgcagcatcggctccgtcaacggcttcgagatcgagagccacaagtgctactgctccctgttctgctgcccctactgccggcactgcagcgccgaccgcgagatccacaagctgcacctctccatctgcaagaagcggaagacggggagcaacgtgatgctggcggtgtgcaagcgcatgtgcttccgcgccaccatcgaggtctccaaccgggccctgctcatccgcagcatcatcaacaccaccttcgccgtgtgcatcctgacgctggccgtgtgcgtcgtgtccaccagcgcggtggagatggagtccctccccgccggcacctgggagcgggaggaggacctgaccaacttctgccaccaggagtgccaggtcacggagaccgagtgcctgtgcccctacgaggccctcgtgctgcgcaagccgctgttcctcgacagcatcgtgaaggggaagaagaacctgctgaactccaccagcctcgagacctccctgagcatcgaggccccctggggcgcgatcaacgtccagtccacgttcaagcccaccgtgagcgccgccaacatcgccctgagctggtccagcgtggagcaccgggggaacaagatcctcgtctccggccgcagcgagtccatcatgaagctggaggagcggaccggcatcagctgggacctgggggtggaggacgcctccgagagcaagctcctgaccgtgtccgtcatggacctgagccagatgtactcccccgtgttcgagtacctcagcggcgaccgccaggtggaggagtggccgaaggcgacgtgcaccggggactgccccgagcggtgcggctgcacctccagcacgtgcctgcacaaggagtggccccactcccgcaactggcggtgcaaccccacctggtgctggggcgtcgggaccggctgcacgtgctgcgggctggacgtgaaggacctcttcaccgactacatgttcgtgaagtggaaggtcgagtacatcaagaccgaggccatcgtgtgcgtggagctgaccagccaggagcgccagtgctccctgatcgaggccggcacccggttcaacctcgggccggtcaccatcacgctgagcgagccccgcaacatccagcagaagctgccgcccgagatcatcaccctccacccccggatcgaggagggcttcttcgacctgatgcacgtgcagaaggtcctgtccgccagcaccgtgtgcaagctccagagctgcacccacggcgtgcccggggacctgcaggtctaccacatcggcaacctgctcaagggggacaaggtgaacggccacctgatccacaagatcgagccccacttcaacacctcctggatgagctgggacgggtgcgacctggactactactgcaacatgggcgactggccctcctgcacgtacaccggcgtgacccagcacaaccacgccgcgttcgtcaacctcctgaacatcgagaccgactacacgaagaacttccacttccacagcaagcgcgtgaccgcccacggggacaccccgcagctggacctcaaggcccggcccacctacggcgccggggaggtgacggtcctggtggaggtggccgacatggagctgcacaccaagaagatcgagatctccggcctcaagttcgcgagcctgtcctgcaccgggtgctacgcctgcagctccggcatcagctgcaaggtccgcatccacgtggacgagcccgacgagctgaccgtgcacgtcaagtccgaggaccccgacatcgtggccgccggcagctccctcatggcgcggaagctggagttcggggccgacagcacgttcaaggccttctccgccatgccgaagaccagcctgtgcttctacatcgtggagcgcgagtactgcaagtcctgcagccgggaggacacccagaagtgcgtcaacaccaagctcgagcgcccccagtccatcctgatcgagcacaagggcacgatcatcgggaagcagaacgacacgtgcaccgccaaggcgagctgctggctggagagcgtgaagtccttcttctacggcctcaagagcatgctgtccggcatcttcgggaacgtgttcatcggcatcttcctgttcatcgcccccttcgtcctcctgatcctgttcttcatgttcgggtggcgcatcctgttctgcttcaagtgctgccggcgcacccggggcctcttcaagtaccgccacctgaaggacgacgaggagaccgggtaccggaagatcatcgagcgcctgaacaacaagaagggcaagaacaagctcctggacggcgagcggctggccgaccgcaagatcgccgagctgttcagcaccaagtcccacatcgggtga

SEQ ID NO: 11938 - RNA, 5070 nt, synthetic construct
  misc_feature 1..5070: note = derived and/or modified CDS sequence (opt1) from CCHFV(C-68031)__DQ211629.1__GP
  source 1..5070: mol_type = other RNA
atgagcttctccatcatgtacacgcccctgctctgcgccgtgctgtgcctgcagctctggagcctggagggctcccacgggctgagcaacaagacccagcactccaacaccagcaccaccaaggccccggaggtctcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtcagcacccagacggtgaaggacacccccatctccaccacccacacgagcctcccctccaccccgagcgcccccaccacgccccagggcacccaccacaccgcccgcgggctgctgtccgtgaccagcaccaagcccgagggcgcctccacgcaggcgaacccggagaagatcagcatggagaccaacagcccccggctcgccatctccgagaccccctccttcagccccaccacgcaggccccgaccgagaactccaaccccatcaccagcaagcagctgatcctgtccgcccagcccgtcacccccaacccggtgaccccgcccgtgcagcccgcgctcagccagtccgacacgagcaccgccatccaggacatccacccctcccccaccagccgcagcaagcggaacctggagatggagatcatcctgaccctctcccaggggctgaagaagtactacggcaagatcctgaagctcctggacctgacgctcgaggaggacaccgaggggctgctggagtggtgcaagcgcaacctcggcctggtctgcgacgacgacttcttccagaagcggatcgaggagttcttcctgaccggcgaggggcacttcaacgaggtgctccagttcaagacccccagcacgctgtcccccaccggcccggcccgcaccgggagccccaccgtggagcccttcaagtcctacttcgccaagggcttcctgagcatggactccggctacttcagcgccaagtgctacccgcgggcgtccaacagcgggctccagctgatcaacgtcacgcagcactccacccgcatcaccgacacccccggccccaaggtgacgaacctgaagaccatcaactgcatcaacctcaaggccagcgtgttcaaggagcaccgggagatcgagatcaacgtcctgctgccccaggtggccgtgaacctctccagctgccacgtcctgatcaagtcccacgtgtgcgactacagcctggacatcgacgggccggtccgcctcccccggatccaccacgagggcaccttcatccccgggacctacaagctggtgatcgacaagaagaacaagcagaacgaccgctgcacgctgatcaccaactgcgtgatcaagggccgggagatccgcaagggccagtccgtcctccggcagtaccgcaccgagatcaagatcgggaaggccagcagcggctcccggcgcctgctgagcgaggagtccggggacgactgcatcagccggacccagctgtcccgcacggagaccgccgagatccacagcgacaactacggcgggcccggcgacaagatcaccatctgcaacggctccaccatcgtggaccagcggctcgggagcgagctgggctgctacacgatcaaccgcgtgaagtccttcaagctgtgcgagaacagcgcgaccgggaagtcctgcgagatcgacagcaccccgatcaagtgccgccagggcttctgcctcaagatcacccaggaggggcggggccacgtcaagctgtcccgcggcagcgaggtggtgctggacgcctgcgactccagctgcgagatcatgatccccaaggggacgggcgacatcctcgtcgactgctccgggggccagcagcacttcctgaaggacaacctgatcgacctcggctgccccaacatccccctgctggggaagatggccatctacatctgccggatgagcaaccacccgaagaccaccatggccttcctcttctggttctccttcggctacgtgatcacgtgcatcctgtgcaaggtgatcttctacctgctcatcgtcgtggggaccctgggcaagaagttcaagcagtaccgcgagctgaagccccagacctgcaccatctgcgagaccacccccgtgaacgccatcgacgcggagatgcacgacctcaactgcagctacaacatctgcccctactgcgccagccggctgacgtccgacgggctggcccgccacgtcatgcagtgcccgaagcggaaggagaaggtggaggagaccgagctctacctgaacctggagcgcatcccctgggtggtccggaagctcctccaggtgagcgagtccaccggcgtggccctgaagcgcagctcctggctcgtcgtgctgctggtgctcctgaccgtcagcctgtcccccgtgcagagcgcccccatcggccacgggaagacggtggagacctaccagacccgggagggctacacctccatctgcctcttcgtcctggggagcatcctgttcatcgtgtcctgcctcatgaagggcctggtggacagcgtcgggaactccttcttcccgggcctgagcatctgcaagacgtgctccatcggcagcatcaacgggttcgagaccgagtcccacaagtgctactgcagcctcttctgctgcccctactgccgccactgctccgcggaccgggagatccacaagctgcacctgagcatctgcaagaagcgcaagaccggcagcaacgtgatgctcgccgtgtgcaagcggatgtgcttccgcgccaccgtcgaggtgtccaacaaggccctgctgatccggaacatcatcaacacgaccttcgtggtctgcatcctcatcctggcggtgtgcgtggtcagcacctccgccgtggagatggagagcctgcccgccgggacctgggagcgcgaggaggacctcacgaacttctgccaccaggagtgccaggtgaccgagaccgagtgcctgtgcccctacgaggccctggtcctccggaagccgctgttctccgacagcatcgtgaagggcatgaagaacctgctcaactccaccagcctggagacgtccctgagcatcgaggccccctggggcgcgatcaacgtgcagtccaccttcaagcccaccgtcagcgccgccaacatcgccctctcctggagctccgtggagcaccgcgggaacaagatcctggtgagcggccgctccgagagcatcatgaagctggaggagcggaccgggatctcctgggacctcggcgtcgaggacgccagcgagagcaagctgctgacggtgtccatcatggacctcagccagatgtactccccggtgttcgagtacctgagcggggaccgccaggtcgaggagtggcccaaggcgacctgcaccggcgactgccccgagcggtgcgggtgcacctccagcacgtgcctgcacaaggagtggccccactcccgcaactggcggtgcaacccgacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgaccagccaggagcgccagtgctccctcatcgaggccgggacccggttcaacctgggccccgtgacgatcaccctgagcgagccccgcaacatccagcagaagctgcccccggagatcgtcaccctgcacccccggatcgaggagggcttcttcgacctgatgcacgtgaagaaggtgctctccgccagcaccgtctgcaagctgcagtcctgcacccacggggtgcccggcgacctccaggtgtaccacatcgggaacctgctgaagggcgacaaggtcaacgggcacctgatccacaagatcgagccccacttcaacacgagctggatgtcctgggacggctgcgacctcgactactactgcaacatgggcgactggccgagctgctcctacaccggggtgacccagcacaaccacgccgcgttcgtgaacatgctgaacatcgagaccgactacacgaagatcttccacttccacagcaagcgcgtcaccgcccacggcgacacgccccagctggacctcaaggcccggcccacctacggggccggcgagatcaccgtgctggtggaggtcgcggacatggagctgcacaccaagaagatcgagatctccgggctcaagttcgccagcctgacctgcaccggctgctacgcctgcagctccggcatcagctgcaaggtgcgcatccacgtggacgagcccgacgagctgacggtccacgtgaagtccgaggacccggacatcgtggccgccagctccagcctcatggcgcggaagctggagttcgggaccgactccaccttcaaggccttcagcgccatgcccaagacctccctgtgcttctacatcgtcgagcgcgagtactgcaagagctgctccaaggaggacacgcagaagtgcgtgaacaccaagctcgagcagccccagagcatcctgatcgagcacaagggcaccatcatcgggaagcagaacgacacgtgcacctccaaggccggctgctggctggagagcgtgaagtccttcttctacgggctgaagaacatgctcagcggcatcttcggcaacgtcttcatcgggatcttcctgttcctggcccccttcatcctcctgatcctgttcttcatgttcggctggcggatcctcttctgcttcaagtgctgccgccggacccgcgggctgttcaagtaccggcacctgaaggacgacgaggagaccggctaccgcaagatcatcgagcggctcaacaacaagaagggcaagaacaagctgctggacggggagcgcctcgcggaccgcaagatcgccgagctgttctccaccaagacgcacatcggctga

SEQ ID NO: 11939 - RNA, 5070 nt, synthetic construct
  misc_feature 1..5070: note = derived and/or modified CDS sequence (opt1) from CCHFV(Baghdad 12)__AJ538197.2__GP
  source 1..5070: mol_type = other RNA
atgcccgtgagcatcatgcacatctccctgatctacgccgtcctctgcctgcagctgtacggcctcggggagacccacggcagctccagcgggaccgagcacaaccgcacgaacgtggtggccaccccgggcgggtcccagagccccgagcccctggtctccaccaccctgcccgtgacgctcgacagctccaccgtgaccccggcgacccaggccagcggccccgagggctccggggaggtctacacgagcccccccaccaccaccgagggcctgtccccgagcgacgccacgtccgagctgcccaccaccaccgggatcggcatcagctccagctccgacgtgaacagcagcacgcaggccgccggggacacctccacccccaccgcgcggacgagcctccccgactccccgagcaccccccccacctcccaggacacccaccaccccatgcgcaacctgctgagcgtgacgtccctcaagccggaggagacccccgcccccagcaagtccggcaaggagagccccgccgcctccagcccgcaccccgtcgcgtcccggccccccaccccgagcaccacggcccagggccccaccgagaacaactcccgcaacaccaccgtgcagctgaagagcgtgacgcagtccgccaccctggggcccatggccagccccacccagaccgtcctcctgcagtccgtgacgagcatcgccatccaggacacccacccgagccccaccaaccggtcccgccggaacctggagatggagatcatcctcaccctgccccagggcctgaagaagtactacgggaaggtgctccgcctgctgcagctcaccctggaggaggacacggagggcctgctcgagtggtgcaagcggaacctgggcctggactgcgacgacaccttcttccagaagcgcatcgaggagttcttcatcaccggggagggccacttcaacgaggtcctccagttccggaccccggggacgctgagcaccaccgagtccacccacgcgggcagccccacggtggagcccttcaagtcctacttcgccaaggggttcctgctcatcgacagcggctacttctccgccaagtgctacagccgcacctccaacagcggcctgcagctgatcaacgtgacccggcactccaccaagatcgccgacacgcccgggccgaagatcaccaacctcaagaccatcagctgcatcaacctgaaggcctccatcttcaaggagcaccgcgagatcgagatcaacgtcctgctcccccaggtggcggtgaacctgagcaactgccacgtcaccatcaagtcccacgtgtgcgactacagcctgaacatcgacggcacggtgaagctcccccacatccaccacgaggggatcttcatccccggcacctacaagatcgtcatcgacaagaagaacaagctgaacgaccggtgcaccctgttcaccaactgcgtgatcaaggggcgcgaggtccggaagggccagtccgtgctccgccagtacaagacggagatccggatcggcaaggccagcaccgggagccgccggctgctgtccgaggagagcggcgacgactgcatctcccgcacccgcctcctgcggaccgagacggccgagatccacggggacagctacggcgggccgggcgacaagatcaccatctgcaacggctccaccatcgtggaccagcgcctggggagcgagatgggctgctacaccatcaaccgggtcaagtccttcaagctgtgcgagaacagcgccacggggaagtcctgcaagatcgacagcatccccgtgaagtgccgccagggctactgcctcaagatcacccaggagggccgggggcacgtgaagctgtcccgcggcagcgaggtcgtgctggacgcctgcgactccagctgcgaggtgatgatccccaaggggaccggcgacatcctcgtcgactgctccgggggccagcagcacttcctgaaggacaacctgatcgacctcggctgccccaacatcccgctgctggggaagatggcgatctacatctgccggatgagcaaccaccccaagaccacgatggccttcctcttctggttctccttcggctacgtgatcacctgcatcctgtgcaaggccatcttctacctgctcatcatcgtggggaccctgggcaagcgcttcaagcagtaccgggagctgaagccccagacctgcacgatctgcgagaccacccccgtcaacgccatcgacgccgagatgcacgacctcaactgcagctacaacatctgcccgtactgcgcgtcccgcctgaccagcgacgggctggcccggcacgtgacccagtgccccaagcgcaaggagaaggtggaggagacggagctctacctgaacctggagcggatcccctgggtcgtgcgcaagctcctgcaggtgagcgagtccaccggcgtcgccctgaagcggagctcctggctcatcgtgctgctggtgctcctggccgtcagctccagccccgtgcagtccgcgccgatcggctacgggaagaccatcgagacctaccaggcccgcgagggctacacgagcatctgcctgttcgtgctcgggtccatcctgttcatcgtcagctgcctgaccaagggcctcgtggactccatcgggaacatcttcttccccggcctgagcatctgcaagacctgctccatcggcagcatcaacgggttcgaggtggagtcccacaagtgctactgcagcctgctctgctgcccctactgccggcactgctccgccgaccgcgagatccaccagctgcacctgagcatctgcaagaagcggaagaccggctccagcgtcatgctcgccgtgtgcaagcgcatgtgcttccgcgccacgatggaggtgagcaacaaggcgctgctgatccggtccatcatcaacaccaccttcgtcgtgtgcatcctcaccctggccgtgtgcgtcgtgagcacgtccgccgtggagatggagagcctgcccgccgggacctgggagcgcgaggaggacctcaccaacttctgccaccaggagtgccaggtcaccgagacggagtgcctgtgcccgtacgaggccctggtgctccggaagcccctgttcctggactccatcgtgaagggcaccaagaacctcctgaacagcacctccctggagaccagcctctccatcgaggcgccctggggggccatcaacgtccagagcacgtacaagccgaccgtgtccaccgccaacatcgccctgagctggtccagcgtggagcaccgcggcaacaagatcctggtctccggccggagcgagtccatcatgaagctcgaggagcgcaccgggatcagctgggacctgggcgtggaggacgcctccgagagcaagctgctcacggtgagcgtcatggacctgtcccagatgtacagccccgtgttcgagtacctgtccggggaccggcaggtggaggagtggcccaaggcgacctgcaccggcgactgccccgagcgctgcggctgcaccacgagcacctgcctccacaaggagtggccgcactcccggaactggcgctgcaaccccacctggtgctggggggtcggcaccgggtgcacgtgctgcggcctggacgtgaaggacctgttcaccgactacatgttcgtgaagtggaaggtcgagtacatcaagaccgacgccatcgtgtgcgtcgagctcaccagccaggagcggcagtgctccctgatcgaggccgggacgcgcttcaacctgggcagcgtgaccatcaccctctccgagccccggaacatccagcagaagctgcccccggagatcatcaccctgcacccccgcatcgaggagggcttcttcgacctcatgcacgtgcagaaggtcctgagcgcctccaccgtgtgcaagctgcagagctgcacgcacggggtgcccggcgacctccaggtctaccacatcgggaacctgctgaagggcgacaaggtgaacgggcacctcatccacaagatcgagccccacttcaacacctcctggatgagctgggacggctgcgacctggactactactgcaacatgggcgactggccgtcctgcacctacaccggggtgacgcagcacaaccacgcgagcttcgtcaacctgctcaacatcgagaccgactacaccaagtccttccacttccacagcaagcgggtgaccgcccacggcgacacgccccagctggacctgaaggtgcgccccacctacggggccggcgagatcaccgtcctcgtggaggtggccgacatggagctgcacaccaagaagatcgagatctccgggctgaagttcgccagcctcacgtgcaccggctgctacgcgtgcagctccggcatcagctgcaaggtccggatccacgtggacgagcccgacgagctgaccgtgcacgtcaagtccgacgacccggacgtggtggccgccagctccagcctgatggcccgcaagctcgagttcgggaccgactccacgttcaaggccttcagcgcgatgcccaagacctccctgtgcttctacatcgtcgagcgggagtactgcaagagctgctccaaggaggacacccagaagtgcgtgaacaccaagctggagcagccccagagcatcctcatcgagcacaagggcacgatcatcgggaagcagaacaacacctgcaccgccaagacctcctgctggctggagagcgtgaagtccttcttctacggcctgaagaacatgctgagcggcatcttcgggaacttcttcatgggcatcttcctcttcctggcccccttcatcctgctcatcctgttcttcatgttcgggtggcgcatcctgttctgcttcaagtgctgccggcgcacgcgcggcctcttcaagtaccggcacctgaaggacgacgaggagaccgggtaccgccggatcatcgagcgcctgaacaacaagaagggcaagaacaagctcctggacggcgagcggctggccgaccgccggatcgccgagctcttctccaccaagacccacatcgggtga

SEQ ID NO: 11940 - RNA, 5070 nt, synthetic construct
  misc_feature 1..5070: note = derived and/or modified CDS sequence (opt1) from CCHFV(Hodzha)__AY223476.1__GP
  source 1..5070: mol_type = other RNA
atgcccgtgagcatcatgcacatcctgctcatgtgcgccgtcctgtgcctgcagcagtacggcctcggggagacccaccgcccgaacaacggcaccgagcacaacaagacgaacgtgctgaccacccccggggacaagctgtcccccgagctccccgtgagcaccgccctgtccgtcacgccggacagctccaccgtgacccccaccacgcccgtgagcggcctggaggggtccggcgacgtctacaccagcccgcccgtgaccaccaagggcctctcccccagcaaggcgacgtccgagctgcccgccagctccgggatcgacaccagctccgccagcgacgtggactccagcacccaggccgcccgggacacctccacgctgaccgtccgcaccagcccgcccagctcccccagcaccccgcccacgtcccaggacacctaccacctcgtgcggaacctgctgagcgtgacctccccctggcccgaggagaccacggcgcccagcaagtccggcaaggagagccccgtcgccaactccccgcaccccgtgaccagccgcccctccagcccgcccatcaccgtgcaggggcccaccgagaactccagccacaacacgaccggccagctcgagtccatggcccagagcaccaccctggtccccatggcctcccccacgcagaccgtgctgagccagtccgtgaccagcctcgcggtccaggacgcccacccgagccccaccaaccggtccaagcgcaacctggagatggtgatcatcctgacgctcccccaggggctgaagaagtactacggcaaggtgctgcggctcctgcagctgaccctcgaggaggacaccgagggcctgctggagtggtgcaagcgcaacctcgggctggactgcgacgacaccttcttccagaagcggatcgaggagttcttcatcaccggcgaggggcacttcaacgaggtcctgcagttcaagacgccgagcaccctctccaccaccgagagcacgcacgccgtgtcccccaccgccgagcccttcaagagctacttcgccaagggcttcctgtccatcgacagcggctacttctccgcgaagtgctacagcaagacctccaacagcgggctgcagctcatcaacgtgacccgccactccacgcggatcgccgacacccccggcccgaagatcaccaacctgaagaccatcagctgcatcaacctgaaggcctccgtcttcaaggagcaccgcgaggtggagatcaacgtcctcctgccccaggtggccgtgaacctgagcaactgccacgtcacgatcaagtcccacgtgtgcgactacagcctcgacgtggacgggaccgtccggctgccccacatccaccacggcgggaccttcatccccggcacctacaagatcgtgatcgacaagaagaacaagctgaacgaccgctgcacgctctacaccaactgcgtgatcaagggccgggaggtccgcaaggggcagagcatcctgcggcagtacaagaccgagatccgcatcggcaaggcctccaccgggagccggcgcctgctctccgaggagagcggcgacgactgcatctcccggacgcagctgctgcgcaccgagaccgcggagatccacggggacgactacggcggcccgggggacaagatcaccatctgcaacggcagcacgatcgtggaccagcgcctggggtccgagctcggctgctacaccatcaaccgggtcaagagcttcaagctgtgcaagaactccgccaccggcaagagctgcgagatcgactccacccccgtgaagtgccgccaggggtactgcctgaagatcacgcaggagggccgggggcacgtgaagctcagccgcggctccgaggtggtcctggacgcctgcgacagctcctgcgaggtgatgatccccaaggggaccggcgacatcctggtggactgcagcggcgggcagcagcacttcctcaaggacaacctgatcgacctgggctgcccccggatcccgctcctggggaagatggccatctacatctgccgcatgtccaaccaccccaagaccaccatggccttcctgttctggttcagcttcggctacgtcatcacgtgcatcctctgcaaggcgatcttctacctgctgatcatcgtggggaccctcggcaagcggttcaagcagtaccgcgagctgaagccccagacctgcaccatctgcgagacgacccccgccaacgccatcgacgccgagatgcacgacctgaactgctcctacaacatctgcccgtactgcgccagccggctcaccagcgacggcctggcgcgccacgtgacccagtgccccaagcggaaggagaaggtcgaggagaccgagctgtacctcaacctggagcgcatcccctggatcgtgcggaagctgctccaggtgtccgagagcacgggggtcgccctgaagcgctccagctggctgatcgtgctcctggtgctgttcgccgtctccctcagccccgtgcagtccgccccgatcggccacgggaagaccatcgagacctaccaggcgcgggaggactacaccagcatctgcctgttcgtgctgggctccatcctcttcatcgtcagctgcctgatgaaggggctggtggactccatcggcaacatcttcttccccggcctcacgatctgcaagacctgcagcatcgggtccatcaacggcttcgagatcgagagccacaagtgctactgctccctgctgtgctgcccctactgccgccactgcagcgccgaccgggagatccaccagctccacctgtccatctgcaagaagcgcaagaccgggagcaacgtgatgctggccgtctgcaagcggatgtgcttccgcgccaccatggaggtgtccaacaaggccctcctgatccgcagcatcatcaacacgaccttcgtggtctgcatcctgatcctcgcggtgtgcgtggtcagcacctccgccgtggagatggagagcctgcccgccggcacctgggagcgggaggaggacctgacgaacttctgccaccaggagtgccaggtgaccgagaccgagtgcctctgcccgtacgaggccctggtcctgcgccggcccctcttcctggactccatcgtgaaggggaccaagaacctgctcaacagcacgtccctggagaccagcctgtccatcgaggccccctggggcgcgatcaacgtgcagagcacctacaagccgaccgtctccacggccaacatcgccctcagctggtccagcgtggagcaccgcggcaacaagatcctggtgtccgggcggagcgagtccatcatgaagctggaggagcgcaccggcatcagctgggacctcggggtcgaggacgcctccgagagcaagctgctgaccgtgtccgtgatggacctcagccagatgtacagccccgtcttcgagtacctgtccggcgaccgccaggtggaggagtggcccaaggcgacctgcacgggggactgccccgagcggtgcggctgcaccagcagcacgtgcctgcacaaggagtggccgcactcccggaactggcgctgcaaccccacctggtgctggggcgtcgggaccggctgcacgtgctgcgggctcgacgtgaaggacctgttcaccgactacatgttcgtgaagtggaaggtcgactacatcaagaccgaggccatcgtgtgcgtggagctgacctcccaggagcggcagtgcagcctcgtcgaggccggcacccgcttcaacctgggccccgtgaccatcaccctgtccgagccccggaacatccagcagaagctcccgcccgagatcatcacgctgcacccccgcatcgaggaggggttcttcgacctgatgcacgtgcagaaggtcctcagcgcctccaccgtgtgcaagctgcagagctgcacccacggcgtgcccggggacctgcaggtctaccacatcggcaacctcctgaagggggacaaggtgaacggccacctgatccacaagatcgagccgcacttcaacacctcctggatgagctgggacggctgcgacctcgactactactgcaacatgggggactggccctcctgcacctacacgggcgtgacccagcacaaccacgccagcttcgtcaacctgctgaacatcgagaccgactacaccaagtccttccacttccacagcaagcgggtgacggcgcacggggacacgccccagctcgacctgaaggcccgccccacctacggcgccggggagatcaccgtgctggtcgaggtggccgacatggagctccacaccaagaagatcgagatcaccggcctgaagttcgcctccctgacctgcaccggctgctacgcgtgcagctccgggatcagctgcaaggtgcggatccacgtcgacgagccggacgagctcacggtgcacgtcaagagcgacgaccccgacgtggtggccgcctccagctccctgatggcccgcaagctggagttcggcaccgacagcaccttcaaggccttctccgcgatgcccaagaccagcctctgcttctacatcgtggagcgggagtactgcaagtcctgcagcaaggaggacacgcagaagtgcgtcaacaccaagctggagcagccccagtccatcctgatcgagcgcaaggggaccatcatcggcaagcagaacaacacgtgcaccgccaaggccagctgctggctggagtccgtcaagagcttcttctacgggctcaagaacatgctgtccggcatcttcggcaacgtgttcgtggggatcttcctgttcctcgccccgttcatcctgctgatcctcttcttcatgttcggctggcggatcctgttctgcttcaagtgctgccgccgcacccgggggctgttcaagtacaagcacctcaaggacgacgaggagaccggctaccgccggatcatcgagcgcctgaacaacaagaagggcaagaacaagctgctcgacggggagcggctggccgaccgccggatcgcggagctgttcagcaccaagacgcacatcggctga

SEQ ID NO: 11941 - RNA, 5067 nt, synthetic construct
  misc_feature 1..5067: note = derived and/or modified CDS sequence (opt1) from CCHFV(Kosovo/9553/2001)__AY675511.1__GP
  source 1..5067: mol_type = other RNA
atgcccatcaacatcatgcacaccctgctcgtgtgcttcatcctgtacctgcagctcctgggcctggggggcgcccacgggcagagcaacgccaccgagcacaacggcacgaacaccaccaccgcgccggggacgtcccagagccccaagccccccgcctccaccaccccgagccacgcccccgagtccagcaccatcaagctcacgacccccacctccgagaccgagggcagcggcgagacgacccccccgacctccaccacgcaggggagcccccccctggagaccacccccgagcgctccaccacgaccgccaccagcacctccggcacggacaacatgaacagcaccacccagatgaccgacaacacgccgaccctgaccgcctccaccagcccctccagctcccccagcacgcccagcacctcccaggggctccactacccggtccggagcctgctgtccgtgagctcccccaagaccgtgaccacgcccacccccatgagcccgggcgagatgtccagcgagacctccagccagcactccgcgatgagccgcacccccaccccccacacggccacccaggtctccaccgagaacgccaaccggagcacctcccgccagagcgagtccagcgcccagcccgcgacgcagtccccggtgaccagccccgcccagagcatcctcctgatgtccgccacccccaccacgatccagaacatccaccccagcccgaccaaccggtccaagcgcaacctggagatggagatcatcctcaccctgagccaggggctgaagaagtactacggcaagatcctcaagctgctgcacctcaccctggaggaggacacggagggcctgctcgagtggtgcaagcggaacctggggtccaactgcgacgacgacttcttccagaagcgcatcgaggagttcttcatcaccggcgaggggtacttcaacgaggtgctgcagttcaagaccctcagcaccccctcccccacggagccgagccacgcccggctgcccaccgccgagcccttcaagtcctacttcgcgaagggcttcctgagcatcgactccggctacttcagcgccaagtgctacccccgctccagcacctccgggctccagctgatcaacgtcacccagcacccggcccggatcgccgagacgcccggccccaagatcaccagcctgaagaccatcaactgcatcaacctccgcgcctccgtgttcaaggagcaccgggaggtggagatcaacgtcctgctgccccagatcgcggtgaacctcagcaactgccacgtggtcatcaacagccacgtgtgcgactactccctggacaccgacgggccggtgcgcctgccccggatctaccacgagggcacgttcatgcccgggacctacaagatcgtcatcgaccgcaagaacaagctcaacgaccggtgcaccctggtgaccaactgcgtgatcaagggccgcgaggtccggaagggccagagcgtgctgcgccagtacaagacggagatcaagatcgggaaggcccccaccggctcccggaagctcctgagcgaggagccgggggacgactgcatctcccgcacccagctgctccgcaccgagacggccgagatccacgacgacaactacggcgggcccggcgacaagatcaccatctgcaacggcagcaccatcgtggaccagcggctggggtccgagctgggctgctacaccatcaaccgcgtcaagagcttcaagctctgcgagaactccgccacggggaagacctgcgagatcgacagcacccccgtgaagtgccggcagggcttctgcctgaagatcacccaggaggggcgcggccacgtgaagctgtcccggggcagcgaggtcgtgctggacgcctgcgactccagctgcgaggtcatgatccccaaggggaccggcgacatcctcgtggactgctccgggggccagcagcacttcctgaaggacaacctgatcgacctcggctgcccgcacatccccctgctggggaagatggcgatctacatcgcccgcatgagcaaccaccccaagacgaccatggccttcctcttctggttctccctgggctacgtgatcacctgcatcctgtgcaaggccctcttctacagcctgatcatcatcgggaccctgggcaagaagatcaagcagtaccgggagctcaagccccagacgtgcaccatctgcgagaccgccccggtcaacgcgatcgacgccgagatgcacgacctgaactgctcctacaacatctgcccctactgcgccagccgcctgaccagcgacgggctcgcccggcacgtgaagcagtgccccaagcgcaaggagaaggtggaggagacggagctgtacctgaacctcgagcggatcccctgggtcgtgcgcaagctgctgcaggtgtccgagagcaccggcgtcgcgctcaagcggtccagctggctgatcgtgctgctcgtgctgctgaccgtctccctcagcccggtgcagtccgcccccgtgggccacgggaagaccatcgagacgtaccagacccgcgagggcttcaccagcatctgcctgttcatgctggggtccatcctcttcatcgtcagctgcctggtgaagggcctggtggactccgtcagcgactccttcttccccgggctcagcgtgtgcaagacctgctccatcggcagcatcaacggcttcgagatcgagtcccacaagtgctactgcagcctgttctgctgcccgtactgccggcactgctccgccgaccgcgagatccaccagctgcacctcagcatctgcaagaagcggaagacggggagcaacgtgatgctggccgtctgcaagcgcatgtgcttccgggccaccatcgaggcgtcccgccgcgccctgctcatccggagcatcatcaacaccaccttcgtgatctgcatcctgacgctgaccatctgcgtggcctccaccagcgccgtcgagatggagaccctccccgccgcgacgtgggagcgcgaggaggacctgaccaacttctgccaccaggagtgccaggtgcccgagaccgagtgcctgtgcccctacgaggccctcgtgctgcggaagccgctgttcctcgactccatcgtcaagggcatgaagaacctgctgaacagcacctccctcgagacgagcctgtccatcgaggccccctggggggccatcaacgtgcagagcaccttcaagcccaccgtgtccaccgccaacatcgcgctgagctggtccagcgtcgagcaccgcggcaacaagatcctcgtgacggggcggtccgagagcatcatgaagctggaggagcgcaccggcgtgtcctgggacctgggcgtcgaggacgccagcgagtccaagctcctgaccgtgagcatcatggacctgagccagatgtactcccccgtgttcgagtacctcagcggggaccggcaggtcgaggagtggccgaaggccacctgcacgggcgactgccccgagcgctgcgggtgcacctccagcacctgcctgcacaaggagtggccccactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctcaccagccaggagcggcagtgctccctgatcgaggcggggacgcgcttcaacctgggcccggtgaccatcaccctcagcgagccccggaacatccagcagaagctgccccccgagatcatcaccctgcacccgaagatcgaggaggggttcttcgacctcatgcacgtccagaaggtgctgtccgccagcacggtgtgcaagctgcagtcctgcacccacggcatccccggcgacctccaggtctaccacatcgggaacctgctgaagggcgaccgcgtgaacgggcacctcatccacaagatcgagccccacttcaacaccagctggatgtcctgggacggctgcgacctggactactactgcaacatgggggactggcccagctgcacctacacgggcgtgacccagcacaaccacgccgccttcgtcaacctgctcaacatcgagaccgactacaccaagacgttccacttccactccaagcgggtgaccgcccacggcgacaccccgcagctggacctgaaggcgcgccccacctacggggccggcgagatcacggtcctcgtggaggtggccgacatggagctgcacaccaagaaggtcgagatcagcgggctgaagttcgcctccctcgcctgcaccggctgctacgcgtgcagctccgggatcagctgcaaggtgcggatccacgtggacgagcccgacgagctgaccgtccacgtgaagagctccgaccccgacgtggtcgccgccagcacgtccctgatggcccgcaagctcgagttcggcaccgacagcaccttcaaggccttctccgcgatgccgaagaccagcctgtgcttctacatcgtggagaaggagtactgcaagtcctgcagcgaggacgacacgaagaagtgcgtggacaccaagctggagcagccccagtccatcctcatcgagcaccggggcaccatcatcgggaagcccaacgacacctgccccgccaagacgagctgctggctggagtccgtcaagagcttcttctacggcctgaagaacatgctcgggtccgtgttcggcaacttcttcatcgggatcctgctgttcctggccccgttcttcctctggatgctgagcttcatgttcggctggaagatcctgttctgcttcaagtgctgccgccggacccgcggcctcttcaagtaccgccacctgaaggacgacgaggagaccgggtaccggcgcatcatcgagcggctgaacaacaagaagggcaagaaccgcctcctggacggggagcggctggccgaccgcaagatcgcggagctcttctccaccaagacgcacatcggctga

SEQ ID NO: 11942 - RNA, 5067 nt, synthetic construct
  misc_feature 1..5067: note = derived and/or modified CDS sequence (opt1) from CCHFV(200406546-Turkey)__KR864902.1__GP
  source 1..5067: mol_type = other RNA
atgcccaccaacatcacccacaccctgctggtgtgcttcatcctgtacctgcagctcctggggcgcgggggcgcccacgggcagagcaacgccaccgagcacaacggcaccaacaccaccaccgcgcccgggaccagccagagccacaagcccctggtgagcaccaccccgccccacaccctcgagagctccaccatcaagcacaccacccccaccagcgagaccgagggctccggcgagaccaccccgccgcccaacaccacccaggggccctccccgcccgaggccacccccgagcggcccgccaccaccgccacctccacccccagcacggacaacaccaactccaccacccagatgaacgacaacaaccccacgagcaccatctccaccagcccctccagctcccccagcacgccgcccacgccccagggcatccaccaccccgcccgctccctgctgagcgtgagctccctcaagaccgcgaccacccccacgcccaccagccccggggagatctccagcgagacctccagccagcactccgccatgagccggaccccgaccctgcacacgaccacccaggtgtccaccgagagcacgaaccactccacgccccgccagagcgagtccagcgcccagcccaccaccccctccccgatgacgagccccgcccagtccatcctgcccatgagcgcggccccgaccgccatccagaacatccacccctcccccaccaaccggagcaagcgcaacctcgaggtcgagatcatcctgaccctgagccagggcctcaagaagtactacgggaagatcctgaagctgctccacctgacgctggaggaggacaccgagggcctcctggagtggtgcaagcggaacctgggctccagctgcgacgacgacttcttccagaagcgcatcgaggagttcttcgtgaccggggagggctacttcaacgaggtgctccagttcaagaccctgtccacgctgagccccaccgagccgtcccacgccaagctccccaccgtcgagcccttcaagagctacttcgccaaggggttcctgtccatcgacagcggctacttctccgcgaagtgctacccccggagctccaccagcggcctgcagctcatcaacgtgacgcagcacccggcccgcatcgccgagacccccgggcccaagaccacctccctgaagacgatcaactgcatcaacctgcgggccagcgtgttcaaggagcaccgcgagatcgagatcaacgtcctcctgccccagatcgccgtgaacctgtccaactgccacgcggtgatcaagagccacgtctgcgactactccctcgacaccgacggcccggtgcggctgccccacatctaccacgaggggaccttcatccccggcacctacaagatcgtgatcgacaagaagaacaagctgaacgaccgctgcatcctcgtcacgaactgcgtgatcaaggggcgggaggtgcgcaagggccagagcgtcctgcggcagtacaagaccgagatcaagatcggcaaggccagcaccgggtcccgcaagctgctcagcgaggagcccggcgacgactgcatctcccggacccagctgctgcgcacggagaccgccgagatccacgacgacaactacgggggcccgggggacaagatcaccatctgcaacggcagcaccatcgtggaccagcggctcggctccgagctggggtgctacacgatcaaccgcgtcaagagcttcaagctgtgcgagaactccgccaccggcaagacctgcgagatcgacagcacccccgtcaagtgccgccaggggttctgcctcaagatcacccaggagggccgggggcacgtgaagctgtcccgcggcagcgaggtggtcctggacgtgtgcgactccagctgcgaggtcatgatccccaagggcacgggggacatcctggtggactgctccggcgggcagcagcacttcctcaaggacaacctgatcgacctgggctgcccccacgtgccgctcctgggccggatggccatctacatctgccgcatgagcaaccacccccggaccaccatggcgttcctgttctggttctccttcgggtacgtcatcacgtgcatcttctgcaaggccctcttctacagcctgatcatcatcggcacgctggggaagaagttcaagcagtaccgcgagctcaagccccagacctgcaccatctgcgagaccgcccccgtgaacgccatcgacgccgagatgcacgacctgaactgctcctacaacatctgcccgtactgcgcgagccggctgacgtccgacggcctcgcccgccacgtgccccagtgccccaagcggaaggagaaggtcgaggagaccgagctgtacctgaacctcgagcgcatcccgtggatcgtgcggaagctgctccaggtgagcgagagcaccggggtcgccctcaagcgctccagctggctgatcgtgctgctcgtgctgctgaccgtctccctcagccccgtgcagtccgcccccgtgggccacggcaagacgatcgagacctaccagacccgggaggggttcaccagcatctgcctgttcatgctgggctccatcctcttcatcgtcagctgcctggtgaaggggctggtggactccgtcagcgactccttcttccccggcctcagcgtgtgcaagacgtgctccatcgggagcatcaacggcttcgagatcgagtcccacaagtgctactgcagcctgttctgctgcccgtactgccgccactgctccgcggaccgggagatccaccagctgcacctcagcatctgcaagaagcgcaagaccggctccaacgtgatgctggccgtctgcaagcggatgtgcttccgcgccaccatcgaggccagccggcgcgccctgctcatccgcagcatcatcaacaccacgttcgtgatctgcatcctgaccctgaccatctgcgtggtctccaccagcgcggtggagatggagaacctccccgccgggacgtgggagcgggaggaggacctgaccaacttctgccaccaggagtgccaggtgaccgagaccgagtgcctgtgcccctacgaggccctcgtcctgcgcaagcccctgttcctcgactccatcgtgaagggcatgaagaacctgctgaacagcacgtccctcgagaccagcctgtccatcgaggccccgtggggcgccatcaacgtgcagagcaccttcaagcccaccgtctccacggcgaacatcgccctgagctggtccagcatcgagcaccggggcaacaagatcctcgtgaccgggcgctccgagagcatcatgaagctggaggagcggaccggcgtgtcctgggacctgggcgtcgaggacgccagcgagtccaagctcctgaccgtgagcatcatggacctgtcccagatgtacagccccgtgttcgagtacctcagcggggaccgccaggtcgaggagtggcccaaggccacgtgcaccggcgactgcccggagcggtgcgggtgcacctcctccacgtgcctgcacaaggagtggccccactcccgcaactggcggtgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctcacgagccaggagcgccagtgctccctgatcgaggcggggacccggttcaacctgggccccgtgaccatcaccctcagcgagccgcgcaacatccagcagaagctgccgcccgagatcatcacgctgcaccccaaggtcgaggaggggttcttcgacctcatgcacgtgcagaaggtgctgtccgccagcaccgtctgcaagctgcagtcctgcacccacggcatcccgggcgacctccaggtgtaccacatcgggaacctgctgaagggcgaccgggtgaacgggcacctcatccacaagatcgagccccacttcaacaccagctggatgtcctgggacggctgcgacctggactactactgcaacatgggggactggcccagctgcacgtacaccggcgtcacccagcacaaccacgccgccttcgtgaacctgctcaacatcgagaccgactacacgaagaccttccacttccactccaagcgcgtcaccgcgcacggcgacacgccccagctggacctgaaggcccggccgacgtacggggccggcgagatcaccgtgctcgtggaggtcgccgacatggagctgcacaccaagaaggtggagatcagcgggctgaagttcgcctccctcgcgtgcaccggctgctacgcctgcagctccgggatcagctgcaaggtgcgcatccacgtcgacgagcccgacgagctgacggtgcacgtgaagtccagcgaccccgacgtcgtggccgccagcacctccctgaccgcccggaagctcgagttcggcaccgacagcacgttcaaggcgttctccgccatgcccaagaccagcctgtgcttctacatcgtggagaaggagtactgcaagtcctgcaacgaggacgacacccagaagtgcgtcgacaccaagctggagcagccgcagagcatcctcatcgagcacaagggcacgatcatcgggaagcagaacgacacgtgcaccgccaaggcctcctgctggctggagagcgtgaagtccttcttctacggcctgaagaacatgctcgggagcgtgttcggcaacttcttcatcgggatcctgctgttcctcgcccccttcgtcctgctggtgctgttcttcatgttcggctggaagatcctcttctgcttcaagtgctgccgccggacccgcggcctgttcaagtaccggcacctgaaggacgacgaggagacggggtacaagcgcatcatcgagcgcctcaacaacaagaagggcaagaaccggctgctggacggggagcgcctcgcggaccggaagatcgccgagctgttctccaccaagacccacatcggctga

SEQ ID NO: 11943 - RNA, 5067 nt, synthetic construct
  misc_feature 1..5067: note = derived and/or modified CDS sequence (opt1) from CCHFV(Haskovo-V46/13)__KR092379.1__GP
  source 1..5067: mol_type = other RNA
atgcccaccaacatcatgcacaccctgctcgtgtgcttcatcctgtacctgcagctcctgggcctcgggggcgcccacgggcagagcaacacgaccgagcacaacggcaccaacaacaccacggccccggggacctcccagagccccaagccccacatgtccaccacgcccccgcacgcgcccgagagctccaccatcaagcccaccacccccaccagcgagacggagggctccggcgagaccaccccgcccagcaacaccacgcaggggccctccccgcccgagaccaccagcgagcgccccgccaccacggccatctccaccagctccaccgacaacatgaaccccaccagccagatgacggacaacacccccacctccaccgtcagcatctccccgagctccagccccagcacgccctccacgccccagggcatgcaccacccggcccggagcctgctgtccgtgagctcccccaagaccgccaccacccccacccccaccagcccggtggaggtcgggtccgagaccagctcccagcacagcgcgatgtccagcacgcccacgccccacaccgccacccaggtgtccaccgagaacaccaaccacagcacgccccgccagtccgagccgagcgcccagcagaccaccccctcccccatgccgagccccgcccagtccaccctgctcatgagcgcggcccccaccgccgtgcagaacacccaccccagcccgaccaaccggtccaagcgcaacctggagatggagatcatcctgacgctcagccagggcctgaagaagtactacgggaagatcctgaagctcctgcacctgaccctcgaggaggacaccgagggcctgctggagtggtgcaagcggaacctcggctccaactgcgacgacgacttcttccagaagcgcatcgaggagttcttcatgaccggggagggctacttcaacgaggtcctgcagttcaagacgctgagcaccctctcccccatggagcccagccacgccgagctgcccaccgccgagccgttcaagtcctacttcgcgaaggggttcctgagcatcgactccggctacttcagcgccaagtgctacccccggtccagcacctccggcctccagctgatcaacgtgacgcagcaccccgcccgcatcgccgagacccccgggccgaagaccaccagcctgaaggccatcaactgcatcaacctccgggcgtccgtgttcaaggagcaccgcgagatcgagatcaacgtcctgctgccccagatcgccgtgaacctcagcaactgccacgtggtcatcaactcccacgtgtgcgactacagcctggacacggacggccccgtgcggctgccccacatctaccacgaggggaccttcatcccgggcacctacaagatcgtcatcgacaagaagaacaagctcaacgaccgctgcaccctggtgacgaactgcgtgatcaaggggcgggaggtccgcaagggccagagcgtgctgcggcagtacaagaccgagatcaagatcggcaaggcctccaccgggagccgcaagctcctgtccgaggagctgggcgacgactgcatcagccggacccagctcctgcgcacggagaccgccgagatccacgacgacaactacgggggccccggggacaagatcaccatctgcaacggctccaccatcgtggaccagcggctgggcagcgagctcgggtgctacacgatcaaccgcggcaagtccttcaagctgtgcgagaacagcgccaccgggaagacctgcgagatcgactccacccccgtcaagtgccggcagggcttctgcctgaagatcacgcaggaggggcgcggccacgtgaagctcagccgcggctccgaggtggtcctggacgcgtgcgacagctcctgcgaggtgatgatccccaaggggaccggcgacatcctggtcgactgcagcgggggccagcagcacttcctgaaggacaacctcatcgacctgggctgcccgcacatccccctgctcgggaagatggccatctacatctgccggatgtccaaccacccccgcaccaccatggccttcctgttctggttcagcttcggctacgtgatcacgtgcatcttctgcaaggccctgttctactccctcatcatcatcgggaccctgggcaagaagatcaagcagtaccgggagctgaagccccagacctgcaccatctgcgagaccacgccggtgaacgccatcgacgcggagatgcacgacctcaactgcagctacaacatctgcccctactgcgcctcccgcctgaccagcgacgggctggcccggcacgtcacccagtgccccaagcgcaaggagaaggtggaggagaccgagctctacctgaacctggagcggatcccgtggatcgtgcgcaagctcctgcaggtcagcgagtccacgggcgtggccctgaagcggagctcctggctcatcgtgctgctggtcctcctgcccgtgagcctgtcccccgtgcagagcgcgcccgtcggccacgggaagaccatcgagacctaccagacccgcgagggcttcacgtccatctgcctcttcatgctggggagcatcctgttcatcgtgtcctgcctcgtgaagggcctggtcgacagcgtgggggactccttcttcccgggcctgagcgtgtgcaagacctgctccatcggcagcatcaacgggttcgagatcgagtcccacaagtgctactgcagcctcttctgctgcccctactgccggcactgctccgccgaccgcgagatccaccagctgcacctgagcatctgcaagaagcggaagaccggctccaacgtcatgctcgccgtgtgcaagcgcatgtgcttccgggccaccatcgaggccagccgccgggcgctgctgatccgcagcatcatcaacacgaccttcgccatgtgcatcctcaccctgaccatctgcgtggtctccacgagcgccgtggagatggagaacctgcccgccgggacctgggagcgggaggaggacctcaccaacttctgccaccaggagtgccaggtgaccgagacggagtgcctgtgcccctacgaggccctggtcctccgcaagccgctgttcctggactccatcgtgaagggcatgaagaacctcctgaacagcacctccctggagaccagcctctccatcgaggcgccctggggcgccatcaacgtgcagagcaccttcaagcccacggtctccaccgccaacatcgccctgagctggtccagcgtggagcaccgcgggaacaagatcctggtgaccggccggtccgagagcatcatgaagctcgaggagcgcaccggggtctcctgggacctgggcgtggaggacgccagcgagtccaagctgctcacggtgagcatcatggacctgtcccagatgtacagccccgtcttcgagtacctgagcggggaccgccaggtggaggagtggccgaaggcgacctgcaccggcgactgccccgagcggtgcgggtgcacctccagcacgtgcctccacaaggagtggccccactcccggaactggcgctgcaaccccacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctgaccagccaggagcggcagtgctccctcatcgaggccgggacccgcttcaacctgggcccggtcaccatcacgctgagcgagccccggaacatccagcagaagctcccgcccgagatcatcaccctgcaccccaagatcgaggagggcttcttcgacctgatgcacgtgcagaaggtgctctccgccagcaccgtctgcaagctgcagtcctgcacccacgggatccccggcgacctccaggtgtaccacatcgggaacctgctgaagggcgaccgcgtgaacgggcacctgatccacaagatcgagccccacttcaacacgagctggatgtcctgggacggctgcgacctcgactactactgcaacatgggcgactggcccagctgcacctacaccggggtcacccagcacaaccacgcggccttcgtgaacctgctgaacatcgagacggactacaccaagaccttccacttccactccaagcgggtgaccgcccacggcgacacgccgcagctcgacctgaaggcccgccccacctacggggccggcgagatcaccgtcctggtggaggtcgcggacatggagctccacaccaagaaggtggagatcagcgggctgaagttcgcctccctgacgtgcaccggctgctacgcctgcagctccggcatcagctgcaaggtgcggatccacgtcgacgagcccgacgagctcaccgtgcacgtgaagtccagcgaccccgacgtcgtggccgccgggaccagcctgatggcgcgcaagctggagttcggcacggactccaccttcaaggccttcagcgccatgccgaagacctccctctgcttctacatcgtggagcgggagtactgcaagagctgctccgaggacgacacccagaagtgcgtcgacacgaagctggagcagccccagagcatcctgatcgagcacaaggggaccatcatcggcaagcagaacgacacgtgcaccgcccgcgcctcctgctggctcgagagcgtgaagtccttcttctacgggctgaagaacatgctgggcagcgtgttcggcaacttcctcatcgggatcctgctgttcctcgcgcccttcgtcctgctggtgctgttcttcatgttcggctggaagatcctcttctgcttcaagtgctgccggcgcacccgggggctgttcaagtaccgccacctgaaggacgacgaggagaccggctaccggcgcatcatcgagcgcctcaactccaagaagggcaagaaccggctgctggacggggagcgcctcgccgaccggaagatcgccgagctgttcagcaccaagacccacatcggctga

SEQ ID NO: 11944 - RNA, 5067 nt, synthetic construct
  misc_feature 1..5067: note = derived and/or modified CDS sequence (opt1) from CCHFV(VLG/TI29414)__AY179961.1__GP
  source 1..5067: mol_type = other RNA
atgcccaccaacatcatgcacaccctgctcgtgtgcttcatcctgtacctgcagctcctgggcctcgggggcgcccacatccagagcaacgccacggagcacaacgggaccaacaccaccacggcgccgtccaccagccagtcccccaagcccctggtcagcaccgcgcccccgcacgccctggagtccagcaccatcaagcccacgacccccgtgtccgagaccgagggcagcgggggcaccacgcccccgcccaacaccacccagggcccctccccgcccgaggccacccccgagcgccccgccacgaccgccaccagcaccccctccacggacaacaccaacagcaccacccacgtgacggacaacaacccgacctccaccatcagcacctcccccagctccagcccctccacgcccagcaccccgcaggggatccaccaccccgcccggaacctgctcagcgtctccagccccaagaccgccaccacgcccaccccgacctcccccggcgacatcagctccgagaccagctccctgcacagcgccatgtcccgcacgagcaccctgtacaccgcgacccaggtgtccaccgagaacgccaaccacagcgcgccccggcagtccgagagctccgcccagcagacgaccaccagccccatgacctccccggcccagcccatcctcgtgatgagcgccgcccccacggccatccagaacatccacccgtcccccaccaaccgcagcaagcggaacctggagatggagatcatcctgaccctcagccaggggctgaagaagtactacggcaagatcctgaagctcctgcacctgaccctcgaggaggacacggaggggctgctggagtggtgcaagcgctccctcggcagcaactgcgacgacgacttcttccagaagcggatcgaggagttcttcatgaccggcgaggggtacttcaacgaggtcctgcagttcaagaccctgtccaccctcagccccacggagccctcccacgcccgcccgcccaccgtggagcccttcaagagctacttcgccaagggcttcctgtccatcgacagcgggtacttctccgcgaagtgctacccccggctgagcacctccggcctccagctgatcaacgtgacccagcacccggcccgcatcgccgagacgcccggccccaagaccaccagcctgaagaccatcaactgcatcaacctccgggcctccgtcttcaaggagcaccgcgagatcgagatcaacgtgctgctgccccagatcgccgtgaacctcagcaactgccacgtcgtgatcaactcccacgtgtgcgactacagcctggacacggacgggccggtccggctgccccacatctaccacgagggcaccttcatccccgggacctacaagatcgtgatcgacaagaagaacaagctcaacgaccgctgcaccctggtgacgaactgcgtcatcaagggccgggaggtgcgcaaggggcagtccgtgctgcggcagtacaagaccgagatcaagatcggcaaggcgagcaccggcagccgcaagctcctgtccgaggagcccggggacgactgcatcagccggacccagctgctccgcgccgagccggccgagatccacgacgacaactacggcgggcccggcgacaagatcacgatctgcaacgggtccaccatcgtcgaccagcggctgggcagcgagctgggctgctacaccatcaaccgcgtgaagtccttcaagctctgcgagaacagcgccaccgggaagacgtgcgagatcgactccacccccgtgaagtgccgccagggcttctgcctgaagatcacccaggaggggcggggccacgtcaagctgagccgcgggtccgaggtggtcctggacgcctgcgacagctcctgcgaggtgatgatccccaagggcaccggcgacatcctcgtggactgcagcgggggccagcagcacttcctgaaggacaacctgatcgacctcgggtgcccgcacatccccctgctgggcaagatggcgatctacatctgccggatgtccaaccacccccgcacgaccatggccttcctcttctggttcagcttcggctacgtcatcacgtgcatcttctgcaaggccctgttctactccctgatcatcatcgggaccctcggcaagaagatcaagcagtaccgggagctgaagccccagacctgcaccatctgcgagaccgccccggtgaacgcgatcgacgccgagatgcacgacctgaactgcagctacaacatctgcccctactgcgcctcccgcctcaccagcgacgggctggcccggcacgtgccccagtgcccgaagcgcaaggagaaggtcgaggagaccgagctgtacctcaacctggagcggatcccctggaacgtgcgcaagctgctccaggtgtccgagagcacgggcgtcgccctgaagcggagctcctggctgatcgtgctcctggtgctgctcaccgtcagcctgtcccccgtgcagagcgcgcccgtggggcacggcaagaccatcgagacctaccagacgcgcgagggcttcacctccatctgcctgttcatgctcgggagcatcctgttcctggtctcctgcctcgtgaagggcctggtggacagcgtctccgacagcttcttcccggggctgtccgtgtgcaagacctgcagcatcggctccatcaacgggttcgagatcgagagccacaagtgctactgctccctcttctgctgcccctactgccggcactgcagcgccgaccgcgagatccaccagctgcacctgtccatctgcaagaagcggaagatgggcagcaacgtgatgctcgccgtctgcaagcgcatgtgcttccgggccaccatcgaggcctcccgccgggcgctgctgatccgcagcatcatcaacacgaccttcgtgatctgcatcctcaccctgaccatctgcgtggtcagcacgtccgccgtggagatggagaacctgcccagcggcacctgggagcgcgaggaggacctcaccaacttctgccaccaggagtgccaggtgaccgagacggagtgcctgtgcccctacgaggccctggtcctccggaagccgctgttcctggactccatcgtgaaggggatgaagaacctcctgaacagcaccaacctggagacctccctcagcatcgaggccccctggggcgccatcaacgtgcagtccaccttcaagcccacggtcagcaccgcgaacatcgccctgtcctggagctccgtggagcaccgcgggaacaagatcctggtgaccggccggagcgagtccatcatgaagctcgaggagcgcaccggggtcagctgggacctgggcgtggaggacgcctccgagagcaagctgctcacggtgtccatcatggacctgagccagatgtactcccccgtcttcgagtacctgagcggcgaccgccaggtggaggagtggccgaaggcgacctgcaccggggactgccccgagcggtgcggctgcaccagctccacgtgcctccacaaggagtggccccacagccggaactggcgctgcaaccccacctggtgctgggaggtggggaccggctgcacgtgctgcgggtggaacgtcaaggacctgttcaccgaccacatgttcgtgaagtggaaggtggagtacatcaagaccgaggccatcgtctgcgtggagctgacctcccaggagcggcagtgcagcctcatcgaggccggcacccgcttcaacctgggcccggtgaccatcacgctgtccgagccccggaacatccagcagaagctcccgcccgagatcatcaccctgcaccccaaggtcgaggaggggttcttcgacctgatgcacgtgcagaaggtgctcagcgcctccaccgtctgcaagctgcagagctgcacccacggcatccccggggacctccaggtgtaccacatcggcaacctgctgaagggcgaccgcgtgaacgggcacctgatccacaagatcgagccccacttcaacacgtcctggatgagctgggacggctgcgacctcgactactactgcaacatgggggactggccctcctgcacctacaccggcatgacccagcacaaccacgccgccttcgtcaacctgctgaacatcgagacggactacaccaagaccttccacttccacagcaagcgggtgaccgcgcacggggacacgccgcagctcgacctgaaggcccgccccacctacggcgccggcgagatcaccgtcctggtggaggtggccgacatggagctccacaccaagaaggtcgagatctccgggctgaagttcgccagcctggcgtgcacgggctgctacgcctgctccagcgggatctcctgcaaggtgcggatccacgtggacgagcccgacgagctcaccgtccacgtcaagagcaacgaccccgacgtgatcgccgcctccaccagcctgatggcccgcaagctggagttcggcaccgacagcacgttcaaggcgttctccgccatgccgaagaccagcctctgcttctacatcgccgagcgggagtactgcaagtcctgcagcgaggaggacacccagaagtgcgtggacaccaagctggagcagccccagtccatcctgatcgagcacaaggggacgatcatcggcaagcagaacgacacgtgcaccgccaaggcgagctgctggctcgagtccgtcaagagcttcttctacggcctgaagaacatgctggggtccgtgttcggcaacttcttcatcgggatcctcctgttcctggcccccttcgtgctgctcgtgctgttcttcatgttcggctggaagatcctgttctgcttcaagtgctgccgccggacccgcgggctcctgaagtaccggctgctcaaggacgacgaggagaccggctaccgccgcatcatcgagcggctgaacaacaagaagggcaagaaccgcctgctcgacggggagcggctggccgaccgcaagatcgccgagctgttcagcaccaagacccacatcggctga

SEQ ID NO: 11945 - RNA, 5067 nt, synthetic construct
  misc_feature 1..5067: note = derived and/or modified CDS sequence (opt1) from CCHFV(UCCR4405)__KY484029.1__GP
  source 1..5067: mol_type = other RNA
atgcccatcaacatcatgcacgccctgctcgtgtgcttcatcctgtacctgcagctcagcggcctcgggggcgcccaccgccagtccaacgcgaccgagcacaacgggaccaacacgaccaccgccccgggcaccagccagtcccccaagccgcccgtcagcacgaccctgccccacacccccgaggcctccaccatcaagctgacgacccccaccagcgagaccgaggggtccggcgagacgacgcccccgcccaacaccacccagggcctgcccctgcccgggaccaccccggagcggagcgccaccaccgccacgtccaccagctccaccgacgacatgaacagcaccacgcagatgaccgacaacacccccacctccacggtgagcatcggcctctccagctcccccagcatgccctccaccagccaggggatccactacccggtgcgcagcctgctgtccgtcagctcccccaagaccgcgaccacgcccacccccatgagcccgggcgaggtgtcccccgagaccagctcccagcacagcgccatgtcccggatccccaccctctacacggccacccaggtgagcaccgagaacaccaaccgctccatcccccggcagagcgagtccagcgtccagccggccacccagtcccccatcacgagccccgcgcagaccatcctgctgatgtccgccgcccccaccgccatccaggacatgcacccgagccccaagaaccgctccaagcggaacctcgaggtggagatcatcctgaccctgagccaggggctcaagaagtactacggcaagatcctgaagctgctccacctgacgctggaggaggacaccgagggcctcctggagtggtgcaagcgcaacctggggagcaactgcgacgacgacttcttccagaagcggatcgaggagttcttcatcaccggcgaggggtacttcaacgaggtgctccagttcaagaccccctccacgctgagcccgaccgagccctcccacgtccgcctgcccaccgccgagcccttcaagagctacttcgcgaagggcttcctctccatcgacagcggctacttctccgccaagtgctacccgcggagctccaccagcgggctgcagctgatcaacgtgacgcagcaccccgcccgcatcgccgagacccccggccccaagaccacctccctcaagacgatcaactgcatcaacctgcgggccagcgtgttcaaggagcaccgcgaggtcgagatcaacgtgctgctcccgcagatcgcggtgaacctgtccaactgccacgtcgtgatcaacagccacgtgtgcgactactccctggacaccgacgggcccgtccggctcccccgcatccaccacgagggcgccttcatccccgggacctacaagatcgtgatcgacaagaagaacaagctgaacgaccggtgcagcctggtgaccaactgcgtcatcaagggccgcgaggtgcggaagggccagtccgtgctccgccagtacaagacggagatcaagatcgggaaggccagcaccggcagccggaagctgctgtccgaggagccgggggacgactgcatcagccgcacccagctcctgaagaccgagacggccgagatccacgacgacaactacggcgggcccggcgacaagatcaccatctgcaacggctccaccatcgtcgaccagcgcctggggagcgagctcggctgctacaccatcaaccgggtgaagtccttcaagctgtgcgagaacagcgccacggggaagacctgcgagatcgactccacccccgtcaagtgccgccagggcttctgcctgaagatcacccaggaggggcggggccacgtgaagctgagccgcggctccgaggtggtcctcgacgcgtgcgacagctcctgcgaggtgatgatccccaaggggacgggcgacatcctggtggactgcagcgggggccagcagcacttcctgaaggacaacctcatcgacctgggctgcccgcacatccccctgctcgggaagatggccatctacatctgccggatgtccaaccacccccgcaccaccatggccttcctgttctggttcagcttcggctacgtcatcacgtgcatcttctgcaaggccctgttctactccctcatcatcatcgggaccctgggcaagaagatcaagcagtaccgggagctgaagccccagacctgcaccatctgcgagaccgccccggtgaacgcgatcgacgccgagatgcacgacctcaagtgcagctacaacatctgcccctactgcgcctcccgcctgaccagcgacgggctggcccggcacgtgacgcagtgccccaagcgcaaggagaaggtcgaggagaccgagctctacctgaacctggagcggatcccctggatcgtgcgcaagctcctccaggtgtccgagagcaccggcgtcgcgctgaagcggagctcctggctcatcgtgctgctggtgctcctgaccgtcagcctgtccccggtgcagagcgcccccgtgggccacgggaagacgatcgagacctaccagacccgcgagggcttcacctccatctgcctcttcatgctggggagcatcctgttcatcgtctcctgcctcgtgaagggcctggtggacagcgtctccgacagcttcttccccgggctgtccgtgtgcaagacgtgcagcatcggctccatcaacggcttcgagatcgagagccacaagtgctactgctccctcttctgctgcccgtactgccggcactacagcgccgaccgcgagatccaccagctgcacctgtccatctgcaagaagcggaagaccgggagcaacgtgatgctcgccgtctgcaagcgcatgtgcttcaaggccaccatcgaggcgtcccggcgcgccctgctgatccgcagcatcatcaacaccacgttcgtgatctgcatcctcatcctggccatctgcgtggtcagcacctccgccgtggagatggagaacctgcccgccggcacctgggagcgggaggaggacctcaccaacttctgccaccaggagtgccaggtgacggagaccgagtgcctgtgcccctacgaggcgctggtcctccgcaagcccctgttcctggacagcaccgtgaaggggatgaagaacctcctgaactccaccagcctggagacgtccctcagcatcgaggccccgtggggcgccatcaacgtgcagtccaccttcaagcccaccgtcagcaccgccaacatcgccctgtcctggagctccgtggagcaccgggggaacaagatcctggtgacgggccgcagcgagtccatcatgaagctcgaggagcggaccggcgtcagctgggacctgggggtggaggacgcgtccgagagcaagctgctcaccgtgtccatcatggacctgagccagatgtactcccccgtcttcgagtacctgagcggcgaccgccaggtggaggagtggcccaaggcgacctgcacgggggactgcccggagcggtgcggctgcaccagcagcacgtgcctccacaaggagtggccccactcccgcaactggcggtgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacctcccaggagcgccagtgcagcctcatcgaggccggcacccggttcaacctggggcccgtcaccatcaccctgtccgagccgcgcaacatccagcagaagctcccgcccgagatcatcaccctgcaccccaagatcgaggagggcttcttcgacctgatgcacgtgcagaaggtgctcagcgcctccacggtctgcaagctgcagagctgcacccacggcatccccggggacctgcagatctaccacatcggcaacctcctgaagggggaccgggtgaacggccacctgatccacaagatcgagccccacttcaacacctcctggatgagctgggacgggtgcgacctcgactactactgcaacatgggcaactggccctcctgcacctacacgggcgtcacccagcacaaccacgccgccttcgtgaacctgctgaacatcgagaccgactacaccaagacgttccacttccacagcaagcgcgtgaccgcccacggggacacgccccagctcgacctgaaggcccggccgacctacggcgcgggggagatcaccgtcctggtggaggtggccgacatggagctccacaccaagaaggtcgagatctccggcctgaagttcgccagcctggtgtgcaccgggtgctacgcctgctccagcggcatctcctgcaaggtgcgcatccacgtcgacgagcccgacgagctcaccgtgcacgtcaagagctccgaccccgacgtggtggccgcgagcacgagcctgatggcccggaagctggagttcggcaccgactccatcttcaaggccttcagcgccatgcccaagacctccctctgcttctacatcgtggagcgcgagtactgcaagagctgctccgaggacgacaccaagaagtgcgtcgacacgaagctggagcagccgcagagcatcctgatcgagcacaaggggaccatcatcggcaagcagaacgacacgtgcaccgccaaggcgtcctgctggctcgagagcgtgaagtccttcttctacgggctgaagaacatgctgggcagcgtgttcgggaacttcttcgtcggcatcctcctgttcctggcccccttcgtgctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaactccaagaaggggaagaaccggctcctggacggcgagcgcctggccgaccggaagatcgccgagctgttcagcaccaagacccacatcggctga

SEQ ID NO: 11946 - RNA, 5067 nt, synthetic construct
  misc_feature 1..5067: note = derived and/or modified CDS sequence (opt1) from CCHFV(Ast133)__KX056060.1__GP
  source 1..5067: mol_type = other RNA
atgcccatcaacatcaagcacaccctgctcgtgtgcttcatcctgtacctgcagctcagcggcctggggggcgcccacgggcagtccaacgccaccgagcacaacggcacgaacaccaccaccgtcccggggacgagccagtcccccaagccccccgcgagcaccaccccgccccacacccccgagtccagcacggtgaagctgaccacccccacctccgagacggagggcagcggcgagaccaccccgccccccaacaccacgcaggggctccccctgccgggcaccacccccgagcgctccgccaccacggccaccagcacctccagcaccgacaacatgaactccacgacccaggtgaccgacaacacccccacgagcaccgtctccatcagcccctccagctccccgagcatgcccagcacctcccaggggatccaccaccccgtgcggagcctgctctccgtgagctcccccaagaccgtcacgaccccgacccccatgagccccggcgagatgtcccccgagaccagctcccagcacttcgccatgagccgcatcccgacgctgtacaccgccacccaggtgtccaccgagaacaccgaccggagcacgccccgccagtccgagagctccgtgcagcccgcgacccagagccccatcacctccccggcccagaccatcctgctcatgagcgccgcccccaaggcgatccaggacatgcacccctccccgacgaaccggagcaagcgcaacctggaggtcgagatcatcctgaccctcagccaggggctgaagaagtactacggcaagatcctgaagctcctgcacctgaccctcgaggaggacaccgagggcctgctggagtggtgcaagcggaacctcgggtccaactgcgacgacgacttcttccagaagcgcatcgaggagttcttcatcacgggcgaggggtacttcaacgaggtgctgcagttcaagaccctgagcaccctctcccccaccgagcccagccacgtgcggctgcccacggccgagccgttcaagtcctacttcgccaagggcttcctgagcatcgactccggctacttcagcgccaagtgctacccccgctccagcacctccgggctccagctgatcaacgtcacccagcaccccgcccggatcgcggagacccccggcccgaagacgaccagcctgaagaccatcaactgcatcaacctccgcgcctccgtgttcaaggagcaccgggaggtggagatcaacgtcctgctgccccagatcgccgtgaacctcagcaactgccacgtggtcatcaactcccacgtgtgcgactacagcctggacaccgacgggcccgtgcgcctgccccggatccaccacgagggcacgttcatcccggggacctacaagatcgtcatcgaccgcaagaacaagctcaacgaccggtgctccctggtgaccaactgcgtgatcaagggccgcgaggtccggaagggccagagcgtgctgcgccagtacaagaccgagatcaagatcgggaaggccagcacgggctcccggaagctcctgagcgaggagcccgacgacgactgcatctcccgcacccagctgctcaagaccgagaccgccgagatccacgacgacaactacgggggccccggggacaagatcacgatctgcaacggcagcaccatcgtcgaccagcgcctgggctccgagctggggtgctacaccatcaaccgggtgaagagcttcaagctctgcgagaactccgcgaccggcaagacgtgcgagatcgacagcacccccgtgaagtgccgccaggggttctgcctgaagatcacccaggagggccgggggcacgtcaagctgtcccgcggcagcgaggtggtgctggacgcctgcgactccagctgcgagatcatgatcccgaagggcaccggggacatcctcgtcgactgctccggcgggcagcagcacttcctgaaggacaacctgatcgacctcggctgcccccacatccccctgctgggcaagatggccatctacatctgccggatgagcaaccacccccgcacgaccatggccttcctcttctggttctccttcgggtacgtgatcacctgcatcttctgcaaggccctgttctacctgctcatcatcatcggcaccctggggaagaagatcaagcagtaccgggagctgaagccgcagacctgcacgatctgcgagaccgcgcccgtgaacgccatcgacgccgagatgcacgacctcaactgcagctacaacatctgcccctactgcgcctcccgcctgaccagcgacggcctggcccggcacgtcacccagtgccccaagcgcaaggagaaggtggaggagacggagctctacctgaacctggagcggatcccgtggatcgtgcgcaagctcctgcaggtctccgagagcaccggggtggcgctgaagcggagctcctggctcatcgtgctgctggtcctcctgaccgtgagcctgtcccccgtgcagagcgcccccgtcggccacggcaagaccatcgagacgtaccagacccgcgaggggttcacctccatctgcctcttcatgctgggcagcatcctgttcatcgtgtcctgcctcgtgaaggggctggtcgacagcgtgtccgacagcttcttcccgggcctgtccgtgtgcaagacctgcagcatcgggtccatcaacggcttcgagatcgagagccacaagtgctactgctccctcttctgctgcccctactgccggcactgcagcgccgaccgcgagatccaccagctgcacctgtccatctgcaagaagcggaagacgggcagcaacgtcatgctcgccgtgtgcaagcgcatgtgcttcaaggcgaccatcgaggcctcccggcgcgccctgctgatccgcagcatcatcaacaccaccttcgtgatgtgcatcctcacgctggccatctgcgtcgtgagcacctccgccgtggagatggaggacctgcccgcggggacctgggagcgggaggaggacctcaccaacttctgccaccaggagtgccaggtcacggagaccgagtgcctgtgcccctacgaggccctggtgctccgcaagccgctgttcagcgactccatcgtgaagggcatgaagaacctgctcaacagcacctccctggagaccagcctgtccatcgaggccccctggggggccatcaacgtccagagcacgttcaagcccaccgtgtccaccgccaacatcgcgctcagctggtccagcgtggagcaccggggcaacaagatcctggtcaccgggcgctccgagagcatcatgaagctggaggagcggacgggcgtgtcctgggacctcggcgtggaggacgccagcgagtccaagctgctgaccgtcagcatcatggacctctcccagatgtacagccccgtgttcgagtacctgagcggggaccgccaggtggaggagtggccgaaggccacctgcaccggcgactgccccgagcggtgcgggtgcacgtccagcacctgcctgcacaaggagtggccccactcccgcaactggcggtgcaaccccacctggtgctggggcgtcgggaccggctgcacgtgctgcggcgtggacgtgaaggacctcttcaccgaccacatgttcatcaagtggaaggtcgagtacatcaagaccgaggccatcgtgtgcgtggagctgaccagccaggagcgccagtgctccctgatcgaggccgggacccggttcaacctcggcccggtcacgatcaccctgagcgagccccgcaacatccagcagaagctgccccccgagatcatcaccctccacccgaagatcgaggaggggttcttcgacctgatgcacgtgcagaaggtgctgtccgcgagcaccgtctgcaagctccagtcctgcacgcacggcatccccggcgacctgcagatctaccacatcgggaacctgctcaagggcgaccgggtgaacgggcacctgatccacaagatcgagccccacttcaacaccagctggatgtcctgggacggctgcgacctggactactactgcaacatgggggactggcccagctgcacctacaccggcgtcacgcagcacaaccacgccgccttcgtgaacctcctgaacatcgagaccgactacaccaagaccttccacttccactccaagcgcgtgacggcccacggcgacaccccgcagctggacctcaaggcgcggcccacctacggggccggcgagatcaccgtcctggtggaggtggccgacatggagctgcacacgaagaaggtcgagatcagcgggctcaagttcgcctccctgacctgcaccggctgctacgcctgcagctccgggatcagctgcaaggtgcgcatccacgtggacgagcccgacgagctgaccgtccacgtgaagtccagcgaccccgacgtggtcgcggccagcacgtccctcatggcccggaagctggagttcggcaccgacagcaccttcaaggccttctccgccatgccgaagaccagcctgtgcttctacatcgtggagcgcgagtactgcaagtcctgcagcgaggacgacacgaagaagtgcgtggacaccaagctcgagcagccccagtccatcctgatcgagcacaagggcaccatcatcgggaagcagaacgacacctgcacggcgaaggccagctgctggctggagtccgtcaagagcttcttctacggcctcaagaacatgctggggtccgtgttcggcagcttcttcgtggggatcctgctcttcctggcccccttcgtcctgctggtgctcttcttcatgttcggctggaagatcctgttctgcttcaagtgctgccggcgcacccggggcctgttcaagtaccgccacctcaaggacgacgaggagaccgggtaccgccggatcatcgagcgcctgaactccaagaagggcaagaaccggctgctcgacggggagcgcctggccgaccggaagatcgccgagctgttcagctccaagacccacatcggctga

SEQ ID NO: 11947 - RNA, 5067 nt, synthetic construct
  misc_feature 1..5067: note = derived and/or modified CDS sequence (opt1) from CCHFV(Ast137)__KX056057.1__GP
  source 1..5067: mol_type = other RNA
atgcccatcaacatcatgcacaccctgctcgtgtgcttcatcctgtacctgcagctcagcggcctcgggggcgcccacgggcagtccaacgccaccgagcacaacggcacgaacaccaccaccgtcccggggacgagccagtcccccaagccgcccgcgagcaccaccctgccccacacccccgagtccagcacggtgaagctgaccacccccacctccgagacggagggcagcggcgagaccacgcccccgcccaacaccacccaggggctgcccccgcccggcaccacccccgagcgccccgccaccacggccacctccaccagctccaccgacaacatgaacagcacgacccaggtgaccgacaacacccccacgtccaccgtcagcatctccccgagctccagcccctccatgcccagcaccagccaggggatccactaccccgtgcggtccctgctcagcgtgtccagcccgaagaccgtcacgacccccacccccatgtcccccggcgagatgagcccggagacctccagccagcactccgccatgagccgcatccccacgctgtacaccgccgcccaggtgtccaccgagaacaccaaccggagcacgccccgccagtccgagagctccgcccagcccgccacccagagcccgaccaccttccccgcccagaccatcctgctcatgtccgcggcccccaaggccatccaggacatgcacccgagccccacgaaccggtccaagcgcaacctggaggtggagatcatcctgaccctcagccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagccccaccgagccctcccacgtgcggctgccgacggccgagcccttcaagagctacttcgccaagggcttcctgtccatcgacagcggctacttctccgcgaagtgctacccccgcagctccaccagcgggctccagctgatcaacgtgacccagcaccccgcccggatcgccgagaccccgggccccaagacgacctccctgaagaccatcaactgcatcaacctccgcgccagcgtcttcaaggagcaccgggaggtggagatcaacgtgctgctgccccagatcgccgtcaacctctccaactgccacgtggtgatcaacagccacgtctgcgactactccctggacaccgacgggcccgtgcgcctgccgcggatccaccacgagggcacgttcatccccgggacctacaagatcgtgatcgacaagaagaacaagctcaacgaccgctgcagcctggtcaccaactgcgtgatcaagggccgggaggtgcgcaagggccagtccgtcctgcggcagtacaagaccgagatcaagatcgggaaggcgagcacgggcagccgcaagctcctgtccgaggagcccggggacgactgcatcagccggacccagctgctcaagaccgagaccgccgagatccacgacgacaactacggcgggcccggcgacaagatcacgatctgcaacggctccaccatcgtggaccagcgcctcgggagcgagctgggctgctacaccatcaaccgcgtcaagtccttcaagctctgcgagaacagcgcgaccgggaagacgtgcgagatcgactccaccccggtgaagtgccggcagggcttctgcctgaagatcacccaggaggggcgcggccacgtgaagctgagccggggctccgaggtcgtgctggacgcctgcgacagctcctgcgagatcatgatccccaaggggaccggcgacatcctcgtggactgcagcgggggccagcagcacttcctgaaggacaacctgatcgacctcggctgcccccacatccccctgctggggaagatggccatccacatctgccgcatgtccaaccacccgcggacgaccatggcgttcctcttctggttcagcttcggctacgtcatcacgtgcatcttctgcaaggccctgttctactccctgatcatcatcgggaccctcggcaagaagatcaagcagtaccgcgagctgaagccccagacctgcaccatctgcgagaccgcccccgtgaacgccatcgacgccgagatgcacgacctgaactgcagctacaacatctgcccctactgcgcgtcccggctcaccagcgacgggctggcccgccacgtgacccagtgcccgaagcggaaggagaaggtcgaggagacggagctgtacctcaacctggagcgcatcccctggatcgtgcggaagctgctccaggtgtccgagagcaccggcgtcgccctgaagcgcagctcctggctgatcgtgctcctggtgctgctcaccgtcagcctgtcccccgtgcagagcgccccggtgggccacgggaagaccatcgagacgtaccagacccgggagggcttcaccaacatctgcctgttcatgctcgggtccatcctgttcatcgtcagctacctggtgaagggcctcgtggactccgtcagcgactccttcttccccgggctgagcgtgtgcaagacctgctccatcggcagcatcaacggcttcgagatcgagtcccacaagtgctactgcagcctgttctgctgcccctactgccgccactgctccgcggaccgggagatccaccagctccacctggggatctgcaagaagcgcaagacgggcagcaacgtgatgctggccgtctgcaagcggatgtgcttcaaggccaccatcgaggcctcccgccgggccctcctgatccgcagcatcatcaacaccaccttcgtgatctgcatcctgacgctcgcgatctgcgtggtctccaccagcgccgtggagatggagaacctgcccgccgggacctgggagcgcgaggaggacctgaccaacttctgccaccaggagtgccaggtgacggagaccgagtgcctctgcccgtacgaggccctggtcctgcggaagcccctcttcctggacagcatcgtgaagggcaccaagaacctgctcaactccaccagcctggagacgtccctgagcatcgaggccccctggggcgcgatcaacgtgcagtccaccttcaagcccaccgtcagcaccgccaacatcgccctctcctggagctccgtggagcaccgcgggaacaagatcctggtgacgggccggagcgagtccatcatgaagctggaggagcgcaccggggtcagctgggacctcggcgtggaggacgcctccgagagcaagctgctgaccgtgtccatcatggacctcagccagatgtactccccggtcttcgagtacctgagcggggaccgccaggtggaggagtggcccaaggccacgtgcaccggcgactgccccgagcggtgcgggtgcacctcctccacgtgcctgcacaaggagtggccccacagccggaactggcgctgcaacccgacctggtgctggggcgtgggcaccgggtgcacgtgctgcggcgtcgacgtgaaggacctcttcaccgaccacatgttcatcaagtggaaggtggagtacatcaagaccgaggcgatcgtctgcgtggagctgaccagccaggagcggcagtgcagcctgatcgaggccgggacccgcttcaacctcggccccgtgaccatcaccctgtccgagccccggaacatccagcagaagctgcccccggagatcatcaccctccaccccaagatcgaggagggcttcttcgacctgatgcacgtccagaaggtgctgagcgcctccacggtgtgcaagctccagagctgcacccacgggatccccggcgacctgcagatctaccacatcgggaacctgctcaagggcgaccgcctgaacgggcacctgatccacaagatcgagccccacttcaacacctcctggatgagctgggacggctgcgacctcgactactactgcaacatgggcgactggccgtcctgcacctacacgggggtcacccagcacaaccacgccgcgttcgtgaacctgctgaacatcgagaccgactacaccaagacgttccacttccacagcaagcgggtcaccgcccacggcgacacgccccagctcgacctgaaggcccgccccacctacggggccggcgagatcaccgtgctggtggaggtcgccgacatggagctccacaccaagaaggtggaggtgtccgggctgaagttcgcgagcctggcctgcaccggctgctacgcctgctccagcggcatctcctgcaaggtccggatccacgtggacgagcccgacgagctcaccgtgcacgtcaagagctccgacccggacgtggtggccgccagcacgtccctgatggcgcgcaagctggagttcgggaccgacagcaccttcaaggccttcagcgccatgcccaagacctccctctgcttctacatcgtcgagcgggagtactgcaagagctgctccgaggacgacacgaagaagtgcgtggacaccaagctggagcagccccagagcatcctgatcgagcacaagggcaccatcatcgggaagcagaacgacacgtgcaccgccaaggcctcctgctggctcgagagcgtgaagtccttcttctacggcctgaagaacatgctggggagcgtcttcggcaacttcttcgtgggcatcctcctgttcctggcgcccttcgtgctgctcgtcctgttcttcatcttcgggtggaagatcctgttctgcttcaagtgctgccgccggacccgcggcctcttcaagtaccggcacctgaaggacgacgaggagaccgggtaccgcaagatcatcgagcgcctgaactccaagaagggcaagaaccggctcctggacggcgagcgcctggccgaccggaagatcgccgagctgttcagcaccaagacgcacatcgggtga

SEQ ID NO: 11948 - RNA, 5067 nt, synthetic construct
  misc_feature 1..5067: note = derived and/or modified CDS sequence (opt1) from CCHFV(Ast149)__KX056054.1__GP
  source 1..5067: mol_type = other RNA
atgcccatcaacatcatgcacaccctgctcgtgtgcttcatcctgtacctgcagctcagcggcctggggggcgcccacgggcagtccaacgccaccgagcacaacggcacgaacaccaccaccgcgccggggacgagccagtcccccaagccccccgccagcaccaccccgccccacacccccgagtccagcacggtcaagctgaccacccccacctccgagacggagggcagcggcgagaccaccccgccccccaacaccacgcaggggctccccccgcccggcaccacccccgagcgccccgccaccacggccacctccaccagctccaccgacaacatgaacagcacgacccaggtgaccgacaacaccccgacgtccaccgtgagcacctcccccagctccagcccctccatgcccagcaccagccaggggatccactacccggtccggtccctgctgagcgtgtccagccccaagacggtgaccacccccacccccatgtccccgggcgagatgagccccgagacgtccagccagcactccgccatgagccgcatccccaccctctacaccgcggcccaggtctccaccgagaacgccaaccggagcaccccccgccagtccgagagctccgcccagccggcgacgcagagccccaccaccttccccgcccagaccatcctgctgatgtccgccgccccgaaggccatccaggacatgcaccccagccccacgaaccggtccaagcgcaacctcgaggtggagatcatcctgaccctgagccaggggctcaagaagtactacggcaagatcctgaagctgctccacctgaccctggaggaggacaccgagggcctcctggagtggtgcaagcggaacctggggagcaactgcgacgacgacttcttccagaagcgcatcgaggagttcttcatcacgggcgaggggtacttcaacgaggtgctccagttcaagaccctgtccaccctgagccccaccgagccgtcccacgtccggctccccacggcggagcccttcaagagctacttcgccaagggcttcctgtccatcgacagcggctacttctccgccaagtgctacccccgcagctccaccagcgggctgcagctcatcaacgtgacccagcacccggcccggatcgccgagacccccggccccaagacgacctccctgaagaccatcaactgcatcaacctgcgcgcgagcgtgttcaaggagcaccgggaggtcgagatcaacgtgctcctgccccagatcgccgtgaacctgtccaactgccacgtcgtgatctacagccacgtgtgcgactactccctcgacaccgacgggccggtccgcctgccccggatccaccacgagggcacgttcatccccgggacctacaagatcgtgatcgacaagaagaacaagctgaacgaccgctgcagcctcgtgaccaactgcgtcatcaagggccgggaggtgcgcaagggccagtccgtgctgcggcagtacaagaccgagatcaagatcgggaaggccagcacgggcagccgcaagctgctctccgaggagcccggggacgactgcatcagccggacccagctgctgaagaccgagaccgccgagatccacgacgacaactacggcgggccgggcgacaagatcacgatctgcaacggctccaccatcgtcgaccagcgcctcgggagcgagctgggctgctacaccatcaaccgcgtgaagtccttcaagctgtgcgagaacagcgccaccgggaagacgtgcgagatcgactccacccccgtcaagtgccggcagggcttctgcctcaagatcacccaggaggggcgcggccacgtgaagctgagccggggctccgaggtggtcctggacgcgtgcgacagctcctgcgagatcatgatccccaaggggaccggcgacatcctggtggactgcagcgggggccagcagcacttcctcaaggacaacctgatcgacctgggctgcccccacatcccgctcctggggaagatggccatctacatctgccgcatgtccaaccacccccggacgaccatggccttcctgttctggttcagcttcggctacgtgatcacctgcatcttctgcaaggccctcttctactccctgatcatcatcgggaccctgggcaagaagatcaagcagtaccgcgagctcaagccccagacctgcacgatctgcgagaccgcccccgtcaacgcgatcgacgccgagatgcacgacctgaactgcagctacaacatctgcccgtactgcgcctcccggctgaccagcgacgggctcgcccgccacgtgacccagtgccccaagcggaaggagaaggtggaggagacggagctgtacctgaacctcgagcgcatcccctggatcgtccggaagctgctgcaggtgtccgagagcaccggcgtggcgctcaagcgcagctcctggctgatcgtcctgctcgtgctgctgaccgtgagcctctccccggtccagagcgcccccgtgggccacgggaagaccatcgagacgtaccagacccgggagggcttcaccaacatctgcctgttcatgctggggtccatcctcttcatcgtgagctgcctggtcaagggcctggtggactccgtgagcgactccttcttccccgggctcagcgtctgcaagacctgctccatcggcagcatcaacggcttcgagatcgagtcccacaagtgctactgcagcctgttctgctgcccctactgccgccactgctccgccgaccgggagatccaccagctgcacctcgggatctgcaagaagcgcaagacgggcagcaacgtgatgctggccgtgtgcaagcggatgtgcttcaaggccaccatcgaggcgtcccgccgggccctgccgatccgcagcatcatcaacaccaccttcgtcatctgcatcctcacgctggccatctgcgtggtgtccaccagcgccgtcgagatggagaacctgcccgccgggacctgggagcgcgaggaggacctcaccaacttctgccaccaggagtgccaggtgacggagaccgagtgcctgtgcccctacgaggcgctggtgctccggaagcccctgttcctggacagcatcgtcaagggcatgaagaacctcctgaactccaccagcctggagacctccctcagcatcgaggccccgtggggggccatcaacgtgcagtccacgttcaagcccaccgtgagcaccgccaacatcgccctgtcctggagctccgtcgagcaccgcggcaacaagatcctggtgaccggccggagcgagtccatcatgaagctcgaggagcgcacgggggtgagctgggacctgggcgtcgaggacgcgtccgagagcaagctgctcaccgtgtccatcatggacctgagccagatgtactcccccgtgttcgagtacctgagcggggaccggcaggtcgaggagtggcccaaggccacctgcaccggcgactgcccggagcgctgcgggtgcacgtccagcacctgcctccacaaggagtggccccacagccggaactggcgctgcaaccccacctggtgctggggcgtgggcaccgggtgcacgtgctgcggcgtggacgtcaaggacctgttcaccgaccacatgttcatcaagtggaaggtggagtacatcaagaccgaggccatcgtgtgcgtcgagctgacctcccaggagcggcagtgcagcctcatcgaggccgggacccgcttcaacctgggccccgtgacgatcaccctgtccgagccgcggaacatccagcagaagctcccccccgagatcatcaccctgcaccccaagatcgaggagggcttcttcgacctgatgcacgtgcagaaggtcctcagcgcgtccaccgtgtgcaagctgcagagctgcacgcacgggatcccgggcgacctgcagatctaccacatcgggaacctcctgaagggcgaccgcctgaacgggcacctcatccacaagatcgagccccacttcaacacctcctggatgagctgggacggctgcgacctggactactactgcaacatgggcgactggccctcctgcacctacaccggggtgacgcagcacaaccacgccgccttcgtcaacctgctcaacatcgagaccgactacaccaagaccttccacttccacagcaagcgggtgacggcccacggcgacaccccccagctggacctgaaggcccgcccgacctacggggcgggcgagatcaccgtcctcgtggaggtggccgacatggagctgcacacgaagaaggtcgaggtgtccgggctgaagttcgccagcctcgcctgcaccggctgctacgcctgctccagcggcatctcctgcaaggtgcggatccacgtcgacgagcccgacgagctgaccgtgcacgtgaagagctccgaccccgacgtcgtggcggccagcacctccctgatggcccgcaagctcgagttcgggacggacagcaccttcaaggccttcagcgccatgcccaagacctccctgtgcttctacatcgtggagcgggagtactgcaagagctgctccgaggacgacaccaagaagtgcgtcgacacgaagctggagcagccgcagagcatcctcatcgagcacaagggcaccatcatcgggaagcagaacgacacctgcaccgcgaaggcctcctgctggctggagagcgtgaagtccttcttctacggcctgaagaacatgctcgggagcgtgttcggcaacttcttcgtcggcatcctgctgttcctcgcccccttcgtgctgctggccctgttcttcatcttcgggtggaagatcctcttctgcttcaagtgctgccgccggacgcgcggcctgttcaagtaccggcacctgaaggacgacgaggagaccgggtaccgcaagatcatcgagcgcctcaactccaagaagggcaagaaccggctgctggacggcgagcgcctcgcggaccggaagatcgccgagctgttcagcaccaagacccacatcgggtga

SEQ ID NO: 11949 - RNA, 5067 nt, synthetic construct
  misc_feature 1..5067: note = derived and/or modified CDS sequence (opt1) from CCHFV(Ast199)__KX056051.1__GP
  source 1..5067: mol_type = other RNA
atgcccatcaacatcatgcacaccctgctcgtgtgcttcatcctgtacctgcagctcagcggcctcgggggcgcccacgtccagtccaacgccaccgagcacaacgggacgaacaccaccaccgtgccgggcacgagccagtcccccaagccgcccgcgagcaccaccctgccccacacccccgagtccagcacggtgaagctgaccacccccacctccgagacggaggggagcggcgagaccacgcccccgcccaacaccacccagggcctgcccccgcccgggaccacccccgagcgccccgccaccacggccaccaccacctccagcacggacaacatgaactccaccacccaggtcaccgacaacacgcccaccagcaccgtgtccatcagcccgtccagcaacccctccatgcccagcacctcccagggcatccactaccccgtgcggagcctgctcagcgtctccagcccgaagacggtgaccacccccacccccatgtcccccggggagatgagcccggagacgtccagccagcactccgccatgagccgcatccccaccctgtacaccgccgcccaggtgtccaccgagaacaccaaccggagcacgccccgccagtccgagagctccgcccagcccgccacccagagcccgaccaccttccccgcccagacgatccccctgatgtccgcggccccgaaggccatccaggacatgcaccccagccccaccaaccggtccaagcgcaacctcgaggtcgagatcatcctgaccctgagccagggcctcaagaagtactacgggaagatcctgaagctgctccacctgaccctggaggaggacacggagggcctcctggagtggtgcaagcggaacctgggctccaactgcgacgacgacttcttccagaagcgcatcgaggagttcttcatcaccggggagggctacttcaacgaggtgctccagttcaagacccccagcaccctgagcccgacggagccctcccacgtgcggctgcccaccgccgagcccttcaagagctacttcgccaaggggttcctctccatcgacagcggctacttctccgcgaagtgctacccgcgcagctccaccagcggcctgcagctgatcaacgtcacccagcaccccgcccggatcgccgagacgcccgggcccaagaccacctccctcaagaccatcaactgcatcaacctgcgcgccagcgtgttcaaggagcaccgggaggtggagatcaacgtcctgctcccgcagatcgccgtgaacctgtccaactgccacgtggtcatcaacagccacgtgtgcgactactccctggacacggacggccccgtgcgcctcccccggatccaccacgaggggaccttcatccccggcacctacaagatcgtcatcgacaagaagaacaagctgaacgaccgctgcagcctggtgaccaactgcgtgatcaaggggcgggaggtccgcaagggccagtccgtgctccggcagtacaagacggagatcaagatcggcaaggcgagcaccgggtcccgcaagctgctgagcgaggagccgggcgacgactgcatcagccggacccagctcctgaagaccgagacggccgagatccacgacgacaactacgggggccccggggacaagatcaccatctgcaacggctccaccatcgtcgaccagcgcctgggcagcgagctcgggtgctacaccatcaaccgcgtgaagtccttcaagctgtgcgagaacagcgcgacgggcaagacctgcgagatcgactccacccccgtgaagtgccggcaggggttctgcctgaagatcacccaggagggccgcgggcacgtcaagctcagccggggctccgaggtggtgctggacgcctgcgacagctcctgcgagatcatgatccccaagggcacgggggacatcctggtcgactgcagcggcgggcagcagcacttcctgaaggacaacctcatcgacctgggctgcccgcacatccccctgctcggcaagatggccatctacatctgccgcatgtccaaccacccccggaccaccatggcgttcctgttctggttcagcttcgggtacgtgatcacgtgcatcttctgcaaggccctgttctactccctcatcatcatcggcaccctggggaagaagatcaagcagtaccgcgagctgaagccccagacctgcaccatctgcgagaccgccccggtgaacgccatcgacgccgagatgcacgacctcaactgcagctacaacatctgcccctactgcgcgtcccggctgaccagcgacggcctggcccgccacgtcacgcagtgccccaagcggaaggagaaggtggaggagaccgagctctacctgaacctggagcgcatcccgtggatcgtgcggaagctcctgcaggtctccgagagcaccggggtggccctgaagcgctgctcctggctcatcgtgctgctggtcctcctgaccgtgagcctgagccccgtgcagtccgcccccgtcggccacggcaagacgatcgagacctaccagacccgggaggggttcaccaacatctgcctcttcatgctgggcagcatcctgttcatcgtgtcctgcctcgtgaaggggctggtcgacagcgtgtccgacagcttcttccccggcctgtccgtgtgcaagacgtgcagcatcgggtccatcaacggcttcgagatcgagagccacaagtgctactgctccctcttctgctgcccgtactgccgccactgcagcgcggaccgggagatccaccagctgcacctgggcatctgcaagaagcgcaagaccgggtccaacgtcatgctcgccgtgtgcaagcggatgtgcttcaaggccaccatcgaggccagccgccgggccctgctgatccgctccatcatcaacaccacgttcgtgatctgcatcctcaccctggcgatctgcgtcgtgagcacctccgccgtggagatggagaacctgcccgccggcacctgggagcgcgaggaggacctcacgaacttctgccaccaggagtgccaggtcaccgagaccgagtgcctgtgcccctacgaggccctggtgctccggaagcccctgttcctggacagcatcgtgaaggggatgaagaacctcctgaactccaccagcctggagacgagcctctccatcgaggccccgtggggcgcgatcaacgtccagagcaccttcaagcccaccgtgtccaccgccaacatcgccctgagctggtccagcgtggagcaccgcgggaacaagatcctggtcacgggccggtccgagagcatcatgaagctcgaggagcgcaccggcgtgtcctgggacctgggggtggaggacgccagcgagtccaagctgctcaccgtcagcatcatggacctgtcccagatgtacagccccgtgttcgagtacctgtccggcgaccgccaggtggaggagtggcccaaggccacgtgcaccggggactgcccggagcggtgcggctgcaccagcagcacgtgcctccacaaggagtggccccactcccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggcgatcgtgtgcgtggagctgacctcccaggagcggcagtgcagcctcatcgaggccggcacccgcttcaacctggggcccgtcaccatcaccctgagcgagccgcggaacatccagcagaagctcccgcccgagatcatcaccctgcaccccaagatcgaggagggcttcttcgacctgatgcacgtgcagaaggtgctctccgccagcacggtctgcaagctgcagtcctgcacccacggcatccccggggacctgcagatctaccacatcggcaacctcctgaagggggaccgcctgaacggccacctcatccacaagatcgagccccacttcaacaccagctggatgtcctgggacgggtgcgacctggactactactgcaacatgggcgactggcccagctgcacctacacgggcgtgacccagcacaaccacgccgcgttcgtcaacctgctcaacatcgagaccgactacaccaagacgttccacttccactccaagcgggtgaccgcccacggggacacgccccagctggacctgaaggcccgcccgacctacggcgccggggagatcaccgtgctcgtcgaggtggccgacatggagctgcacaccaagaaggtggaggtcagcggcctgaagttcgcgtccctcgcctgcaccgggtgctacgcctgcagctccggcatcagctgcaaggtgcggatccacgtggacgagcccgacgagctgaccgtccacgtgaagtccagcgaccccgacgtggtcgccgcctccacgagcctgatggcgcgcaagctcgagttcggcaccgactccaccttcaaggccttcagcgccatgcccaagacctccctgtgcttctacatcgtggagcgggagtactgcaagagctgcagcgaggacgacacgaagaagtgcgtggacaccaagctggagcagccgcagtccatcctcatcgagcacaaggggaccatcatcggcaagcagaacgacacgtgcaccgccaaggccagctgctggctggagtccgtcaagagcttcttctacgggctgaagaacatgctcggctccgtgttcgggaacttcttcgtgggcatcctgctgttcctcgcgcccttcgtcctgctggtgctgttcttcatcttcggctggaagatcctcttctgcttcaagtgctgccgccggacccgcgggctgttcaagtaccggcacctgaaggacgacgaggagaccggctaccgcaagatcatcgagcgcctcaacagcaagaaggggaagaaccggctgctggacggcgagcgcctcgccgaccggaagatcgccgagctgttctccaccaagacgcacatcggctga

SEQ ID NO: 11950 - RNA, 5067 nt, synthetic construct
  misc_feature 1..5067: note = derived and/or modified CDS sequence (opt1) from CCHFV(Saf)__KX013487.1__GP
  source 1..5067: mol_type = other RNA
atgcccaccaacatcatgcacaccctgctcgtgtgcttcatcctgtacctgcagctcctgggcctcgggggcgcccacgggcagagcaacgccacggagcacaacggcaccaacaccaccacggcgccgtccaccagccagtcccccaagcccctggtcagcaccgcgcccccgcacgccctggagtccagcaccatcaagcccacgacccccgcctccgagaccgaggggagcggcgagaccacgcccccgcccaacaccacccagggcccctccccgcccgagaccacgcccgagcgccccgccaccaccgccaccagcacgccctccaccgacaacaccaacagcaccacgcacgtgaccgacaacaacccgacctccaccatcagcacgtcccccagctccagcccctccacccccagcaccccgcaggggatccaccaccccgcccggaacctgctcagcgtgtccagccccaagaccgccacgacccccaccccgacctcccccggcgagatcagctccgagacgagctccctgcacagcgccatgtcccgcaccagcaccctgtacaccgcgacccaggtctccacggagaacgccaaccacagcgcgccccggcagtccgagagctccgcccagcccaccaccaccagcccgatgacgtcccccgcccagagcatcctcgtgatgtccgccgcccccaccgccatccagaacatccacccgagccccaccaaccgcagcaagcggaacctggagatggagatcatcctgaccctctcccaggggctgaagaagtactacggcaagatcctgaagctcctgcacctgacgctcgaggaggacaccgaggggctgctggagtggtgcaagcgcaacctcggcagcaactgcgacgacgacttcttccagaagcggatcgaggagttcttcatgaccggcgaggggtacttcaacgaggtgctgcagttcaagaccctgtccacgctcagccccaccgagccctcccacgcccgcccgcccaccgtcgagcccttcaagagctacttcgccaagggcttcctgtccatcgacagcgggtacttctccgcgaagtgctacccccggagctccaccagcggcctgcagctcatcaacgtgacgcagcacccggcccgcatcgccgagacccccggccccaagaccacctccctgaagacgatcaactgcatcaacctgcgggccagcgtgttcaaggagcaccgcgagatcgagatcaacgtcctcctgccccagatcgccgtgaacctgtccaactgccacgtggtcatcaacagccacgtgtgcgactactccctcgacaccgacgggccggtgcggctgccccacatccaccacgagggcaccttcatccccgggacctacaagatcgtcatcgacaaggagaacaagctgaacgaccgctgcacgctcgtgaccaactgcgtgatcaagggccgggaggtccgcaaggggcagagcgtgctgcggcagtacaagaccgagatcaagatcggcaaggcgagcaccggctcccgcaagctgctcagcgaggagcccggggacgactgcatctcccggacgcagctgctgcgcaccgagaccgccgagatccacgacgacaactacggcgggccgggcgacaagatcaccatctgcaacgggagcacgatcgtggaccagcggctcggctccgagctgggctgctacaccatcaaccgcgtcaagagcttcaagctgtgcgagaactccgccaccgggaagacctgcgagatcgacagcacgcccgtgaagtgccgccagggcttctgcctcaagatcacccaggaggggcggggccacgtgaagctgtcccgcgggagcgaggtcgtgctggacgcctgcgactccagctgcgaggtcatgatccccaagggcaccggcgacatcctggtggactgctccgggggccagcagcactacctcaaggacaacctgatcgacctggggtgcccccacatcccgctcctgggcaagatggccatctacatctgccggatgagcaaccacccccgcaccaccatggcgttcctgttctggttctccttcggctacgtgatcacgtgcatcttctgcaaggccctcttctacagcctgatcatcatcgggaccctgggcaagaagatcaagcagtaccgggagctcaagccccagacctgcaccatctgcgagacggcccccgtcaacgccatcgacgcggagatgcacgacctgaactgctcctacaacatctgcccgtactgcgccagccgcctgacctccgacgggctcgcccggcacgtgccccagtgccccaagcgcaaggagaaggtggaggagaccgagctgtacctgaacctcgagcggatcccgtggatcgtccgcaagctgctccaggtgagcgagagcaccggcgtggccctgaagcggtccagctggctgatcgtcctgctcgtgctgctgacggtgtccctcagccccgtccagtccgcccccgtggggcacggcaagaccatcgagacctaccagacccgcgagggcttcacgagcatctgcctgttcatgctggggtccatcctcttcctggtgagctgcctggtcaagggcctcgtggactccgtgagcgactccttcttccccgggctgagcgtctgcaagacctgctccatcggcagcatcaacgggttcgagatcgagtcccacaagtgctactgcagcctgttctgctgcccgtactgccggcactgctccgcggaccgcgagatccaccagctccacctgagcatctgcaagaagcggaagaccggctccaacgtgatgctggccgtgtgcaagcgcatgtgcttccgggccaccatcgaggccagccgccgggccctcctgatccgcagcatcatcaacacgaccttcgtcatctgcatcctgaccctcaccatctgcgtggtgtccacgagcgcggtcgagatggagaacctgccctccggcacctgggagcgcgaggaggacctgaccaacttctgccaccaggagtgccaggtgaccgagacggagtgcctctgcccctacgaggccctggtgctgcggaagcccctcttcagcgactccatcgtcaaggggatgaagaacctgctgaacagcacctccctcgagaccagcctgtccatcgaggccccgtggggcgccatcaacgtgcagagcaccttcaagcccacggtgtccaccgccaacatcgcgctgagctggtccagcgtcgagcaccgcgggaacaagatcctcgtgaccggccggtccgagagcatcatgaagctggaggagcgcaccggggtgtcctgggacctgggcgtcgaggacgccagcgagtccaagctcctgacggtgagcatcatggacctgagccagatgtactcccccgtgttcgagtacctcagcggcgaccggcaggtcgaggagtggcccaaggcgacctgcaccggggactgcccggagcgctgcggctgcacctccagcacgtgcctgcacaaggagtggccccactcccggaactggcgctgcaaccccacctggtgctggggcgtggggaccgggtgcacgtgctgcggcgtggacgtcaaggacctgttcaccgaccacatgttcgtgaagtggaaggtggagtacatcaagaccgaggccatcgtctgcgtggagctcaccagccaggagcggcagtgctccctgatcgaggccggcacccgcttcaacctggggcccgtgaccatcacgctcagcgagccgcggaacatccagcagaagctgccgcccgagatcatcaccctgcaccccaaggtcgaggagggcttcttcgacctcatgcacgtgcagaaggtgctgtccgccagcaccgtctgcaagctgcagtcctgcacccacgggatccccggcgacctccaggtgtaccacatcggcaacctgctgaagggggaccgcgtgaacggccacctcatccacaagatcgagccccacttcaacacgagctggatgtcctgggacgggtgcgacctggactactactgcaacatgggcgactggcccagctgcacctacaccggggtcacccagcacaaccacgccgccttcgtgaacctgctcaacatcgagacggactacatgaagaccttccacttccactccaagcgggtcaccgcccacggcgacacgccccagctggacctgaaggcgcgcccgacctacggcgccggggagatcaccgtgctcgtggaggtcgccgacatggagctgcacaccaagaaggtggagatcagcggcctgaagttcgtgtccctcgcctgcaccgggtgctacgcctgcagctccggcatcagctgcaaggtccggatccacgtggacgagcccgacgagctgacggtgcacgtcaagagctccgaccccgacgtggtggcggccagcacctccctgatggcccgcaagctcgagttcgggaccgacagcaccttcaaggccttctccgccatgcccaagacgagcctgtgcttctacatcgtcgagcgggagtactgcaagtcctgcagcgaggaggacacccagaagtgcgtggacaccaagctggagcagccgcagtccatcctcatcgagcacaagggcaccatcatcggcaagcagaacgacacgtgcaccgcgaaggccagctgctggctggagtccgtcaagagcttcttctacgggctgaagaacatgctcggctccgtgttcgggaacttcttcatcggcatcctgctgttcctcgcccccttcgtgctgctggtgctgttcttcatgttcgggtggaagatcctcttctgcttcaagtgctgccgccggacccgcggcctgctgaagtaccggcacctcaaggacgacgaggagaccggctaccgccgcatcatcgagcggctgaacaacaagaaggggaagaaccgcctgctcgacggcgagcggctggccgaccgcaagatcgcggagctgttcagcacgaagacccacatcgggtga

SEQ ID NO: 11951 - RNA, 5067 nt, synthetic construct
  misc_feature 1..5067: note = derived and/or modified CDS sequence (opt1) from CCHFV(Min)__KX013481.1__GP
  source 1..5067: mol_type = other RNA
atgcccaccaacatcatgcacaccctgctcgtgtgcttcatcctgtacctgcagctcctgggcctggggggcgcccacgggcagagcaacgccacggagcacaacggcaccaacaccaccacggcgccgtccaccagccagtcccccaagcccctcgtcagcaccgcccccccgcacgccctggagtccagcaccatcaagcccacgacccccgcctccgagaccgaggggagcggcgagaccacgcccccgcccaacaccacccagggcccctcccccccggagaccacgcccgagcgccccgccaccaccgcgaccagcacgccctccaccgacaacaccaacagcaccacgcacgtgaccgacaacaacccgacctccaccatcagcacgtcccccagctccagcccctccacccccagcaccccgcaggggatccaccaccccgcccggaacctgctcagcgtgtccagcctgaagaccgccacgacccccacccccacctccccgggcgagatcagctccgagacgagctccctgcacagcgccatgtcccgcaccagcaccctctacaccgcgacccaggtctccacggagaacgccaaccacagcgccccccggcagtccgagagctccgcccagcccaccaccaccagccccatgacgtccccggcccagagcatcctggtgatgtccgcggcccccatcgccatccagaacatccaccccagcccgaccaaccgcagcaagcggaacctggagatggagatcatcctcaccctgtcccaggggctgaagaagtactacggcaagatcctcaagctgctgcacctcaccctggaggaggacacggaggggctgctcgagtggtgcaagcgcaacctgggcagcaactgcgacgacgacttcttccagaagcggatcgaggagttcttcatgaccggcgaggggtacttcaacgaggtgctgcagttcaagaccctctccaccctgagccccacggagccctcccacgcccgccccccgaccgtcgagcccttcaagagctacttcgccaagggcttcctgtccatcgacagcgggtacttctccgcgaagtgctacccccggagctccaccagcggcctccagctgatcaacgtgacccagcaccccgcccgcatcgccgagacgccgggccccaagaccacctccctgaagaccatcaactgcatcaacctccgggccagcgtgttcaaggagcaccgcgagatcgagatcaacgtcctgctgccccagatcgccgtgaacctctccaactgccacgtggtcatcaacagccacgtgtgcgactactccctggacacggacgggcccgtgcggctgccgcacatctaccacgagggcaccttcatccccgggacctacaagatcgtcatcgacaagaagaacaagctcaacgaccgctgcaccctggtgacgaactgcgtgatcaagggccgggaggtccgcaaggggcagagcgtgctgcggcagtacaagaccgagatcaagatcggcaaggcgagcaccggctcccgcaagctcctgagcgaggagcccggggacgactgcatctcccggacccagctgctccgcacggagaccgccgagatccacgacgacaactacggcgggcccggcgacaagatcaccatctgcaacgggagcaccatcgtggaccagcggctgggctccgagctgggctgctacacgatcaaccgcgtcaagagcttcaagctctgcgagaactccgccaccgggaagacctgcgagatcgacagcaccccggtgaagtgccgccagggcttctgcctgaagatcacgcaggaggggcggggccacgtgaagctgtcccgcgggagcgaggtcgtgctggacgcctgcgactccagctgcgaggtcatgatccccaagggcaccggcgacatcctcgtggactgctccgggggccagcagcacttcctgaaggacaacctgatcgacctcgggtgcccccacatccccctgctgggcaagatggccatctacatctgccggatgagcaaccacccgcgcaccaccatggcgttcctcttctggttctccttcggctacgtgatcacctgcatcttctgcaaggccctgttctacagcctgatcatcatcgggacgctcggcaagaagatcaagcagtaccgggagctgaagccccagacctgcaccatctgcgagaccgcccccgtcaacgccatcgacgcggagatgcacgacctgaactgctcctacaacatctgcccctactgcgccagccgcctcacgtccgacgggctggcccggcacgtgccgcagtgccccaagcgcaaggagaaggtggaggagaccgagctgtacctcaacctggagcggatcccctggatcgtccgcaagctgctccaggtgagcgagagcaccggcgtggccctgaagcggtccagctggctgatcgtcctcctggtgctgctcaccgtgtccctgagcccggtccagtccgcccccgtggggcacggcaagacgatcgagacctaccagacccgcgagggcttcaccagcatctgcctgttcatgctcgggtccatcctgttcctggtgagctgcctcgtcaagggcctggtggactccgtgagcgactccttcttccccgggctgagcgtctgcaagacgtgcaccatcggctccatcaacgggttcgagatcgagagccacaagtgctactgctccctcttctgctgcccctactgccggcactgcagcgcggaccgcgagatccaccagctgcacctgtccatctgcaagaagcggaagaccggcagcaacgtgatgctcgccgtgtgcaagcgcatgtgcttccgggccaccatcgaggcctcccgccgggccctgctgatccgcagcatcatcaacacgaccttcgtcatctgcatcctcaccctgaccatctgcgtggtgagcacgtccgcggtcgagatggagaacctgccgagcggcacctgggagcgcgaggaggacctcaccaacttctgccaccaggagtgccaggtgaccgagacggagtgcctgtgcccctacgaggccctggtgctccggaagcccctgttcctggactccatcgtcaaggggaccaagaacctcctgaacagcacctccctggagaccagcctctccatcgaggccccctggggcgccatcaacgtgcagagcacgttcaagccgaccgtgtccaccgccaacatcgcgctgagctggtccagcgtcgagcaccgcgggaacaagatcctggtgaccggccggtccgagagcatcatgaagctcgaggagcgcacgggggtgtcctgggacctgggcgtcgaggacgccagcgagtccaagctgctcaccgtgagcatcatggacctgtcccagatgtacagccccgtgttcgagtacctgagcggcgaccggcaggtcgaggagtggcccaaggccacctgcaccggggactgccccgagcgctgcggctgcacgtccagcacctgcctccacaaggagtggccgcactcccggaactggcgctgcaaccccacctggtgctggggggtgggcaccgggtgcacctgctgcggcgtggacgtcaaggacctgttcacggaccacatgttcgtgaagtggaaggtggagtacatcaagaccgaggccatcgtctgcgtggagctgaccagccaggagcggcagtgctccctcatcgaggcgggcacccgcttcaacctggggcccgtgacgatcaccctgagcgagccccggaacatccagcagaagctcccgcccgagatcatcaccctgcaccccaaggtcgaggagggcttcttcgacctgatgcacgtgcagaaggtgctctccgccagcaccgtctgcaagctgcagtcctgcacgcacgggatccccggcgacctgcaggtgtaccacatcggcaacctcctgaagggggaccgcatcaacggccacctgatccacaagatcgagccgcacttcaacaccagctggatgtcctgggacgggtgcgacctcgactactactgcaacatgggcgactggcccagctgcacctacaccggggtgacgcagcacaaccacgccgccttcgtcaacctgctgaacatcgagaccgactacaccaagaccttccacttccactccaagcgggtgacggcccacggcgacaccccccagctcgacctgaaggcgcgccccacctacggcgccggggagatcaccgtcctggtggaggtggccgacatggagctccacacgaagaaggtcgagatcagcggcctgaagttcgcctccctggcctgcaccgggtgctacgcgtgcagctccggcatcagctgcaaggtgcggatccacgtggacgagccggacgagctcaccgtccacgtgaagtccagcgaccccgacgtggtcgccgccagcacctccctgatggcccgcaagctggagttcgggacggacagcaccttcaaggccttctccgcgatgcccaagaccagcctctgcttctacatcgtggagcgggagtactgcaagtcctgcagcgaggaggacacccagaagtgcgtggacacgaagctggagcagccccagtccatcctgatcgagcacaagggcaccatcatcggcaagcagaacgacacctgcaccgccaaggccagctgctggctcgagtccgtcaagagcttcttctacgggctgaagaacatgctgggctccgtgttcgggaacttcttcatcggcatcctcctgttcctggccccgttcgtgctgctcgtcctgttcttcatgttcgggtggaagatcctgttctgcttcaagtgctgccgccggacgcgcggcctcctgaagtaccggcacctgaaggacgacgaggagaccggctaccgccgcatcatcgagcggctcaacaacaagaaggggaagaaccgcctgctggacggcgagcggctcgcggaccgcaagatcgccgagctgttcagcaccaagacccacatcgggtga

SEQ ID NO: 11952 - RNA, 5067 nt, synthetic construct
  misc_feature 1..5067: note = derived and/or modified CDS sequence (opt1) from CCHFV(Mamon)__KX013478.1__GP
  source 1..5067: mol_type = other RNA
atgcccaccaacatcatgcacaccctgctcgtgtgcttcatcctgtacctgcagctcctgggcctcgggggcgcccacgggcagagcaacacgaccgagcacaacggcaccaacaccacgaccgccccgtccaccagccagtcccccaagcccctggtcagcaccgcgcccccgcacgccctggagtccagcacgatcaagcccaccacccccgcctccgagaccgaggggagcggcgagacgacgcccccgcccaacatcacccagggcccctccccgcccgagaccacccccgagcgccccgccaccaccgccaccagcacgccctccaccgacaacaccaacagcaccacgcacgtgaccgacaacaacccgacctccaccatcagcacgtcccccagctccagcccctccacccccagcaccccgcaggggatccaccaccccgcgcggaacctgctcagcgtgtccagccccaagaccgccacgacccccaccccgacctcccccggcgagatcagctccaagacgagctccctgcacagcgccatgtcccgcaccagcaccctgtacaccgccacccaggtctccacggagaacgcgaaccacagcgcgccccggcagtccgagagctccgcccagcccaccaccaccagcccgatgacgtcccccgcccagagcatcctcgtgatgtccgccgcccccaccgccatccagaacatccacccgagccccaccaaccgcagcaagcggaacctggagatggagatcatcctgaccctctcccaggggctgaagaagtactacggcaagatcctgaagctcctgcacctgacgctcgaggaggacaccgaggggctgctggagtggtgcaagcgcaacctcggcagcaactgcgacgacgacttcttccagaagcggatcgaggagttcttcatgaccggcgaggggtacttcaacgaggtgctgcagttcaagaccctgtccacgctcagccccaccgagccctcccacgcccgcccgcccaccgtcgagcccttcaagagctacttcgccaagggcttcctgtccatcgacagcgggtacttctccgccaagtgctacccccggagctccaccagcggcctgcagctcatcaacgtgacgcagcacccggcgcgcatcgccgagacccccggccccaagaccacctccctgaagacgatcaactgcatcaacctgcgggccagcgtgttcaaggagcaccgcgagatcgagatcaacgtcctcctgccccagatcgccgtgaacctgtccaactgccacgtggtcatcaacagccacgtgtgcgactactccctcgacaccgacgggccggtgcggctgccccacatctaccacgagggcaccttcatccccgggacctacaagatcgtcatcgacaagaagaacaagctgaacgaccgctgcacgctcgtgaccaactgcgtgatcaagggccgggaggtccgcaaggggcagagcgtgctgcggcagtacaagaccgagatcaagatcggcaaggccagcaccggctcccgcaagctgctcagcgaggagcccggggacgactgcatctcccggacgcagctgctgcgcaccgagaccgcggagatccacgacgacaactacggcgggccgggcgacaagatcaccatctgcaacgggagcacgatcgtggaccagcggctcggctccgagctgggctgctacaccatcaaccgcgtcaagagcttcaagctgtgcgagaactccgccaccgggaagacctgcgagatcgacagcacgcccgtgaagtgccgccagggcttctgcctcaagatcacccaggaggggcggggccacgtgaagctgtcccgcgggagcgaggtcgtgtccgacgcctgcgacagctcctgcgaggtcatgatccccaagggcaccggcgacatcctggtggactgcagcgggggccagcagcacttcctgaaggacaacctcatcgacctggggtgcccccacatcccgctgctcggcaagatggccatctacatctgccggatgtccaaccacccccgcaccaccgtggccttcctgttctggttcagcttcggctacgtcatcacgtgcatcttctgcaaggcgctgttctactccctcatcatcatcgggaccctgggcaagaagatcaagcagtaccgggagctgaagccccagacctgcaccatctgcgagacggcccccgtgaacgccatcgacgccgagatgcacgacctcaactgcagctacaacatctgcccgtactgcgcgtcccgcctgaccagcgacgggctggcccggcacgtgccccagtgccccaagcgcaaggagaaggtcgaggagaccgagctctacctgaacctggagcggatcccgtggatcgtgcgcaagctcctccaggtgagcgagtccaccggcgtcgccctgaagcggagctcctggctgatcgtgctgctggtgctcctgacggtcagcctgtcccccgtgcagagcgcccccgtggggcacggcaagaccatcgagacctaccagacccgcgagggcttcacgtccatctgcctcttcatgctggggagcatcctgttcctcgtctcctgcctggtgaagggcctggtggacagcgtctccgacagcttcttccccgggctctccgtgtgcaagacctgcagcatcggctccatcaacgggttcgagatcgagagccacaagtgctactgctccctgttctgctgcccgtactgccggcactgcagcgccgaccgcgagatccaccagctgcacctctccatctgcaagaagcggaagaccggcagcaacgtgatgctggcggtctgcaagcgcatgtgcttccgggccaccatcgaggccagccgccgggccctgctcatccgctccatcatcaacacgaccttcgtgatctgcatcctgaccctgaccatctgcgtggtcagcacgtccgccgtggagatggagaacctccccagcggcacctgggagcgcgaggaggacctgaccaacttctgccaccaggagtgccaggtgaccgagacggagtgcctgtgcccctacgaggcgctcgtcctgcggaagcccctgttcctcgactccatcgtgaaggggatgaagaacctgctgaacagcacctccctcgagaccagcctgtccatcgaggccccgtggggcgccatcaacgtgcagagcaccttcaagcccacggtctccaccgccaacatcgccctgagctggtccagcgtggagcaccgcgggaacaagatcctcgtgaccggccggtccgagagcatcatgaagctggaggagcgcaccggggtctcctgggacctgggcgtggaggacgcgagcgagtccaagctcctgacggtgagcatcatggacctgagccagatgtactcccccgtcttcgagtacctcagcggcgaccgccaggtggaggagtggcccaaggcgacctgcaccggggactgcccggagcggtgcggctgcacctccagcacgtgcctgcacaaggagtggccccactcccggaactggcgctgcaaccccacctggtgctggggcgtggggaccgggtgcacgtgctgcggcgtcgacgtgaaggacctgttcaccgaccacatgttcgtgaagtggaaggtcgagtacatcaagaccgaggccatcgtgtgcgtggagctcaccagccaggagcggcagtgctccctgatcgaggccggcacccgcttcaacctggggcccgtcaccatcacgctcagcgagccgcggaacatccagcagaagctgccgcccgagatcatcaccctgcaccccaaggtggaggagggcttcttcgacctcatgcacgtgcagaaggtcctgtccgccagcaccgtgtgcaagctgcagtcctgcacccacgggatccccggcgacctccaggtgtaccacatcggcaacctgctgaagggggaccgcgtcaacggccacctcatccacaagatcgagccccacttcaacacgagctggatgtcctgggacgggtgcgacctggactactactgcaacatgggcgactggcccagctgcacctacaccggggtgacccagcacaaccacgccgccttcgtcaacctgctcaacatcgagacggactacaccaagaccttccacttccactccaagcgggtgaccgcccacggcgacacgccccagctggacctgaaggcccgcccgacctacggcgcgggggagatcaccgtgctcgtcgaggtggccgacatggagctgcacaccaagaaggtggagatcagcggcctgaagttcgcctccctcgcctgcacggggtgctacgcctgcagctccggcatcagctgcaaggtccggatccacgtggacgagcccgacgagctgaccgtgcacgtcaagagctccgaccccgacgtggtggcggccagcacctccctgatggcccgcaagctcgagttcgggaccgacagcacgttcaaggccttctccgccatgcccaagaccagcctgtgcttctacatcgtcgagcgggagtactgcaagtcctgcagcgaggaggacacccagaagtgcgtggacaccaagctggagcagccgcagtccatcctcatcgagcacaagggcacgatcatcggcaagcagaacgacacgtgcaccgcgaagaccagctgctggctggagtccgtcaagagcttcttctacgggctgaagaacatgctcggctccgtgttcgggaacttcttcatcggcatcctgctgttcctcgcccccttcgtgctgctggtgctgttcttcatgttcgggtggaagatcctcttctgcttcaagtgctgccgccggacccgcggcctgctgaagtaccggcacctcaaggacgacgaggagaccggctaccgccgcatcatcgagcggctgaacaacaagaaggggaagaaccgcctgctcgacggcgagcggctggccgaccgcaagatcgccgagctgttcagcaccaagacccacatcgggtga

SEQ ID NO: 11953 - RNA, 5067 nt, synthetic construct
  misc_feature 1..5067: note = derived and/or modified CDS sequence (opt1) from CCHFV(K340_6)__KX013475.1__GP
  source 1..5067: mol_type = other RNA
atgcccatcaacatcatgcacaccctgctcgtgtgcttcatcctgtacctgcagctcagcggcctcgggggcgcccacgtccagtccaacgccaccgagcacaacgggacgaacaccaccaccgcgccgggcacgagccagtcccccaagccgcccgccagcaccaccctgccccacacccccgagtccagcacggtgaagcccaccacccccacctccgagacggaggggagcggcgagaccaccccgccgcccaacaccacgcagggcctgccgcccaccgggaccacccccgagcgctccgccacgaccgccaccagcacctccagcacggacaacatgaactccaccacccaggtgaccgacagcacgcccacctccaccgtcagcacctcccccagctccagcagctccatgcccagcacgtcccagggcatccaccaccccgtgcggagcctgctgtccgtgagctcccccaagaccgtcaccacccccacgccgatgagccccggggagatgtcccccgagaccagctcccagcacagcgccatgtcccgcgtgcccaccctctacaccgcgacccaggtgagcacggagaacaccgaccggtccaccccgcgccagagcgagtccagcgtccagcccgccacccagtcccccatcacgagccccgcccagaccatcctgctgatgagcgccgcgccgaaggccatccaggacatgcacccctcccccaccaaccggagcaagcgcaacctcgaggtggagatcatcctgaccctgtcccagggcctcaagaagtactacgggaagatcctgaagctgctccacctgacgctggaggaggacaccgagggcctcctggagtggtgcaagcggaacctgggcagcaactgcgacgacgacttcttccagaagcgcatcgaggagttcttcatcaccggggagggctacttcaacgaggtgctccagttcaagaccctgtccacgctgagcccgaccgagccctcccacgtccggctccccaccgccgagcccttcaagagctacttcgccaaggggttcctgtccatcgacagcggctacttctccgccaagtgctacccgcgcagctccaccagcggcctgcagctcatcaacgtgacgcagcaccccgcgcggatcgccgagacccccgggcccaagaccacctccctgaagacgatcaactgcatcaacctgcgcgccagcgtgttcaaggagcaccgggaggtcgagatcaacgtgctcctgccgcagatcgccgtgaacctgtccaactgccacgtcgtgatcaacagccacgtgtgcgactacagcctcgacaccgacggccccgtccgcctgccccggatccaccacgaggggaccttcatccccggcacctacaagatcgtgatcgaccgcaagaacaagctgaacgaccggtgctccctcgtgacgaactgcgtcatcaaggggcgcgaggtgcggaagggccagagcgtcctgcgccagtacaagaccgagatcaagatcggcaaggcctccaccgggagccggaagctgctctccgaggagccgggcgacgactgcatcagccgcacccagctgctgaagacggagaccgcggagatccacgacgacaactacgggggccccggggacaagatcaccatctgcaacggctccaccatcgtggaccagcgcctcggcagcgagctggggtgctacacgatcaaccgggtgaagtccttcaagctgtgcgagaacagcaccaccggcaagacctgcgagatcgactccacgcccgtcaagtgccgccaggggttctgcctcaagatcacccaggagggccgggggcacgtgaagctgagccgcggctccgaggtggtcctggacgcctgcgacagctcctgcgagatcatgatccccaagggcaccggggacatcctggtggactgcagcggcgggcagcagcacttcctcaaggacaacctgatcgacctgggctgcccgcacatcccgcccctcggcaagatggccatctacatctgccggatgtccaaccacccccgcaccaccatggccttcctgttctggttcagcttcgggtacgtgatcacgtgcatcttctgcaaggccctgttctactccctcatcatcatcggcaccctggggaagaagatcaagcagtaccgggagctgaagccccagacctgcaccatctgcgagacggcgcccgtcaacgccatcgacgccgagatgcacgacctcaactgcagctacaacatctgcccctactgcgccagccgcctgacctccgacggcctggcccggcacgtgacccagtgccccaagcgcaaggagaaggtggaggagaccgagctctacctgaacctggagcggatcccgtggatcgtccgcaagctcctccaggtgagcgagtccacgggggtggcgctgaagcggagctcctggctgatcgtcctgctggtgctcctgaccgtgagcctgtcccccgtccagagcgcccccgtgggccacggcaagaccatcgagacctaccagacgcgcgaggggttcacctccatctgcctcttcatgctgggcagcatcctgttcatcgtgtcctgcctcgtcaaggggctggtggacagcgtgtccgacagcttcttcccgggcctgtccgtctgcaagacctgcagcatcgggtccatcaacggcttcgagatcgagagccacaagtgctactgctccctcttctgctgcccctactgccggcactgcagcgccgaccgcgagatccaccagctgcacctgagcatctgcaagaagcggaagaccggctccaacgtgatgctcgccgtgtgcaagcgcatgtgcttcaaggcgacgatcgaggccagccggcgcgccctgctgatccgctccatcatcaacaccaccttcgtcatgtgcatcctcaccctggccatctgcgtggtgagcacgtccgccgtcgagatggaggacctgcccgcggggacctgggagcgggaggaggacctcaccaacttctgccaccaggagtgccaggtgaccgagacggagtgcctgtgcccctacgaggccctggtgctccgcaagccgctgagcctggactccatcgtcaagggcatgaagaacctcctgaacagcacctccctggagaccagcctctccatcgaggccccctggggcgccatcaacgtgcagagcaccttcaagcccacggtgtccaccgccaacatcgcgctgagctggtccagcgtcgagcaccgggggaacaagatcctggtgaccgggcgctccgagagcatcatgaagctcgaggagcggaccggcgtgtcctgggacctgggcgtcgaggacgccagcgagagcaagctgctcacggtgtccatcatggacctgagccagatgtactcccccgtgttcgagtacctgagcggggaccgccaggtcgaggagtggccgaaggcgacctgcaccggcgactgccccgagcggtgcgggtgcacctccagcacgtgcctccacaaggagtggccccactcccgcaactggcggtgcaaccccacctggtgctggggcgtggggaccggctgcacgtgctgcggcgtggacgtcaaggacctgttcaccgaccacatgttcatcaagtggaaggtggagtacatcaagaccgaggccatcgtgtgcgtcgagctgaccagccaggagcgccagtgctccctcatcgaggccgggacccggttcaacctgggcccggtgaccatcacgctgagcgagccccgcaacatccagcagaagctcccgcccgagatcatcaccctgcaccccaagatcgaggaggggttcttcgacctgatgcacgtgcagaaggtcctctccgccagcaccgtgtgcaagctgcagtcctgcacccacggcatccccggcgacctgcagatctaccacatcgggaacctcctgaagggcgaccgggtcaacgggcacctgatccacaagatcgagccccacttcaacacgagctggatgtcctgggacggctgcgacctcgactactactgcaacatgggggactggcccagctgcacctacaccggcgtgacccagcacaaccacgccgccttcgtgaacctgctgaacatcgagacggactacaccaagaccttccacttccactccaagcgcgtcaccgcccacggcgacacgccgcagctcgacctgaaggcgcggcccacctacggggccggcgagatcaccgtgctggtggaggtcaccgacatggagctccacacgaagaaggtggagatcagcgggctgaagttcgcctccctgacctgcaccggctgctacgcctgcagcagcgggatctcctgcaaggtgcgcatccacgtcgacgagcccgacgagctcaccgtgcacgtcaagagctccgaccccgacgtggtggccgcgagcacgtccctgatggcccggaagctggagttcggcaccgacagcaccttcaaggccttctccgccatgccgaagaccagcctctgcttctacatcgtggagcgcgagtactgcaagtcctgcagcgaggacgacacgaagaagtgcgtcgacaccaagctggagcagccccagtccatcctgatcgagcacaagggcaccatcatcgggaagcagaacgacacgtgcaccgccaaggcgagctgctggctcgagtccgtcaagagcttcttctacggcctgaagaacatgctggggtccgtgttcggcagcttcttcgtggggatcctcctgttcctggcccccttcgtgctcctggtgctgttcttcatgttcggctggaagatcctgttctgcttcaagtgctgccggcgcacccggggcctcttcaagtaccgccacttcaaggacgacgaggagaccgggtaccgccggatcatcgagcgcctgaactccaagaagggcaagaaccggctgctcgacggggagcgcctggccgaccggaagatcgccgagctgttcagcaccaagacgcacatcggctga

SEQ ID NO: 11954 - RNA, 5067 nt, synthetic construct
  misc_feature 1..5067: note = derived and/or modified CDS sequence (opt1) from CCHFV(K323_27)__KX013472.1__GP
  source 1..5067: mol_type = other RNA
atgcccatcaacatcatgcacaccctgctcgtgtgcttcatcctgtacctgcagctcagcggcctcgggggcgcccacgggcagtccaacgccaccgagcacaacggcacgaacaccaccaccgtcccggggacgagccagtcccccaagccgcccgcgagcaccaccctgccccacacccccgagtccagcacggtgaagctcaccacccccacctccgagacggagggcagcggcgagaccacgcccccgcccaacaccacccaggggctgcccctgcccggcaccaccccggagcgctccgccaccacggccaccagcacctccagcaccgacaacatgaactccacgacccaggtgaccgacaacacccccacgagcaccgtctccatcagcccctccagctcccccagcatgccgagcacctcccaggggatccaccaccccgtgcggagcctcctgtccgtgagctcccccaagaccgtcacgacccccaccccgatgagccccggcgagatgtcccccgagaccagctcccagcacagcgccatgtcccgcatccccacgctgtacaccgccacccaggtgagcaccgagaacaccgaccggtccacgccgcgccagagcgagtccagcgtgcagcccgcgacccagtcccccatcaccagccccgcccagaccatcctcctgatgtccgccgccccgaaggcgatccaggacatgcaccccagccccacgaaccggagcaagcgcaacctggaggtcgagatcatcctcaccctgtcccaggggctgaagaagtactacggcaagatcctcaagctgctgcacctcaccctggaggaggacaccgagggcctgctcgagtggtgcaagcggaacctggggagcaactgcgacgacgacttcttccagaagcgcatcgaggagttcttcatcacgggcgaggggtacttcaacgaggtgctgcagttcaagaccctctccaccctgagcccgaccgagtccagccacgtgcggctgcccacggccgagcccttcaagtcctacttcgccaagggcttcctcagcatcgactccggctacttcagcgccaagtgctacccccgctccagcacctccgggctgcagctgatcaacgtcacccagcacccggcccggatcgcggagacccccggccccaagacgaccagcctcaagaccatcaactgcatcaacctgcgcgcctccgtgttcaaggagcaccgggaggtggagatcaacgtcctgctcccccagatcgccgtgaacctgagcaactgccacgtggtcatctccagccacgtgtgcgactacagcctggacaccgacgggccggtgcgcctcccccggatccaccacgagggcacgttcatccccgggacctacaagatcgtcatcgaccgcaaggacaagctgaacgaccggtgctccctggtgaccaactgcgtgatcaagggccgcgaggtccggaagggccagagcgtgctccgccagtacaagaccgagatcaagatcgggaaggcctccacgggcagccggaagctgctgtccgaggagcccggggacgactgcatcagccgcacccagctcctgaagaccgagaccgccgagatccacgacgacaactacggcgggccgggcgacaagatcacgatctgcaacggctccaccatcgtcgaccagcgcctggggagcgagctcggctgctacaccatcaaccgggtgaagtccttcaagctgtgcgagaacagcgcgaccgggaagacgtgcgagatcgactccacccccgtgaagtgccgccagggcttctgcctgaagatcacccaggaggggcggggccacgtcaagctgagccgcggctccgaggtggtgctcgacgcctgcgacagctcctgcgagatcatgatccccaaggggaccggcgacatcctggtcgactgcagcgggggccagcagcacttcctgaaggacaacctcatcgacctgggctgcccccacatcccgctgctcgggaagatggccatctacatctgccggatgtccaaccacccccgcacgaccatggccttcctgttctggttcagcttcggctacgtgatcacgtgcatcttctgcaaggccctgttctacctcctgatcatcatcgggaccctgggcaagaagatcaagcagtaccgggagctcaagccccagacctgcaccatctgcgagaccgcgcccgtgaacgccatcgacgccgagatgcacgacctgaactgctcctacaacatctgcccgtactgcgccagccgcctgaccagcgacgggctcgcccggcacgtcacccagtgccccaagcgcaaggagaaggtggaggagacggagctgtacctgaacctcgagcggatcccctggatcgtgcgcaagctgctgcaggtctccgagagcaccggcgtggcgctcaagcggtccagctggctgaccgtgctgctcgtcctgctgaccgtgtccctcagccccgtgcagtccgccccggtcggccacgggaacacgatcgagacctaccagacccgcgagggcttcaccagcatctgcctgttcatgctggggtccatcctcttcatcgtgagctgcctggtgaagggcctggtcgactccgtgagcgactccttcttccccgggctcagcgtgtgcaagacgtgctccatcggcagcatcaacggcttcgagatcgagtcccacaagtgctactgcagcctgttctgctgcccccactgccggcaccgctccgccgaccgggagatccaccagctgcacctcagcatctgcaagaagcgcaagaccgggagcaacgtcatgctggccgtgtgcaagcggatgtgcccgaaggcgaccatcgaggcctcccgccgcgccctgcccatccggagcatcatcaacaccacgctcgtgatgtgcatcctgaccctggccatctgcgtcgtgtccaccagcgccgtggagatggaggacctccccgcgggcacctgggagcgcgaggaggacctgacgaacttctgccaccaggagtgccaggtcaccgagaccgagtgcctgtgcccctacgaggccctcgtgctgcggaagccgctgttcctcgactccatcgccaaggggatgaagaacctgctgaacagcacctccctcgagacgagcctgtccatcgaggccccctggggcgccatcaacgtgcagagcaccttcaagcccaccgtctccaccgcgaacatcgccctgagctggtccagcgtggagcaccgcgggaacaagatcctcgtgacgggccggtccgagagcatcatgaagctggaggagcgcaccggcgtctcctgggacctgggggtggaggacgccagcgagtccaagctcctgaccgtgagcatcatggacctgagccagatgtactcccccgtcttcgagtacctcagcggcgaccgccaggtggaggagtggccgaaggcgacctgcacgggggactgccccgagcggtgcggctgcacctccagcacgtgcctgcacaaggagtggccccactcccggaactggcgctgcaaccccacctggtgctggggcgtggggaccggctgcacgtgctgcggggtcgacgtgaaggacctgttcaccgaccacatgttcatcaagtggaaggtggagtacatcaagaccgaggccatcgtctgcgtggagctcaccggccaggagcggcagtgcagcctgatcgaggccgggacccgcttcaacctgggcccggtgaccatcaccctctccgagccccggaacatccagcagaagctgccgcccgagatcatcaccctgcaccccaagatcgaggagggcttcttcgacctcatgcacgtccagaaggtgctgagcgcctccacggtgtgcaagctgcagagctgcacccacgggatccccggcgacctccagatctaccacatcgggaacctgctgaagggcgaccgcgtcaacgggcacctcatccacaagatcgagccccacttcaacacctcctggatgagctgggacggctgcgacctggactactactgcaacatgggcgactggccctcctgcacctacacgggggtgacccagcacaaccacgccgccttcgtcaacctgctcaacatcgagaccgactacaccaagacgttccacttccacagcaagcgggtgaccgcgcacggcgacaccccgcagctggacctgaaggcccgccccacctacggggccggcgagatcacggtgctcgtcgaggtggccgacatggagctgcacaccaagaaggtggagatctccgggctgaagttcgccagcctgacctgcaccggctgctacgcgtgctccagcggcatctcctgcaaggtccggatccacgtggacgagcccgacgagctgacggtgcacgtcaagagcagcgaccccgacgtggtggccgcctccaccagcctgatggcccgcaagctcgagttcgggaccgactccaccttcaaggccttcagcgcgatgccgaagacgtccctgtgcttctacatcgtcgagcgggagtactgcaagagctgctccgaggacgacaccaagaagtgcgtggacaccaagctggagcagccccagagcatcctcatcgagcacaagggcaccatcatcgggaagcagaacgacacgtgcaccgccaaggcctcctgctggctggagagcgtgaagtccttcttctacggcctgaagaacatgctcgggagcgtcttcggctccttcttcgtgggcatcctgctgttcctggcccccttcgtgctcctggtcctgttcttcatgttcgggtggaagatcctcttctgcttcaagtgctgccgccggacccgcggcctgttcaagtaccgccacctgaacgacgacgaggagaccgggtaccggcgcatcatcgagcggctcaacagcaagaagggcaagaaccgcctgctggacggcgagcggctcgccgaccgcaagatcgcggagctgttctccacgaagacccacatcgggtga

SEQ ID NO: 11955 - RNA, 5067 nt, synthetic construct
  misc_feature 1..5067: note = derived and/or modified CDS sequence (opt1) from CCHFV(K315_14)__KX013469.1__GP
  source 1..5067: mol_type = other RNA
atgcccttcaacatcatgcacaccctgctcgtgtgcttcatcctgtacctgcagctcagcggcctggggggcgcccacgggcagtccaacgagaccgagcacaacggcacgaacaccaccaccgtcccggggacgagccagtcccccaagccccccgccagcaccaccctgcagcacaccccggagtccagcacggtgaagctcaccacccccacctccgagacggagggcagcggcgagaccaccccccccccgaacaccacgcaggggctgcccccccccggcaccaccccggagcgctccgcgaccacggccaccagcacctccagcaccgacaacatgaactccacgacccaggtgaccgacaacacccccacgagcaccgtctccatcagcccctccagctcccccagcatgccgagcacctcccaggggatccactaccccatccggagcctgctctccgtgagctcccccaagaccgtgacgacccccaccccgatcagccccggcgagatgtcccccgagaccagctcccagcacagcgccatgtcccgcatccccacgctgtacaccgccacccaggtcagcaccgagaacaccaaccggtccacgccgcgccagagcgagtccagcgtgcagcccgccacccagtcccccatcaccagccccgcgcagaccatcctgctcatgtccgccgccccgaaggccatccaggacatgcaccccagccccacgaaccggagcaagcgcaacctggaggtggagatcatcctgaccctctcccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagcccgaccgagccctcccacgtgcggctgcccacggcggagcccttcaagagctacttcgccaagggcttcctgtccatcgacagcggctacttctccgccaagtgctacccgcgcagctccaccagcgggctccagctgatcaacgtgacccagcaccccgcccggatcgccgagacccccggccccaagacgacctccctgaagaccatcaactgcatcaacctccgcgcgagcgtcttcaaggagcaccgggaggtggagatcaacgtgctgctgccgcagatcgccgtcaacctctccaactgccacgtggtgatcaacagccacgtctgcgactactccctggacaccgacgggcccgtgcgcctgccccggatccaccacgagggcacgttcatccccgggacctacaagatcgtgatcgacaagaagaacaagctcaacgaccgctgcagcctggtcaccaactgcgtgatcaagggccgggaggtgcgcaagggccagagcgtcctgcggcagtacaagaccgagatccgcatcgggaaggcctccacgggcagccggaagctcctgtccgaggagccgggggacgactgcatcagccgcacccagctgctcaagaccgagaccgccgagatccacgacgacaactacggcgggcccggcgacaagatcacgatctgcaacggctccaccgtggtcgaccagcgcctggggagcgagctgggctgctacaccatcaaccgggtgaagtccttcaagctctgcaagaacagcgccaccgggaagacgtgcgagatcgactccacccccgtgaagtgccgccagggcttctgcctgaagatcacccaggaggggcggggccacgtcaagctgagccgcggctccgaggtggtgctggacgtctgcgacagctcctgcgagatcatgatccccaaggggaccggcgacatcctcgtggactgcagcgggggccagcagcacttcctgaaggacaacctgatcgacctcggctgcccgcacatccccctgctggggaagatggcgatctacatctgccggatgtccaaccacccccgcacgaccatggccttcctcttctggttcagcttcggctacgtgatcacctgcatcttctgcaaggccctgttctactccctgatcatcatcgggaccctcggcaagaagatcaagcagtaccgggagctgaagccccagacctgcacgatctgcgagaccgccccggtcaacgccatcgacgcggagatgcacgacctgaactgcagctacaacatctgcccctactgcgcctcccgcctcaccagcgaggggctggcccggcacgtgacccagtgccccaagcgcaaggagaaggtggaggagacggagctgtacctcaacctggagcggatcccctggatcgtccgcaagctgctccaggtgagcgagtccaccggcgtggccctgaagcggagctcctggctgatcgtcctcctggtgctgctcaccgtgagcctgtccccggtccagagcgcccccgtgggccacgggaagaccatcgagacgtaccagacccgcgagggcttcacctccatctgcctgttcatgctcgggagcatcctgttcatcgtgtcctgcctggtcaagggcctcgtgtacagcgtgtccgacagcttcttccccgggctgtccgtctgcaagacctgcagcatcggctccatcaacggcttcgagatcgagagccacaagtgctactgctccctgttctgctgcccgtactgccggcactgcagcgcggaccgcgagatccaccagctccacctgtccatctgcaagaagcggaagacggggagcaacgtgatgctggccgtgtgcaagcgcatgtgcttcaaggccaccatcgaggccagccggcgcgcgctcctgatccgctccatcatcaacaccaccttcgtcatctgcatcctgacgctcgccatctgcgtggtgagcacctccgccgtcgagatggaggacctgcccgccggcacctgggagcgggaggaggacctgaccaacttctgccaccaggagtgccaggtgacggagaccgagtgcctctgcccctacgaggccctggtgctgcgcaagcccctcttcctggacagcatcgtcaaggggatgaagaagctgctcaactccaccagcctggagacctccctgagcatcgaggcgccgtggggcgccatcaacgtgcagtccacgttcaagcccaccgtgagcaccgccaacatcgccctctcctggagctccgtcgagcaccgggggaacaagatcctggtgaccggccgcagcgagtccatcatgaagctggaggagcggacgggcgtgagctgggacctcggggtcgaggacgcctccgagagcaagctgctgaccgtgtccatcatggacctcagccagatgtacagccccgtgttcgagtacctgtccggcgaccgccaggtcgaggagtggcccaaggcgacctgcaccggggactgcccggagcggtgcggctgcacgagctccacctgcctgcacaaggagtggccccacagccgcaactggcggtgcaaccccacctggtgctggggggtgggcaccggctgcacgtgctgcggggtggacgtcaaggacctcttcaccgaccacatgttcatcaagtggaaggtggagtacatcaagaccgaggccatcgtgtgcgtcgagctgacctcccaggagcgccagtgcagcctgatcgaggccggcacccggttcaacctcgggcccgtgacgatcaccctgtccgagccgcgcaacatccagcagaagctgccccccgagatcatcaccctccaccccaagatcgaggagggcttcttcgacctgatgcacgtgcagaaggtcctgagcgcctccaccgtgtgcaagctccagagctgcacgcacggcatcccgggggacctgcagatctaccacatcggcaacctgctcaagggggaccgggtcaacggccacctgatccacaagatcgagccccacttcaacacctcctggatgagctgggacgggtgcgacctggactactactgcaacatgggcgactggccctcctgcacctacaccggcgtgacgcagcacaaccacgccgcgttcgtgaacctcctgaacatcgagaccgactacaccaagaccttccacttccacagcaagcgcgtcacggcccacggggacaccccccagctggacctcaaggcccggccgacctacggcgccggggagatcaccgtgctggtggaggtcgcggacatggagctgcacacgaagaaggtggagatctccggcctcaagttcgccagcctgacctgcaccgggtgctacgcctgctccagcggcatctcctgcaaggtgcgcatccacgtcgacgagcccgacgagctgaccgtgcacgtgaagagcagcgaccccgacgtcgtggccgcctccacgagcctcatggcgcggaagctggagttcggcaccgactccaccttcaaggccttcagcgccatgcccaagacctccctgtgcttctacatcgtggagcgcgagtactgcaagagctgctccgaggacgacacgaagaagtgcgtcgacaccaagctcgagcagccgcagagcatcctgatcgagcacaaggggaccatcatcggcaagcagaacgacacctgcacggccaaggcctcctgctggctggagagcgtgaagtccttcttctacgggctcaagaacatgctgggcagcgtgttcgggtccttcttcgtcggcatcctgctcttcctggcgcccttcgtgctgctggtgctcttcttcatgttcggctggaagatcctgttctgcttcaagtgctgccggcgcacccgggggctgttcaagtaccgccacctcaaggacgacgaggagaccggctaccgccggatcatcgagcgcctgaacagcaagaaggggaagaaccggctgctcgacggcgagcgcctggccgaccggaagatcgccgagctgttctccaccaagacgcacatcggctga

SEQ ID NO: 11956 - RNA, 5067 nt, synthetic construct
  misc_feature 1..5067: note = derived and/or modified CDS sequence (opt1) from CCHFV(K229_243)__KX013466.1__GP
  source 1..5067: mol_type = other RNA
atgcccaccaacatcatgcacaccctgctcgtgtgcttcatcctgtacctgcagctcctgggcctcggcggggcccaggggcagagcaacgccaccgagcacaacgagaccaacaccaccaccgccccctccaccagccagtcccccaagccgcccgtgagcaccaccccgccccacgccctcgagtccagcacgatcaagcccaccacccccgcccgcgagaccgaggggtccggggagaccacgccgccgcccaacaccacccagggccccagcccgcccgaggccacccccgagcggcccgccaccaccgcgacctccacgcccagcaccgacaacaccaactccaccacgcacgtgaccgacaacaaccccaccagcaccatctccacgagcccctccagctcccccagcacccccttcacgccccagggcatccaccaccccgcccgcaacctgctgtccgtgagcagccccaagaccgccacgaccccgacccccaccagcccccgcgagctcagctccgagacgagctccctgcacagcgccatctcccgcaccagcaccctgtacaccgcgacccaggtgtccacggagaacgccaaccacagcgcgccccggcagtccgagagctccgcccagccgaccaccaccagccccatgacgtcccccgcccagagcatcctcgtgatgtccgcggccccgaccgccatccagaacatccaccccagccccaccaaccgctccaagcggaacctggagatggagatcatcctgaccctcagccaggggctgaagaagtactacggcaagatcctgaagctcctgcacctgacgctcgaggaggacaccgaggggctgctggagtggtgcaagcgcaacctcggcagcaactgcgacgacgacttcttccagaagcggatcgaggagttcttcatgaccggggagggctacttcaacgaggtgctgcagttcaagaccctgtccacgctcagccccaccgagccgtcccacgcccggccgcccgccgtcgagcccttcaagagctacttcgcgaagggcttcctgtccatcgacagcgggtacttctccgccaagtgctacccgcggagctccaccagcggcctgcagctcatcaacgtgacccagcaccccgcccgcatcgccgagacgcccgggcccaagaccacctccctgaagaccatcaactgcatcaacctgcgggccagcgtgttcaaggagcaccgcgagatcgagatcaacgtcctcctgccgcagatcgcggtgaacctgtccaactgccacgtggtcatcaacagccacgtgtgcgactactccctcgacacggacggccccgtgcggctgccccacatctaccacgagggcaccttcatccccgggacctacaagatcgtcatcgacaagaagaacaagctgaacgaccgctgcaccctcgtgacgaactgcgtgatcaagggccgggaggtccgcaaggggcagagcgtgctgcggcagtacaagaccgagatcaagatcggcaaggcctccaccgggagccgcaagctgctcagcgaggagccgggcgacgactgcatctcccggacccagctgctgcgcacggagaccgccgagatccacgacgacaactacggcgggcccggcgacaagatcaccatctgcaacgggagcaccatcgtggaccagcgcctcggctccgagctggggtgctacacgatcaaccgggtcaagagcttcaagctgtgcgagaactccgccaccggcaagacctgcgagatcgacagcacccccgtgaagtgccgccagggcttctgcctcaagatcacgcaggaggggcggggccacgtgaagctgtcccgcgggagcgaggtcgtgctggacgcctgcgactccagctgcgaggtcatgatccccaagggcaccggggacatcctggtggactgctccggcggccagcagcacttcctcaaggacaacctgatcgacctggggtgcccgcacatccccctcctgggcaagatggcgatctacatctgccggatgagcaaccacccccgcaccaccatggccttcctgttctggttctccttcgggtacgtgatcacgtgcatcttctgcaaggccctcttctacagcctgatcatcatcggcacgctgggcaagaagatcaagcagtaccgggagctcaagccccagacctgcaccatctgcgagaccgccccggtcaacgcgatcgacgccgagatgcacgacctgaactgctcctacaacatctgcccctactgcgccagccgcctgacgtccgacgggctcgcccggcacgtgccccagtgcccgaagcgcaaggagaaggtggaggagaccgagctgtacctgaacctcgagcggatcccctggatcgtccgcaagctgctccaggtgagcgagtccaccggcgtggccctcaagcggagcagctggctgatcgtcctgctcgtgctgctgaccgtgtccctcagccccgtccagtccgcgcccgtggggcacggcaagacgatcgagacctaccagacccgcgaggggttcaccagcatctgcctgttcatgctgggctccatcctcttcctggtgagctgcctggtcaagggcctcgtggactccgtgagcgactccttcttcccggggctgagcgtctgcaagacgtgctccatcggcagcatcaacgggttcgagatcgagtcccacaagtgctactgcagcctgttctgctgcccctactgccggcactgctccgccgaccgcgagatccaccagctccacctgagcatctgcaagaagcggaagaccggctccaacgtgatgctggccgtgtgcaagcgcatgtgcttccgggccaccatcgaggccagccgccgcgcgctcctgatccggtccatcatcaacaccacgttcgtcatctgcatcctgaccctcaccatctgcgtggtgagcaccagcgccgtcgagatggagaacctgcccgccgggacgtgggagcgcgaggaggacctgaccaacttctgccaccaggagtgccaggtgaccgagaccgagtgcctctgcccctacgaggccctggtgctgcggaagcccctgttcctggactccatcgtcaagggcatgaagaacctgctcaacagcacgtccctggagaccagcctgtccatcgaggccccctggggcgcgatcaacgtgcagagcaccttcaagcccaccgtgtccacggccaacatcgccctcagctggtccagcgtcgagcaccgcgggaacaagatcctggtgaccggccggtccgagagcatcatgaagctggaggagcgcaccggggtgtcctgggacctcggcgtcgaggacgccagcgagtccaagctgctgaccgtgagcatcatggacctctcccagatgtacagccccgtgttcgagtacctgtccggggaccggcaggtcgaggagtggccgaaggcgacgtgcaccggcgactgccccgagcgctgcggctgcaccagctccacgtgcctgcacaaggagtggccccactcccggaactggcgctgcaaccccacctggtgctggggcgtgggcaccgggtgcacgtgctgcggcgtggacgtcaaggacctcttcaccgaccacatgttcgtgaagtggaaggtggagtacatcaagaccgaggccatcgtctgcgtggagctgacgagccaggagcggcagtgctccctgatcgaggccgggacccgcttcaacctcggcccggtgaccatcaccctgagcgagccccggaacatccagcagaagctgccgcccgagatcatcacgctccacccgaaggtcgaggagggcttcttcgacctgatgcacgtgcagaaggtgctgtccgccagcaccgtctgcaagctccagtcctgcacccacgggatccccggcgacctccaggtgtaccacatcgggaacctgctcaagggcgaccgcgtgaacggccacctgatccacaagatcgagccccacttcaacaccagctggatgtcctgggacgggtgcgacctggactactactgcaacatgggcgactggcccagctgcacgtacaccggggtcacccagcacaaccacgccgcgttcgtgaacctcctgaacatcgagaccgactacacgaagaccttccacttccactccaagcgggtcaccgcccacggcgacaccccgcagctggacctcaaggcccgccccacgtacggggccggcgagatcaccgtgctggtggaggtcgccgacatggagctgcacaccaagaaggtggagatcagcggcctcaagttcgcgtccctggcctgcaccgggtgctacgcctgcagctccggcatcagctgcaaggtgcggatccacgtcgacgagcccgacgagctgacggtgcacgtgaagtccagcgaccccgacgtcgtggccgcctccaccagcctcatggcgcgcaagctggagttcgggaccgacagcaccttcaaggccttctccgccatgccgaagacgagcctgtgcttctacatcgtggagaaggagtactgcaagtcctgcagcgaggaggacacccagaagtgcgtcgacaccaagctcgagcagccccagtccatcctgatcgagcacaagggcaccatcatcgggaagcagaacgacacgtgcaccgccaaggcgagctgctggctggagtccgtcaagagcttcttctacggcctcaagaacatgctgggctccgtgttcgggaacttcttcatcggcatcctcctgttcctgacccccttcgtcctgctggtcctgttcttcatgttcgggtggaagatcctgttctgcttcaagtgctgccggcgcacccggggcctgctcaagtaccgccacctgaaggacgacgaggagacggggtaccgccggatcatcgagcgcctgaacaacaagaagggcaagaaccggctcctggacggcgagcgcctggccgaccggaagatcgccgagctgttcagcaccaagacccacatcgggtga

SEQ ID NO: 11957 - RNA, 5067 nt, synthetic construct
  misc_feature 1..5067: note = derived and/or modified CDS sequence (opt1) from CCHFV(K229_194)__KX013463.1__GP
  source 1..5067: mol_type = other RNA
atgcccatcaacatcatgcacaccctgctcgtgtgcttcatcctgtacctgcagctcagcggcctcgggggcgcccacgggcagtccaacgccaccgagcacaacggcacgaacaccaccaccgtcccggggacgagccagtcccccaagccgcccgcgagcaccaccctgccccacacccccgagtccagcacggtgaagctgaccacccccacctccgagacggagggcagcggcgagaccacgcccccgcccaacaccacccaggggctgcccccgcccggcaccacccccgagcgccccgccaccacggccacctccaccagctccaccgacaacatgaacagcacgacccaggtgaccgacaacacccccatctccacggtcagcatctccccgagctccagcccctccatgcccagcaccagccaggggatccactaccccgtgcggtccctgctcagcgtgtccagcccgaagaccgtcaccacgcccacccccatgtcccccggcgagatgagcccggagacctccagccagcactccgccatgagccgcatccccaccctgtacacggccacccaggtgtccaccgagaacaccaaccggagcacgccccgccagtccgagagctccgcgcagcccgccacccagagcccgaccacctcccccacccagacgatcctgctcatgagcgccgcccccaaggcgatccaggacatgcacccgtcccccaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgaacaccctcagccccacggagccctcccacgtgcggctgccgaccgccgagcccttcaagagctacttcgccaagggcttcctgtccgtggacagcggctacttctccgccaagtgctacccccgcagctccaccagcgggctccagctgatcaacgtcacccagcaccccgcccggatcgcggagacgccgggccccaagaccacctccctgaagaccatcaactgcatcaacctccgcgccagcgtgttcaaggagcaccgggaggtggagatcaacgtcctgctgccccagatcgccgtgaacctctccaactgccacgtggtcatcaacagccacgtgtgcgactactccctggacacggacgggcccgtgcgcctgccgcggatccaccacgagggcaccttcatccccgggacctacaagatcgtcatcgacaagaagaacaagctcaacgaccgctgcagcctggtgaccaactgcgtgatcaagggccgggaggtccgcaagggccagtccgtgctgcggcagtacaagacggagatcaagatcgggaaggccagcaccggcagccgcaagctcctgtccgaggagcccggggacgactgcatcagccggacccagctgctcaagaccgagacggccgagatccacgacgacaactacggcgggcccggcgacaagatcaccatctgcaacggctccaccatcgtcgaccagcgcctcgggagcgagctgggctgctacaccatcaaccgcgtgaagtccttcaagctctgcgagaacagcgcgacggggaagacctgcgagatcgactccaccccggtgaagtgccggcagggcttctgcctgaagatcacccaggaggggcgcggccacgtcaagctgagccggggctccgaggtggtgctggacgcctgcgacagctcctgcgagatcatgatccccaaggggacgggcgacatcctcgtcgactgcagcgggggccagcagcacttcctgaagggcaacctgatcgacctcgggtgcccccacatccccctgctgggcaagatggccatctacatctgccgcatgtccaaccacccgcggaccaccatggccttcctcttctggttcagcttcgggtacgtgatcacgtgcatcttctgcaaggccctgttctactccctgatcatcatcggcaccctcgggaagaagatcaagcagtaccgcgagctgaagccccagacctgcaccatctgcgagaccgcgcccgtgaacgccatcgacgccgagatgcacgacctgaactgcagctacaacatctgcccctactgcgcctcccggctcaccagcgacggcctggcccgccacgtcacgcagtgcccgaagcggaaggagaaggtggaggagaccgagctgtacctcaacctggagcgcatcccctggatcgtgcggaagctgctccaggtctccgagagcaccggcgtggcgctgaagcgcagctcctggctgatcgtgctcctggtcctgctcaccgtgagcctgtcccccgtgcagagcgccccggtcgggcacggcaagacgatcgagacctaccagacccgggaggggttcaccaacatctgcctgttcatgctcggctccatcctgttcatcgtgagctgcctggtgaaggggctcgtcgactccgtgagcgactccttcttccccggcctgagcgtgtgcaagacgtgctccatcggcagcatcaacgggttcgagatcgagtcccacaagtgctactgcagcctgttctgctgcccctactgccgccactgctccgccgaccgggagatccaccagctccacctgggcatctgcaagaagcgcaagaccgggagcaacgtcatgctggccgtgtgcaagcggatgtgcttcaaggcgaccatcgaggcctcccgccgggccctcctgatccgcagcatcatcaacaccacgttcgtgatctgcatcctgaccctcgccatctgcgtcgtgtccaccagcgccgtggagatggagaacctgcccgcgggcacctgggagcgcgaggaggacctgacgagcttctgccaccaggagtgccaggtcaccgagaccgagtgcctctgcccgtacgaggccctggtgctgcggaagcccctcttcctggactccatcgtgaaggggaagaagaacctgctcaacagcacctccctggagacgagcctgtccatcgaggccccctggggcgccatcaacgtccagagcaccttcaagcccaccgtgtccaccgccaacatcgcgctcagctggtccagcgtggagcaccgcggcaacaagatcctggtcacggggcggtccgagagcatcatgaagctggaggagcgcaccggcgtgtcctgggacctcggggtggaggacgccagcgagtccaagctgctgaccgtcagcatcatggacctctcccagatgtacagcccggtgttcgagtacctgtccggcgaccgccaggtggaggagtggcccaaggcgacctgcacgggggactgccccgagcggtgcggctgcaccagctccacgtgcctgcacaaggagtggccccacagccggaactggcgctgcaacccgacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgaccagccaggagcggcagtgctccctgatcgaggccggcacccgcttcaacctcggccccgtcaccatcaccctgagcgagccccggaacatccagcagaagctgcccccggagatcatcaccctccaccccaagatcgaggaggggttcttcgacctgatgcacgtgcagaaggtgctgtccgccagcacggtctgcaagctccagtcctgcacccacggcatccccggggacctgcagatctaccacatcggcaacctgctcaagggggaccgcctgaacggccacctgatccacaagatcgagccccacttcaacaccagctggatgtcctgggacggctgcgacctcgactactactgcaacatgggggactggccgagctgcacctacacgggcgtgacccagcacaaccacgccgccttcgtcaacctgctgaacatcgagaccgactacaccaagacgttccacttccactccaagcgggtgaccgcccacggggacacgccccagctcgacctgaaggcgcgccccacctacggcgccggggagatcaccgtgctggtcgaggtggccgacatggagctccacaccaagaaggtggagatcagcggcctgaagttcgcctccctggcctgcaccggctgctacagctgctccagcgggatctcctgcaaggtccggatccacgtggacgagcccgacgagctcaccgtgcacgtcaagagctccgacccggacgtggtggcggccagcacgagcctgatggcccgcaagctggagttcggcaccgactccaccttcaaggccttcagcgccatgcccaagacctccctctgcttctacatcgtcgagcgggagtactgcaagagctgctccgaggacgacacgaagaagtgcgtggacaccaagctggagcagccccagagcatcctgatcgagcacaaggggaccatcatcggcaagcagaacgacacgtgcaccgcgaaggcctcctgctggctcgagagcgtgaagtccttcttctacgggctgaagaacatgctgggcagcgtcttcggcaacttcttcgtggggatcctcctgttcctggcccccttcgtgctgctcgtcctgttcttcatgttcggctggaagatcctgttctgcttcaagtgctgccgccggacccgcggcctcttcaagtaccggcacctgaaggacgacgaggagaccgggtaccgcaagatcatcgagcgcctgaactccaagaagggcaagaaccggctcctggacggggagcgcctggccgaccggaagatcgccgagctgttcagcaccaagacgcacatcggctga

SEQ ID NO: 11958 - RNA, 5067 nt, synthetic construct
  misc_feature 1..5067: note = derived and/or modified CDS sequence (opt1) from CCHFV(Gaib)__KX013445.1__GP
  source 1..5067: mol_type = other RNA
atgcccgtgagcatcatgtacatcccgctggtctacgccgtgatctacctccagctgtacggcctcgggggcgcccacgggctcctgaacaagaccgagcagaacgagaccggcatcacggcgacccacgggcgcgtgcagggcccgccctccgccagcatcaccctgcccgtcacccccgaccccctctccgccacgagcgccgcctccaccagcggccccgaggggtccggcgaggtgcccaccagcccgtccaccatcacgcaggggctgaccagctccgagaacacgccccagctgcccaccgcgaccgacaccggcatcagctccaccagcatcatcgacgtgtccacccagacggccggggacaccagcacccccaccgcccacacgtccctcccgaacagcccctccgcccccttcaccagccaggacacccggcacaccgtccgcggcctgctgacggtgaccagcaccaagtccgacgaggcgagcaccctcacggaccccaaggaggcctccaccgaggcccggagcccgtcccccagcatctcccgcacccccacccccagcccgacggtgcaggcctccaccgagaacaacacccccagcacgccccggcagcccgagccgaccacccgccccgccctgccctcccccaccaccagcccgacccagccctccctgagccagtccgcgacgagcgccgccatccaggacatgcacccctccccgaccaaccggagccgccggaacctcgagatggagatcatcctgaccctgtcccagggcctcaagaagtactacgggaagatcctgaagctgctcgacctgaccctggaggaggacacggagggcctcctggagtggtgcaagcgcaacctggacctgacctgcgacgagaacttcttcctgaagcggatcgaggagttcttcctgagcggggagggccacttcaacgaggtcctccagttcaaggcccccagcaccatgtccagcaccgagcccacgcacgccgggcccccgaccgtggagcccttcaagtcctacttcgcgaagggcttcctgagcatcgactccggctacttcagcgccaagtgctacccccgcacctccaacagcgggctgcagctcatcaacgtgacccagcacacggcccggatcgccgacacccccggcccgaagatcaccaacgtcaagaccatcaactgcatcaacctgaaggcctccgtgttcaagaagcaccgcgaggtggagatcaacgtcctgctcccccagatcgcggtgaacctgagcaactgccacgtgctgatcaagtcccacgtctgcgactacagcctcaacttcgacgggatggtgcggctgccccgcatccaccacgagggcacgttcatccccggcacctacaagatcgtgatcgaccggaagaacaagcagaacgaccgctgcaccctggtcaccaactgcgtgatcaaggggcgggaggtgcgcaagggccagtccgccctccggcagtaccgcacggagatcaagatcggggaggccagcatcggctcccgccggctgctgagcgaggagtccagcgacgactgcatcagccgcacccagctcctgcggaccgagaccgccgagatccacaacgacaactacgggggcccgggcgacaagatcacgatctgcaacgggtccaccatcgtcgaccagcgcctgggcagcgagctcgggtgctacaccatcaaccgggtgaagtccttcaagctgtgcgagaacagcgccaccggcaagtcctgcgagatcgacagcatccccgtcaagtgccgccaggggttctgcctgaagatcacgcaggagggccggggccacgtgaagctgtcccgcgggagcgaggtggtcctcgacgcgtgcgactccagctgcgagatcatgatccccaagggcaccggggacatcctggtggactgctccggcggccagcagcacttcctgaaggacaacctcatcgacctggggtgccccaacatcccgctgctcggcaagatggccatctacatctgccggatgagcaaccaccccaagaccaccatggccttcctgttctggttctccttcgggtacgtgatcacgtgcatcttctgcaaggccatcttctacctgctcatcatcgtcggcaccctggggaagaagttcaagcagtaccgcgagctgaagccccagacctgcaccatctgcgagacgacccccgtgaacgcgatcgacgccgagatgcacgacctcaactgcagctacaacatctgcccgtactgcgcctcccggctgaccagcgacggcctggcccgccacgtggtccactgccccaagcggaaggagaagatcgaggagaccgagctctacctgaacctggagcgcgtgccctgggtggtccggaagctcctccaggtgtccgagagcaccggcgtggccctgaagcgctccagctggctcatcgtcctgctggtgctcctgacggtgagcctgtcccccgtccagagcgcgccgatcgggcacggcaagaccatcgagacctaccagacccgggaggggtacacgtccatctgcctcttcgtgctgggcgggatcctgttcatcgtgagctgcctcatgaagggcctggtcgactccgtgggcaacaacttcttccccgggctgaccatctgcaagacctgcagcatctccagcatcaacggcttcgagatcgagtcccacaagtgctactgcagcctcctgtgctgcccctactgccgccactgctccgccgaccgggagatccaccagctgcacctcagcatctgcaagaagcgcaagaccgggtccaacgtgatgctggccgtctgcaagcgcatgtgcctgcgggtgacgaccgaggtgagcaaccgcgccctcttcatccggtccatcatcaacaccaccttcgtcatctgcatcctgatcctggccgtgtgcgtgatcagcacgtccgcggtcgagatggagaacctcccggccggcacctgggagcgcgaggaggacctgaccaacttctgccaccaggagtgccaggtgaccgagacggagtgcctgtgcccctacgaggccctcgtgctgcggaagcccctgttcagcgactccatcgtcaaggggatgaagaacctcctgaacagcaccagcctggagacctccctcagcatcgaggccccctggggcgccatcaacgtgcagtccaccttcaagccgacggtgagcaccgcgaacatcgccctgtcctggagctccatcgagcaccgcggcaacaagatcctggtcagcgggcggtccgagagcatcatgaagctcgaggagcgcaccggcatctcctgggacctgggggtggaggacgccagcgagtcccggctgctcaccgtgagcgtcatggacctgtcccagatgtacagccccgtgttcgagtacctgtccggcgaccgccaggtggaggagtggcccaaggccacgtgcaccggggactgccccgagcggtgcggctgcaccagctccacgtgcctccacaaggagtggccgcacagccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcgccagtgctccctgatcgaggccggcacccggttcaacctgggccccgtcaccatcacgctcagcgagccccgcaacatccagcagaagctgccgcccgagatcatcaccctgcacccccggatcgaggaggggttcttcgacctcatgcacgtgcagaaggtgctgtccgccagcaccgtctgcaagctgcagtcctgcacccacggcgtgcccggggacctccaggtctaccacatcggcaacctgctgaagggggacaaggtgaacggccacctcatccacaagatcgagccgcacttcaacaccagctggatgtcctgggacggctgcgacctggactactactgcaacatgggggactggcccagctgcacgtacaccggcgtgacccagcacaaccacgccgccttcgtcaacctgctcaacatcgagaccgactacacgaagaacttccacttccactccaagcgcgtgaccgcgcacggggacacgccccagctggacctgaaggcccggcccacctacggcgccggggagatcaccgtgctcgtcgaggtggccgacatggagctgcacaccaagaagatcgagatcagcggcctgaagttcgcctccctgacctgcaccggctgctacgcgtgcagctccgggatcagctgcaaggtgcgcatccacgtcgacgagccggacgagctgacggtgcacgtgaagtccgaggaccccgacatcgtcgccgccagctccagcctgatggcccggaagctcgagttcggcaccgactccaccttcaaggccttcagcgcgatgcccaagaccagcctgtgcttctacatcgtggagcgcgagtactgcaagtcctgcagccgcgaggacacgcagaagtgcgtgtccaccaagctggagcagccccagagcatcctcatcgagcacaaggggaccatcatcggcaagcagaacaacacgtgcaccaccaagacgacctgctggctggagtccgtcaagagcttcttctacgggctgaagaacatgctctccagcatcttcggcaacgtgttcgtgggcatcttctccttcctggccccgttcatcctgctgatcctcttcttcatgttcgggtggcggatcctgttctgcttcaagtgctgccgccggacccgcggcctgttcaagtaccggcacctcaaggacgacgaggagaccgggtaccgccggatcatcgagcgcctgaacaacaagaagggcaagagcaagctgctcgacggcgagcggctggccgaccgcaagatcgccgagctgttctccaccaagacccacatcgggtga

SEQ ID NO: 11959 - RNA, 5067 nt, synthetic construct
  misc_feature 1..5067: note = derived and/or modified CDS sequence (opt1) from CCHFV(Kosova Hoti)__EU037902.1__GP
  source 1..5067: mol_type = other RNA
atgcccatcaacatcatgcacaccctgctcgtgtgcttcatcctgtacctgcagctcctgggcctggggggcgcccacgggcagagcaacgccaccgagcacaacggcacgaacaccaccaccgcgccggggacgtcccagagccccaagccccccgcctccaccaccccgagccacgcccccgagccctccaccatcaagctcacgacccccaccagcgagaccgagggctccggcgagacgaccccgcccaccaacaccacgcaggacagcccccccctggagaccaccccggagcgctccgccaccacggccaccagcacctccgggaccgacaacatgaacagcacgacccagatgaccgacaacacccccacgtccaccgtcagcacctccctgagctccagcccctccacccccagcacgagccagggcatgcaccacccggtgcggtccctcctgagcgtgtccagccccaagaccgcgaccacccccacgcccatgtccccgggggagatgagctccgagaccagctcccagcacagcgccatgtcccgcacccccaccccccacaccgccacgcaggtcagcaccgagaacgccaaccggtccaccagccgccagtccgagagctccgcgcagcccgccacccagagcccggtgacgtcccccgcccagagcatcctgctcatgagcgccacccccaccaccatccagaacatccacccctccccgacgaaccggagcaagcgcaacctggagatggagatcatcctgaccctctcccagggcctgaagaagtactacgggaagatcctgaagctcctgcacctgaccctcgaggaggacaccgagggcctgctggagtggtgcaagcggaacctcggcagcaactgcgacgacgacttcttccagaagcgcatcgaggagttcttcatcacgggggagggctacttcaacgaggtgctgcagttcaagaccctgtccacccccagctccaccgagcccagccacgcccggctcccgacggcggagcccttcaagtcctacttcgccaaggggttcctgagcatcgactccggctacttcagcgccaagtgctacccccgctccagcacctccggcctgcagctcatcaacgtcacccagcaccccgcccggatcgccgagaccccggggcccaagacgaccagcctgaagaccatcaactgcatcaacctgcgcgcgtccgtgttcaaggagcaccgggaggtggagatcaacgtcctcctgccccagatcgccgtgaacctgagcaactgccacgtggtcatcaacagccacgtgtgcgactactccctcgacaccgacggccccgtgcgcctgccgcggatctaccacgaggggacgttcatgcccggcacctacaagatcgtcatcgaccgcaagaacaagctgaacgaccggtgcaccctcgtgaccaactgcgtgatcaaggggcgcgaggtccggaagggccagagcgtgctgcgccagtacaagacggagatcaagatcggcaaggcccccaccgggtcccggaagctgctcagcgaggagcccggcgacgactgcatctcccgcacccagctgctgcgcaccgagacggccgagatccacgacgacaactacgggggcccgggggacaagatcaccatctgcaacggcagcaccatcgtggaccagcggctcggctccgagctggggtgctacaccatcaaccgcgtcaagagcttcaagctgtgcgagaactccgccacgggcaagacctgcgagatcgacagcacccccgtgaagtgccggcaggggttctgcctcaagatcacccagaagggccgcgggcacgtgaagctgtcccggggcagcgaggtcgtgctggacgcgtgcgactccaactgcgaggtcatgatccccaagggcaccggggacatcctggtggactgcagcggcgggcagcagcacttcctcaaggacaacctgatcgacctgggctgcccccacatcccgctcctgggcaagatggccatctacatctgccgcatgtccaaccaccccaagacgaccatggccttcctgttctggttcagcttcgggtacgtgatcacctgcatcttctgcaaggccctcttctactccctgatcatcatcggcaccctggggaagaagatcaagcagtaccgggagctcaagccccagacgtgcaccatctgcgagaccgcccccgtcaacgcgatcgacgccgagatgcacgacctgaactgcagctacaacatctgcccgtactgcgcctcccgcctgaccagcgacggcctcgcccggcacgtgaagcagtgccccaagcgcaaggagaaggtggaggagacggagctgtacctgaacctcgagcggatcccctgggtcgtgcgcaagctgctgcaggtgagcgagtccaccggggtcgcgctcaagcggagctcctggctgatcgtgctgctcgtgctgctgaccgtcagcctctcccccgtgcagagcgccccggtgggccacggcaagaccatcgagacgtaccagacccgcgaggggttcacctccatctgcctgttcatgctgggcagcatcctcttcatcgtctcctgcctggtgaaggggctggtggacagcgtctccgacagcttcttccccggcctctccgtgtgcaagacctgcagcatcgggtccatcaacggcttcgagatcgagagccacaagtgctactgctccctgttctgctgcccctactgccggcactgcagcgccgaccgcgagatccaccagctgcacctcaacatctgcaagaagcggaagacgggctccaacgtgatgctggccgtctgcaagcgcatgtgcttccgggccaccatcgaggcgagccgccgcgccctgctcatccggagcatcatcaacaccaccttcgtgatctgcatcctgacgctgaccatctgcgtggtctccaccagcgccgtggagatggagaacctcccggccgggacctgggagcgcgaggaggacctgacgaacttctgccaccaggagtgccaggtgaccgagaccgagtgcctgtgcccctacgaggccctcgtcctgcggaagcccctgttcctcgactccatcgtgaagggcatgaagaacctgctgaacagcacctccctcgagacgagcctgtccatcgaggcgccctggggggccatcaacgtgcagagcaccttcaagccgaccgtctccaccgccaacatcgccctgagctggtccagcgtggagcaccgcggcaacaagatcctcgtgacggggcggtccgagagcatcatgaagctggaggagcgcaccggcatctcctgggacctgggcgtcgaggacgccagcgagtccaagctcctgaccgtgagcatcatggacctgtcccagatgtacagccccgtgttcgagtacctcagcggggaccggcaggtcgaggagtggcccaaggcgacctgcacgggcgactgcccccagcgctgcgggtgcacctccagcacctgcctgcacaaggagtggccgcactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctcaccagccaggagcggcagtgctccctgatcgaggccgggacgcgcttcaacctgggccccgtgaccatcaccctcagcgagccccggaacatccagcagaagctgccgcccgagatcatcaccctgcaccccaagatcgaggaggggttcttcgacctcatgcacgtccagaaggtgctgtccgccagcacggtgtgcaagctgcagtcctgcacccacggcatccccggcgacctccaggtctaccacatcgggaacctgctgaagggcgaccgcgtgaacgggcacctcatccacaagatcgagccgcacttcaacaccagctggatgtcctgggacggctgcgacctggactactactgcaacatgggggactggcccagctgcacctacacgggcgtgacccagcacaaccacgcggccttcgtcaacctgctcaacatcgagaccgactacaccaagacgttccacttccactccaagcgggtgaccgcccacggcgacaccccccagctggacctgaaggcccgccccacctacggggccggcgagatcacggtcctcgtggaggtggcggacatggagctgcacaccaagaaggtcgagatcagcgggctgaagttcgcctccctcgcctgcaccggctgctacgcctgcagctccgggatcagctgcaaggtgcggatccacgtggacgagccggacgagctgaccgtccacgtgaagtccagcgaccccgacgtggtcgccgcgggcacgagcctgatggcccgcaagctcgagttcggcaccgactccaccttcaaggccttcagcgccatgcccaagacctccctgtgcttctacatcgtggagaaggagtactgcaagagctgctccgaggacgacacgaagaagtgcgtggacaccaagctggagcagccccagagcatcctcatcgagcaccgggggaccatcatcggcaagcagaacgacacctgcacggccaaggcgtcctgctggctggagagcgtcaagtccttcttctacgggctgaagaacatgctcggcagcgtgttcgggaacttcttcatcggcatcctgctgttcctcgccccgttcgtgctgctggtcctgttcttcatgttcggctggaagatcctcttctgcttcaagtgctgccgccggacccgcgggctgttcaagtaccgccacctgaaggacgacgaggagaccggctaccggcgcatcatcgagcggctcaacaacaagaaggggaagaaccgcctgctggacggcgagcggctcgccgaccgcaagatcgccgagctgttctccaccaagacgcacatcggctga

SEQ ID NO: 11960 - RNA, 5067 nt, synthetic construct
  misc_feature 1..5067: note = derived and/or modified CDS sequence (opt1) from CCHFV(Turkey200310849)__DQ211636.1__GP
  source 1..5067: mol_type = other RNA
atgcccaccaacatcatgcacaccctgctcgtgtgcttcatcctgtacctgcagctcctgtgcctgggcggggcccacggccagctcaacacgaccgagcacaacgggaccaacaacaccacggccccgggcgcgagccagtcccccaagccgcccatgagcaccaccccgccccacgcccccgagtccagcaccatcaagcccacgacccccatctccgaggccgaggggagcggcgagaccacctccacgcccaacaccacccagggcctgagctcccccgagaccacgagcgagcgccccgccaccaccgccatctccaccagctccacggacagcaccaacccgaccacccagatgacggacaacacccccaccctgaccgtctccacgagcccctccagctcccccagcaccccgagcacgccccaggggatctaccaccccgcgcggtccctcctgagcgtgtccagccccaagaccgtgaccaccccgacccccacctcccccggcgagatgagctccgagacgagctcccagcacagcgccatgtcccgcatccccaccccgcacaccgccacccgggtcagcaccgagaacacgaaccactccacgccccgccagagcgagtccagcgcccagcagaccaccccctcccccatgaccagcccggcgcagtccatcctgctcatgagcgccgcccccaccgccgtgcaggacatccaccccagcccgaccaaccggtccaagcgcaacctggagaccgagatcatcctgacgctcagccaggggctgaagaagtactacggcaagatcctgaagctcctgcacctgaccctcgaggaggacaccgaggggctgctggagtggtgcaagcggaacctcggctccaactgcgacgacgacttcttccagaagcgcatcgaggagttcttcatgaccggcgaggggtacttcaacgaggtgctgcagttcaagacgctgagcaccctctcccccaccgagcccagccacgcccggctgcccaccgcggagccgttcaagtcctacttcgccaagggcttcctgagcatcgactccgggtacttcagcgccaagtgctacccccgctccagcgcctccggcctccagctgatcaacgtcacgcagcaccccgcccggatcgcggagacccccggcccgaagaccaccagcctgaagacgatcaactgcatcaacctccgcgcctccgtgttcaaggagcaccgggagatcgagatcaacgtgctgctgccccagatcgccgtcaacctcagcaactgccacgtggtgatcaactcccacgtctgcgactacagcctggacaccgacgggcccgtgcgcctgccccggatctaccacgagggcaccttcatcccggggacctacaagatcgtgatcgacaagaagaacaagctcaacgaccgctgcacgctggtcaccaactgcgtgatcaagggccgggaggtgcgcaaggggcagagcgtcctgcggcagtacaagaccgagatcaagatcggcaaggcctccaccggcttccgcaagctcctgagcgaggagcccggggacgactgcatctcccggacgcagctgctccgcaccgagaccgccgagatccacgacgacaactacggcgggcccggcgacaagatcaccatctgcaacgggagcacgatcgtggaccagcgcctgggctccgagctgggctgctacaccatcaaccgggtcaagagcttcaagctctgcgagaactccgcgaccgggaagacctgcgaggtggacagcacgcccgtgaagtgccgccagggcttctgcctgaagatcacccaggaggggcggggccacgtgaagctgtcccgcgggagcgaggtcgtgctggacgcctgcgactccagctgcgaggtcatgatcccgaagggcaccggcgacatcctcgtggactgctccgggggccagcagcacttcctgaaggacaacctgatcgacctcgggtgcccccacatccccctgctgggcaagatggccatctacatctgccggatgagcaaccacccccgcaccaccatggccttcctcttctggttctccttcggctacgtgatcacgtgcatcagctgcaaggccctgttctactccctgatcatcatcgggaccctcggcaagaagatcaagcagtaccgggagctgaagccgcagacctgcaccatctgcgagacggcgcccgtcaacgccatcgacgccgagatgcacgacctgaactgcagctacaacatctgcccctactgcgcctcccgcctcaccagcgacgggctggcgcggcacgtgacccagtgccccaagcgcaaggagaaggtggaggagaccgagctgtacctcaacctggagcggatcccgtggatcgtccgcaagctgctccaggtgagcgagtccacgggcgtggccctgaagcggagctcctggctgatcgtcctcctggtgctgctcaccgtgagcctgtcccccgtccagagcgcccccgtggggcacggcaagaccatcgagatctaccagacccgcgagggcttcgcctccatctgcctgttcatgctcgggagcatcctgttcatcgtgtcctgcctggtcaagggcctcgtggacagcgtgtccgacagcttcttcccggggctgtccgtctgcaagacgtgcagcatcggctccgtgaacgggttcgagatcgagagccacaagtgctactgctccctgttctgctgcccctactgccggcactgcagcgccgaccgcgagatccaccagctccacctgtccatctgcaagaagcggaagaccggcagcaacgtgatgctggcggtctgcaagcgcatgtgcttccgggccaccatcgaggccagccgccgcgccctcctgatccggtccatcatcaacaccacgttcgtgatctgcatcctgaccctcaccatctgcgtggtcagcacctccgccgtggagatggagaacctgcccgcgggcacgtgggagcgcgaggaggacctgaccaacttctgccaccaggagtgccaggtgaccgagaccgagtgcctctgcccctacgaggccctggtcctgcggaagcccctcttcctggacagcatcgtgaaggggatgaagaacctgctcaactccacgagcctggagacctccctgagcatcgaggccccgtggggcgccatcaacgtgcagtccaccttcaagcccgccgtcagcaccgcgaacatcgccctctcctggagctccgtggagcaccgcgggaacaagatcctggtgacgggccggagcgagtccatcatgaagctggaggagcgcaccggggtcagctgggacctcggcgtggaggacgcctccgagagcaagctgctgaccgtgtccatcatggacctcagccagatgtacagccccgtcttcgagtacctgtccggcgaccgccaggtggaggagtggccgaaggcgacctgcacgggggactgccccgagcggtgcggctgcaccagcagcacgtgcctgcacaaggagtggccccactcccggaactggcgctgcaaccccacctggtgctggggcgtggggaccgggtgcacgtgctgcggcgtcgacgtgaaggacctcttcaccgaccacatgttcgtgaagtggaaggtcgagtacatcaagaccgaggccatcgtgtgcgtggagctgacctcccaggagcggcagtgcagcctgatcgaggccggcacccgcttcaacctcgggccggtcaccatcaccctgtccgagccccggaacatccagcagaagctgccgcccgagatcatcaccctccaccccaagatcgaggagggcttcttcgacctgatgcacgtgcagaaggtgctgagcgcctccacggtctgcaagctccagagctgcacccacgggatccccggcgacctccaggtgtaccacatcggcaacctgctcaagggggaccgcgtgaacggccacctgatccacaagatcgagtcccacttcaacaccagctggatgtcctgggacgggtgcgacctggactactactgcaacatgggcgactggcccagctgcacctacacgggggtcacccagcacaaccacgccgccttcgtgaacctcctgaacatcgagaccgactacaccaagacgttccacttccactccaagcgggtcaccgcgcacggcgacacgccccagctggacctcaaggcccgcccgacctacggcgccggggagatcaccgtgctggtggaggtcgccgacatggagctgcacaccaagaaggtggagatcagcggcctcaagttcgcctccctggcgtgcaccgggtgctacgcctgcagctccggcatcagctgcaaggtgcggatccacgtcgacgagcccgacgagctgaccgtgcacgtcaagagctccgaccccgacgtggtggccgccagcacgtccctcatggcccgcaagctggagttcgggaccgacagcaccttcaaggcgttctccgccatgcccaagaccagcctgtgcttctacatcgtggagcgggagtactgcaagtcctgcagcgaggacgacacgcagaagtgcgtcgacacccgcctcgagcagccgcagtccatcctgatcgagcacaagggcaccatcatcggcaagcagaacgacacgtgcaccgccaaggccagctgctggctggagtccgtcaagagcttcttctacgggctcaagaacatgctgggctccgtgttcgggaacctgttcatcggcatcctcctgttcctggcgcccttcgtgctgctcgtgctgttcttcatgttcgggtggaagatcctgttctgcttcaagtgctgccggcgcacccgcggcctcttcaagtaccggcacctgaaggacgacgaggagaccggctaccgccggatcatcgagcgcctgaacagcaagaaggggaagaaccggctcctggacggcgaccgcctggccgaccggaagatcgccgagctgttctccaccaagacgcacatcgggtga

SEQ ID NO: 11961 - RNA, 5067 nt, synthetic construct
  misc_feature 1..5067: note = derived and/or modified CDS sequence (opt1) from CCHFV(Kashmanov)__DQ211631.1__GP
  source 1..5067: mol_type = other RNA
atgcccaccaacatcatgcacaccctgctcgtgtgcttcatcctgtacctgcagctcctgggcctcgggggcgcccacgggcagagcaacgccacggagcacaacggcaccaacaccaccacggcgccgtccaccagccagtcccccaagcccctggtcagcaccgcgcccccgcacgccctggagtccagcaccatcaagcccacgacccccgcctccgagaccgaggggagcggcgagaccacgcccccgcccaacaccacccagggcccctccccgcccgagaccacgcccgagcgccccgccaccaccgccaccagcacgccctccaccgacaacaccaacagcaccacgcacgtgaccgacaacaacccgacctccaccatcagcacgtcccccagctccagcccctccacccccagcaccccgcaggggatccaccaccccgcccggaacctgctcagcgtgtccagccccaagaccgccacgacccccaccccgacctcccccggcgagatcagctccgaggccagctccctgcacagcgcgatgtcccgcacgagcaccctgtacaccgccacccaggtctccaccgagaacgccaaccacagcgcgccccggcagtccgagagctccgcccagcccacgaccaccagcccgatgacctcccccgcccagagcatcctcgtgatgtccgccgcccccatcgccatccagaacatccacccgagccccacgaaccgcagcaagcggaacctggagatggagatcatcctgaccctctcccaggggctgaagaagtactacggcaagatcctgaagctcctgcacctgaccctcgaggaggacaccgaggggctgctggagtggtgcaagcgcaacctcggcagcaactgcgacgacgacttcttccagaagcggatcgaggagttcttcatgacgggcgaggggtacttcaacgaggtgctgcagttcaagaccctgtccaccctcagccccaccgagccctcccacgccggcccgcccacggtcgagcccttcaagagctacttcgcgaaggggttcctgtccatcgacagcggctacttctccgccaagtgctacccccgcagctccaccagcggcctgcagctcatcaacgtgacccagcacccggcccggatcgccgagacccccgggcccaagacgacctccctgaagaccatcaactgcatcaacctgcgcgccagcgtgttcaaggagcaccgggagatcgagatcaacgtcctcctgccccagatcgcggtgaacctgtccaactgccacgtggtcatcaacagccacgtgtgcgactactccctcgacaccgacggcccggtgcgcctgccccacatctaccacgaggggacgttcatccccggcacctacaagatcgtcatcgacaagaagaacaagctgaacgaccggtgcaccctcgtgaccaactgcgtgatcaaggggcgcgaggtccggaagggccagagcgtgctgcgccagtacaagacggagatcaagatcggcaaggccagcaccgggtcccggaagctgctcagcgaggagcccggcgacgactgcatctcccgcacccagctgctgcggaccgagacggccgagatccacgacgacaactacgggggcccgggggacaagatcaccatctgcaacggcagcaccatcgtggaccagcgcctcggctccgagctggggtgctacaccatcaaccgggtcaagagcttcaagctgtgcgagaactccgccacgggcaagacctgcgagatcgacagcacccccgtgaagtgccgccaggggttctgcctcaagatcacccaggagggccgcgggcacgtgaagctgtcccggggcagcgaggtcgtgctggacgcctgcgactccagctgcgaggtcatgatccccaagggcacgggggacatcctggtggactgctccggcgggcagcagcacttcctcaaggacaacctgatcgacctgggctgcccccacatcccgctcctgggcaagatggcgatctacatctgccgcatgagcaaccacccccggaccaccatggccttcctgttctggttctccttcgggtacgtgatcacgtgcatcttctgcaaggccctcttctacagcctgatcatcatcggcaccctggggaagaagatcaagcagtaccgcgagctcaagccccagacctgcaccatctgcgagaccgcccccgtcaacgcgatcgacgccgagatgcacgacctgaactgctcctacaacatctgcccgtactgcgccagccggctgacctccgacggcctcgcccgccacgtgccccagtgccccaagcggaaggagaaggtggaggagacggagctgtacctgaacctcgagcgcatcccgtggatcgtccggaagctgctccaggtgagcgagagcaccggggtggccctgaagcgctccagctggctgatcgtcctgctcgtgctgctgaccgtgtccctcagccccgtccagtccgcgcccgtgggccacggcaagaccatcgagacgtaccagacccgggaggggttcaccagcatctgcctgttcatgctgggctccatcctcttcctggtgagctgcctggtcaaggggctcgtggactccgtgagcgactccttcttccccggcctgagcgtctgcaagacctgcacgatcgggtccatcaacggcttcgagatcgagagccacaagtgctactgctccctgttctgctgcccgtactgccgccactgcagcgccgaccgggagatccaccagctccacctgtccatctgcaagaagcgcaagaccggcagcaacgtgatgctggccgtgtgcaagcggatgtgcttccgcgccaccatcgaggcctcccggcgcgcgctcctgatccggagcatcatcaacaccacgttcgtcatctgcatcctgaccctcaccatctgcgtggtgagcacctccgccgtcgagatggagaacctgcccagcgggacgtgggagcgcgaggaggacctgaccaacttctgccaccaggagtgccaggtgaccgagaccgagtgcctctgcccctacgaggccctggtgctgcgcaagcccctcttcctggactccatcgtcaagggcatgaagaacagcctgaactccacgagcctcgagacctccctgagcatcgaggccccgtggggcgccatcaacgtgcagtccaccttcaagcccaccgtgagcacggcgaacatcgccctgtcctggagctccgtcgagcaccgggggaacaagatcctcgtgaccgggcgcagcgagtccatcatgaagctggaggagcggaccggcgtgagctgggacctgggcgtcgaggacgcctccgagagcaagctcctgaccgtgtccatcatggacctgagccagatgtacagccccgtgttcgagtacctctccggggaccgccaggtcgaggagtggcccaaggccacgtgcaccggcgactgcccggagcggtgcgggtgcaccagctccacgtgcctgcacaaggagtggccccacagccgcaactggcggtgcaaccccacctggtgctggggcgtggggaccggctgcacgtgctgcggcgtggacgtcaaggacctgttcaccgaccacatgttcgtgaagtggaaggtggagtacatcaagaccgaggcgatcgtctgcgtggagctcacctcccaggagcgccagtgcagcctgatcgaggccgggacccggttcaacctgggccccgtgaccatcaccctctccgagccgcgcaacatccagcagaagctgccgcccgagatcatcacgctgcaccccaaggtcgaggaggggttcttcgacctcatgcacgtgcagaaggtgctgagcgcctccaccgtctgcaagctgcagagctgcacccacggcatccccggcgacctccaggtgtaccacatcgggaacctgctgaagggcgaccggatcaacgggcacctcatccacaagatcgagccccacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaccttccacttccacagcaagcgcgtgaccgcgcacggcgacacgccccagctggacctgaaggcccggccgacctacggggccggcgagatcaccgtcctcgtggaggtggccgacatggagctgcacaccaagaaggtcgagatctccgggctgaagttcgccagcctcgcgtgcaccggctgctacgcctgctccagcgggatctcctgcaaggtgcgcatccacgtggacgagcccgacgagctgacggtccacgtcaagagcagcgaccccgacgtggtggccgcctccaccagcctgatggcccggaagctcgagttcggcaccgactccaccttcaaggcgttcagcgccatgcccaagacgtccctgtgcttctacatcgtggagcgcgagtactgcaagagctgctccgaggaggacacccagaagtgcgtggacaccaagctggagcagccgcagagcatcctcatcgagcacaagggcaccatcatcgggaagcagaacgacacgtgcaccgccaaggcctcctgctggctggagagcgtcaagtccttcttctacggcctgaagaacatgctcgggagcgtgttcggcaacttcttcatcgggatcctgctgttcctcgcgcccttcgtgctgctggtcctgttcttcatgttcggctggaagatcctcttctgcttcaagtgctgccggcgcacccggggcctgctgaagtaccgccacctcaaggacgacgaggagaccgggtaccggcgcatcatcgagcgcctgaacaacaagaagggcaagaaccggctgctcgacggggagcgcctggccgaccggaagatcgccgagctgttctccacgaagacccacatcggctga

SEQ ID NO: 11962 - RNA, 5067 nt, synthetic construct
  misc_feature 1..5067: note = derived and/or modified CDS sequence (opt1) from CCHFV(Drosdov)__DQ211630.1__GP
  source 1..5067: mol_type = other RNA
atgcccatcaacatcatgcacgccctgctcgtgtgcttcatcctgtacctgcagctcagcggcctcgggggcgcccaccgccagtccaacgcgaccgagcacaacgggaccaacacgaccaccgccccgggcaccagccagtcccccaagccgcccgtcagcacgaccctgccccacacccccgaggcctccaccatcaagctgacgacccccaccagcgagaccgaggggtccggcgagacgacgcccccgcccaacaccacccagggcctgcccctgcccgggaccaccccggagcggagcgccaccaccgccacgtccaccagctccaccgacgacatgaacagcaccacgcagatgaccgacaacacccccacctccacggtgagcatcggcctctccagctcccccagcatgccctccaccagccaggggatccactacccggtgcgcagcctgctgtccgtcagctcccccaagaccgcgaccacgcccacccccatgagcccgggcgaggtgtcccccgagaccagctcccagcacagcgccatgtcccggatccccaccctctacacggccacccaggtgagcaccgagaacaccaaccgctccatcccccggcagagcgagtccagcgtccagccggccacccagtcccccatcacgagccccgcgcagaccatcctgctgatgtccgccgcccccaccgccatccaggacatgcacccgagccccaagaaccgctccaagcggaacctcgaggtggagatcatcctgaccctgagccaggggctcaagaagtactacggcaagatcctgaagctgctccacctgacgctggaggaggacaccgagggcctcctggagtggtgcaagcgcaacctggggagcaactgcgacgacgacttcttccagaagcggatcgaggagttcttcatcaccggcgaggggtacttcaacgaggtgctccagttcaagaccccctccacgctgagcccgaccgagccctcccacgtccgcctgcccaccgccgagcccttcaagagctacttcgcgaagggcttcctctccatcgacagcggctacttctccgccaagtgctacccgcggagctccaccagcgggctgcagctgatcaacgtgacgcagcaccccgcccgcatcgccgagacccccggccccaagaccacctccctcaagacgatcaactgcatcaacctgcgggccagcgtgttcaaggagcaccgcgaggtcgagatcaacgtgctgctcccgcagatcgcggtgaacctgtccaactgccacgtcgtgatcaacagccacgtgtgcgactactccctggacaccgacgggcccgtccggctcccccgcatccaccacgagggcgccttcatccccgggacctacaagatcgtgatcgacaagaagaacaagctgaacgaccggtgcagcctggtgaccaactgcgtcatcaagggccgcgaggtgcggaagggccagtccgtgctccgccagtacaagacggagatcaagatcgggaaggccagcaccggcagccggaagctgctgtccgaggagccgggggacgactgcatcagccgcacccagctcctgaagaccgagacggccgagatccacgacgacaactacggcgggcccggcgacaagatcaccatctgcaacggctccaccatcgtcgaccagcgcctggggagcgagctcggctgctacaccatcaaccgggtgaagtccttcaagctgtgcgagaacagcgccacggggaagacctgcgagatcgactccacccccgtcaagtgccgccagggcttctgcctgaagatcacccaggaggggcggggccacgtgaagctgagccgcggctccgaggtggtcctcgacgcgtgcgacagctcctgcgaggtgatgatccccaaggggacgggcgacatcctggtggactgcagcgggggccagcagcacttcctgaaggacaacctcatcgacctgggctgcccgcacatccccctgctcgggaagatggccatctacatctgccggatgtccaaccacccccgcaccaccatggccttcctgttctggttcagcttcggctacgtcatcacgtgcatcttctgcaaggccctgttctactccctcatcatcatcgggaccctgggcaagaagatcaagcagtaccgggagctgaagccccagacctgcaccatctgcgagaccgccccggtgaacgcgatcgacgccgagatgcacgacctcaagtgcagctacaacatctgcccctactgcgcctcccgcctgaccagcgacgggctggcccggcacgtgacgcagtgccccaagcgcaaggagaaggtcgaggagaccgagctctacctgaacctggagcggatcccctggatcgtgcgcaagctcctccaggtgtccgagagcaccggcgtcgcgctgaagcggagctcctggctcatcgtgctgctggtgctcctgaccgtcagcctgtccccggtgcagagcgcccccgtgggccacgggaagacgatcgagacctaccagacccgcgagggcttcacctccatctgcctcttcatgctggggagcatcctgttcatcgtctcctgcctcgtgaagggcctggtggacagcgtctccgacagcttcttccccgggctgtccgtgtgcaagacgtgcagcatcggctccatcaacggcttcgagatcgagagccacaagtgctactgctccctcttctgctgcccgtactgccggcactacagcgccgaccgcgagatccaccagctgcacctgtccatctgcaagaagcggaagaccgggagcaacgtgatgctcgccgtctgcaagcgcatgtgcttcaaggccaccatcgaggcgtcccggcgcgccctgctgatccgcagcatcatcaacaccacgttcgtgatctgcatcctcatcctggccatctgcgtggtcagcacctccgccgtggagatggagaacctgcccgccggcacctgggagcgggaggaggacctcaccaacttctgccaccaggagtgccaggtgacggagaccgagtgcctgtgcccctacgaggcgctggtcctccgcaagcccctgttcctggacagcaccgtgaaggggatgaagaacctcctgaactccaccagcctggagacgtccctcagcatcgaggccccgtggggcgccatcaacgtgcagtccaccttcaagcccaccgtcagcaccgccaacatcgccctgtcctggagctccgtggagcaccgggggaacaagatcctggtgacgggccgcagcgagtccatcatgaagctcgaggagcggaccggcgtcagctgggacctgggggtggaggacgcgtccgagagcaagctgctcaccgtgtccatcatggacctgagccagatgtactcccccgtcttcgagtacctgagcggcgaccgccaggtggaggagtggcccaaggcgacctgcacgggggactgcccggagcggtgcggctgcaccagcagcacgtgcctccacaaggagtggccccactcccgcaactggcggtgcaaccccacctggtgctggggcgtggggaccggctgcacgtgctgcggggtcgacgtgaaggacctgttcaccgaccacatgttcgtgaagtggaaggtcgagtacatgaagaccgaggccatcgtgtgcgtggagctgacctcccaggagcgccagtgcagcctcatcgaggccggcacccggttcaacctggggcccgtcaccatcaccctgtccgagccgcgcaacatccagcagaagctcccgcccgagatcatcaccctgcaccccaagatcgaggagggcttcttcgacctgatgcacgtgcagaaggtgctcagcgcctccacggtctgcaagctgcagagctgcacccacggcatccccggggacctgcagatctaccacatcggcaacctcctgaagggggaccgggtgaacggccacctgatccacaagatcgagccccacttcaacacctcctggatgagctgggacgggtgcgacctcgactactactgcaacatgggcaactggccctcctgcacctacacgggcgtcacccagcacaaccacgccgccttcgtgaacctgctgaacatcgagaccgactacaccaagacgttccacttccacagcaagcgcgtgaccgcccacggggacacgccccagctcgacctgaaggcccggccgacctacggcgcgggggagatcaccgtcctggtggaggtggccgacatggagctccacaccaagaaggtcgagatctccggcctgaagttcgccagcctggtgtgcaccgggtgctacgcctgctccagcggcatctcctgcaaggtgcgcatccacgtcgacgagcccgacgagctcaccgtgcacgtcaagagctccgaccccgacgtggtggccgcgagcacgagcctgatggcccggaagctggagttcggcaccgactccatcttcaaggccttcagcgccatgcccaagacctccctctgcttctacatcgtggagcgcgagtactgcaagagctgctccgaggacgacaccaagaagtgcgtcgacacgaagctggagcagccgcagagcatcctgatcgagcacaaggggaccatcatcggcaagcagaacgacacgtgcaccgccaaggcgtcctgctggctcgagagcgtgaagtccttcttctacgggctgaagaacatgctgggcagcgtgttcgggaacttcttcgtcggcatcctcctgttcctggcccccttcgtgctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaactccaagaaggggaagaaccggctcctggacggcgagcgcctggccgaccggaagatcgccgagctgttcagcaccaagacccacatcggctga

SEQ ID NO: 11963 - RNA, 5067 nt, synthetic construct
  misc_feature 1..5067: note = derived and/or modified CDS sequence (opt1) from CCHFV(1231-CR/TI-2015)__KU161585.1__GP
  source 1..5067: mol_type = other RNA
atgcccatcaacatcatgcacaccctgctcgtgtgcttcatcctgtacctgcagctcctgggcctggggggcgcccacgagcagagcaacgccaccgaccacaaccgcacgaacaccatcaccgcgccgtccaccagccagaaccccaagccccccgcctccacgaccccgccccacacccccgagagctccaccatcaagctcatcacgagcaccggggaggccgagggctccggggagaccacccccccgctgaacacgacccagggccccttcccccccgagaccaccagcgagcacccggcctccacggccaccaacaccagctccaccaacagcatgaactccacgacccagatgaccgacaagaccctgacgagcaccgtctccaccagcctctccatcagcccctccacccccagcacgagccagggcatccactaccccatccggtccctgctgagcgtgtccagcccgcgcaccgcggccacccccacccccatgtccacgcgggagatgagctccgagaccaacagccagcactccgccgtgagccgcacccccaccttccacacggccacccaggtctccaccgagaacgacaaccggagcaccccgcgccagtccgagagctccgcgcagcccgccacccagagccccatgacgtcccccgcccagagcatcctcctggtgtccgccgccccgaccaccatccagaacatccaccccagccccaccaaccggagcaagcgcaacctggagatggagatcatcctcacgctgccccaggggctgaagaagtactacggcaagatcctcaagctgctgcacctcaccctggaggaggacaccgaggggctgctcgagtggtgcaagcggaacctgggctccaactgcgacgacgagttcttccagaagcgcatcgaggagttcttcatcaccggggagggctacttcaacgaggtgctgcagttcaagacgctcagcaccctgtccccgatggagcccagccacgcgcggcccccgaccgccgagcccttcaagtcctacttcgccaagggcttcctgagcatcgactccgggtacttcagcgccaagtgctacccccgctccagctccagcggcctccagctgatcaacatcacccagcaccccgcccggatcgcggagacgccggggcccaagaccacctccctgaagaccatcaactgcatcaacctccgcgccagcgtcttcaaggagcaccgggaggtggagatcaacgtgctgctgccccagatcgccgtcaacctctccaactgccacgtggtgatcaacagccacgtctgcgactactccctggacacggacggccccgtgcgcctgccgcggatctaccacgagggcaccttcatccccgggacctacaagatcgtgatcgacaagaagaacaagctcaacgaccgctgcaccctggtcacgaactgcgtgaccaagggccgggaggtgcgcaaggggcagagcgtcctgcggcagtacaagaccgagatcaagatcggcaaggccagcaccgggtcccgcaagctcctgagcgaggagcccggcgacgactgcatctcccgcacgcagctgctccggaccgagaccgccgagatccacgacgacaactacggcgggcccggcgacaagatcaccatctgcaacgggagcacgatcgtggaccagcgcctgggctccgagctggggtgctacaccatcaaccgggtgaagagcttcaagctctgcgagaactccgcgaccggcaagacctgcgagatcgacagcacgccggtcaagtgccgccagggcttctgcctgaagatcacccaggaggggcggggccacgtgaagctgtcccgcgggagcgaggtggtcctggacgcctgcgactccagctgcgaggtgatgatccccaagggcaccggggacatcctcgtcgactgctccggcggccagcagcacttcctgaaggacaacctgatcgacctcgggtgcccccacatccccctgctgggcaagatggccatctacatctgccggatgagcaaccacccgcgcaccacgatggccttcctcttctggttctccttcgggtacgtgatcacctgcatcttctgcaaggccctgttctacagcctgatcatcatcggcaccctcggcaagaagatcaagcagtaccgggagctgaagccccagacctgcaccatctgcgagacggcgcccgtgaacgccatcgacgccgagatgcacgacctgaactgctcctacaacatctgcccctactgcgccagccgcctcacctccgacgggctggcgcggcacgtcacccagtgcccgaagcgcaaggagaaggtggaggagaccgagctgtacctcaacctggagcggatcccctggatcgtgcgcaagctgctccaggtcagcgagagcacgggcgtggccctgaagcggtccagctggctgatcgtgctcctggtcctgctcaccgtgtccctgagccccgtgcagtccgcccccgtcgggcacggcaagaccatcgagacctaccagacgcgcgaggggttcaccagcatctgcctgttcatgctcggctccatcctgttcatcgtgagctgcctggtgaagggcctcgtcgagtccgtgagcgactccttcttcccggggctgagcgtgtgccggacctgctccatcggcagcatcaacgggttcgagatcgagtcccacaagtgctactgcagcctgttctgctgcccctactgccgccactgctccgccgaccgggagatccaccagctccacctgagcatctgcaagaagcgcaagaccggctccaacgtcatgctggccgtgtgcaagcgcatgtgcttccgggcgacgatggaggccagccgccgggccctcctgatccgcagcatcatcaacaccaccttcgtgatctgcatcctgaccctcacgatctgcgtcgtgtccaccagcgccgtggagatggagaacctgcccgccgggacctgggagcgggaggaggacctgaccaacttctgccaccaggagtgccaggtcacggagaccgagtgcctctgcccgtacgaggcgctggtgctgcgcaagcccctcttcctggactccatcgtgaagggcatgaagaacctgctcaacagcacctccctggagaccagcctgtccatcgaggccccctggggcgccatcaacgtccagagcacgttcaagcccaccgtgtccaccgccaacatcgccctcagctggtccagcgtggagcaccgggggaacaagatcctggtcaccggccgctccgagagcatcatgaagctggaggagcggacgggggtgtcctgggacctcggcgtggaggacgcgagcgagtccaagctgctgaccgtcagcatcatggacctctcccagatgtacagcccggtgttcgagtacctgagcggggaccgccaggtggaggagtggcccaaggccacctgcaccggcgactgccccgagcggtgcggctgcacgtccagcacctgcctgcacaaggagtggccccactcccgcaactggcggtgcaacccgacctggtgctggggggtcggcaccgggtgcacgtgctgcggcgtggacgtgaaggacctcttcaccgaccacatgttcgtcaagtggaaggtggagtacatcaagaccgaggccatcgtgtgcgtcgagctgaccagccaggagcgccagtgctccctgatcgaggccgggacccggttcaacctcggccccgtgacgatcaccctgagcgagccccgcaacatccagcagaagctgcccccggagatcatcaccctccaccccaagatcgaggagggcttcttcgacctgatgcacgtgcagaaggtcctgtccgcgagcaccgtgtgcaagctccagtcctgcacgcacgggatccccggcgacctgcaggtgtaccacatcgggaacctgctcaagggcgaccgggtcaacggccacctgatccacaagatcgagccccacttcaacaccagctggatgtcctgggacgggtgcgacctggactactactgcaacatgggcgactggccgagctgcacctacaccggggtgacgcagcacaaccacgccgccttcgtgaacctcctgaacatcgagaccgactacaccaagaccttccacttccactccaagcgcgtcacggcccacggcgacaccccccagctggacctcaaggcccggcccacctacggggcgggcgagatcaccgtgctggtcgaggtggccgacatggagctgcacacgaagaaggtggagatcagcggcctcaagttcgcctccctggcctgcaccgggtgctacgcctgcagctccggcatcagctgcaaggtccgcatccacgtggacgagcccgacgagctgaccgtgcacgtcaagtccagcgacccggacgtggtggcggccagcacctccctcatggcccggaagctggagttcgggacggacagcaccttcaaggccttctccgccatgcccaagaccagcctgtgcttctacatcgtcgagcgcgagtactgcaagtcctgcagcgaggacgacaccaagaagtgcgtggacacgaagctcgagcagccccagtccatcctgatcgagcacaagggcaccatcatcgggaagcagaacgacacctgcaccgcgaaggccagctgctggctggagtccgtgaagagcttcttctacggcctcaagaacatgctgggctccgtcttcgggaacttcttcatcggcatcctgctcttcctggcccccttcgtgctgctggtgctcttcttcatgttcgggtggaagatcctgttctgcttcaagtgctgccgccggacgcgcggcctgttcaagtaccggcacctcaaggacgacgaggagaccgggtaccgccggatcatcgagcgcctgaacaacaagaagggcaagaaccggctgctcgacggcgagcgcctggccgaccggaagatcgcggagctgttcagcaccaagacccacatcgggtga

SEQ ID NO: 11964 - RNA, 5067 nt, synthetic construct
  misc_feature 1..5067: note = derived and/or modified CDS sequence (opt1) from CCHFV(1-CR/HU-2015)__KU161584.1__GP
  source 1..5067: mol_type = other RNA
atgcccatcaacatcatgcacaccctgctcgtgtgcttcatcctgtacctgcagctcctgggcctcgggggcgcccacgagcagagcaacgccaccgaccacaaccgcacgaacaccatcaccgcgccgtccaccagccagaaccccaagccgcccgcctccacgaccccgccccacacccccgagagctccaccatcaagctgatcacgagcaccggggaggccgagggctccggggagaccaccccgcccctgaacacgacccagggccccttcccgcccgagaccaccagcgagcaccccgcctccacggccaccaacaccagctccaccaacagcatgaactccacgacccagatgaccgacaacaccctgacgagcaccgtctccaccagcctctccatcagcccctccacccccagcacgagccagggcatccactaccccgtgcggtccctgctgagcgtgtccagccccaagaccgcggccacccccacccccatgtccacgcgcgagatgagctccgagaccagctcccagcacagcgccatgtcccggacccccaccttccacacggccacccaggtcagcaccgagaacgcgaaccgctccaccccgcggcagagcgagtccagcgcccagcccgccacccagtcccccatgacgagccccgcccagtccatcttcctcgtgagcgccgcgccgaccaccatccagaacatccaccccagccccaccaaccgctccaagcggaacctggagatggagatcatcctgacgctcccccaggggctgaagaagtactacggcaagatcctgaagctcctgcacctgaccctcgaggaggacaccgaggggctgctggagtggtgcaagcgcaacctcggcagcaactgcgacgacgagttcttccagaagcggatcgaggagttcttcatcaccggggagggctacttcaacgaggtgctgcagttcaagacgctgtccaccctcagcccgaccgagccctcccacgcccggcccccgaccgccgagcccttcaagagctacttcgccaagggcttcctgtccatcgacagcgggtacttctccgccaagtgctacccccgcagctccacgagcggcctgcagctcatcaacatcacccagcaccccgcgcgcatcgccgagaccccggggcccaagaccacgtccctgaagaccatcaactgcatcaacctgcgggccagcgtcttcaaggagcaccgcgaggtggagatcaacgtgctcctgccccagatcgccgtcaacctgtccaactgccacgtggtgatcaacagccacgtctgcgactactccctcgacaccgacggccccgtgcggctgccgcgcatctaccacgagggcaccttcatccccgggacgtacaagatcgtgatcgacaagaagaacaagctgaacgaccggtgcaccctcgtcaccaactgcgtgatcaagggccgcgaggtgcggaaggggcagagcgtcctgcgccagtacaagaccgagatcaagatcggcaaggccagcacggggtcccggaagctgctcagcgaggagcccggcgacgactgcatctcccgcacccagctgctgcgcaccgagaccgcggagatccacgacgacaactacggcgggcccggcgacaagatcacgatctgcaacgggagcaccatcgtggaccagcggctcggctccgagctggggtgctacaccatcaaccgcgtcaagagcttcaagctgtgcgagaactccgccaccggcaagacgtgcgagatcgacagcaccccggtgaagtgccggcagggcttctgcctcaagatcacccaggaggggcgcggccacgtgaagctgtcccgggggagcgaggtggtcctggacgcctgcgactccagctgcgaggtgatgatccccaagggcaccggggacatcctggtcgactgctccggcggccagcagcacttcctcaaggacaacctgatcgacctggggtgcccccacatccccctcctgggcaagatggccatctacatctgccgcatgagcaaccacccgcggacgaccatggccttcctgttctggttctccttcgggtacgtgatcacgtgcatcttctgcaaggccctcttctacagcctgatcatcatcggcaccctgggcaagaagatcaagcagtaccgcgagctcaagccccagacctgcaccatctgcgagaccgcccccgtgaacgccatcgacgccgagatgcacgacctgaactgctcctacaacatctgcccctactgcgcgagccggctgacctccgacgggctcgcccgccacgtcacccagtgcccgaagcggaaggagaaggtggaggagacggagctgtacctgaacctcgagcgcatcccctggatcgtgcggaagctgctgcaggtcagcgagagcaccggcgtggccctcaagcgctccagctggctgatcgtgctgctcgtcctgctgaccgtgtccctcagccccgtgcagtccgcccccgtcgggcacggcaagaccatcgagacgtaccagacccgggaggggttcaccagcatctgcctgttcatgctgggctccatcctcttcatcgtgagctgcctggtgaagggcctggtcgactccgtgagcgactccttcttcccggggctcagcgtgtgccggacctgctccatcggcagcatcaacgggttcgagatcgagtcccacaagtgctactgcagcctgttctgctgcccctactgccggcactgctccgccgaccgcgagatccaccagctgcacctcagcatctgcaagaagcggaagacgggctccaacgtcatgctggcggtgtgcaagcgcatgtgcttccgcgccaccatggaggccagccggcgcgccctgctcatccggagcatcatcaacaccaccttcgtgatctgcatcctgacgctgaccatctgcgtcgtgtccaccagcgccgtggagatggagaacctccccgcggggacctgggagcgcgaggaggacctgacgaacttctgccaccaggagtgccaggtcaccgagaccgagtgcctgtgcccgtacgaggccctcgtgctgcggaagcccctgttcctcgactccatcgtgaagggcatgaagaacctgctgaacagcacctccctcgagacgagcctgtccatcgaggccccctggggcgccatcaacgtccagagcaccttcaagcccaccgtgtccaccgccaacatcgcgctgagctggtccagcgtggagcaccgcgggaacaagatcctcgtcacgggccggtccgagagcatcatgaagctggaggagcgcaccggggtgtcctgggacctgggcgtggaggacgccagcgagtccaagctcctgaccgtcagcatcatggacctgtcccagatgtacagcccggtgttcgagtacctcagcggggaccgccaggtggaggagtggcccaaggcgacctgcacgggcgactgccccgagcgctgcggctgcacctcctccacgtgcctgcacaaggagtggccccacagccggaactggcgctgcaacccgacctggtgctggggcgtcgggaccgggtgcacgtgctgcggcgtggacgtgaaggacctgttcaccgaccacatgttcgtcaagtggaaggtggagtacatcaagaccgaggccatcgtgtgcgtcgagctcaccagccaggagcggcagtgctccctgatcgaggcggggacccgcttcaacctgggccccgtgaccatcaccctcagcgagccccggaacatccagcagaagctgcccccggagatcatcaccctgcaccccaagatcgaggagggcttcttcgacctcatgcacgtgcagaaggtcctgtccgccagcacggtgtgcaagctgcagtcctgcacccacgggatccccggcgacctccaggtgtaccacatcgggaacctgctgaagggcgaccgcgtcaacggccacctcatccacaagatcgagccccacttcaacaccagctggatgtcctgggacgggtgcgacctggactactactgcaacatgggcgactggccgagctgcacctacacgggggtgacccagcacaaccacgccgccttcgtgaacctgctcaacatcgagaccgactacaccaagacgttccacttccactccaagcgggtcaccgcccacggcgacacgccccagctggacctgaaggcgcgccccacctacggggccggcgagatcaccgtgctcgtcgaggtggccgacatggagctgcacaccaagaaggtggagatcagcggcctgaagttcgcctccctcgcctgcaccgggtgctacgcgtgcagctccggcatcagctgcaaggtccggatccacgtggacgagcccgacgagctgaccgtgcacgtcaagtccagcgacccggacgtggtggccgccagcacgtccctgatggcccgcaagctcgagttcgggaccgacagcaccttcaaggccttctccgcgatgcccaagaccagcctgtgcttctacatcgtcgagcgggagtactgcaagtcctgcagcgaggacgacacgaagaagtgcgtggacaccaagctggagcagccccagtccatcctcatcgagcacaagggcaccatcatcgggaagcagaacgacacgtgcaccgccaaggccagctgctggctggagtccgtcaagagcttcttctacggcctgaagaacatgctcggctccgtgttcgggaacttcttcatcggcatcctgctgttcctcgcccccttcgtgctgctggtgctgttcttcatgttcgggtggaagatcctcttctgcttcaagtgctgccgccgcacccggggcctgttcaagtaccgccacctgaaggacgacgaggagaccgggtaccggcgcatcatcgagcggctcaacaacaagaagggcaagaaccgcctgctggacggcgagcggctcgcggaccgcaagatcgccgagctgttcagcaccaagacgcacatcgggtga

SEQ ID NO: 11965 - RNA, 5067 nt, synthetic construct
  misc_feature 1..5067: note = derived and/or modified CDS sequence (opt1) from CCHFV(V42/81)__GU477490.1__GP
  source 1..5067: mol_type = other RNA
atgcccaccaacaccatgcacacgctgctcgtgtgcttcatcctgtacctgcagctcctgggcctcgggggcgcccacgtccagccgaacgccaccgagcacaaccgcaccaacaccacgaccgcgcccgggaccagccactccctcaagcccctggtgagcaccacgcccccgcaggcccccgagtccagcaccatcaagcccaccacccccacgtccgagaccgagggcagcggggaggccaccccgctgtccaacaccatccaggcccccagctcccccgagacgaccagcgagcggcccgccaccgcggtgatctccaccagcggcacggactccaccaacagcaccacccagacgaccgacaacaacccgaccaccacggtcggcacctcccccagctccagcccctccacccccagcaccccgcaggggatccaccaccacgcccgcagcctcctgtccgtgacgagccccgagaccgtgaccacccccaagcccacgtccccgcgggagatgagctccgagaccagcaaccagcactccgccatgagccgcacccccacccaccacaccgtcacccaggtgtccaccgagaacaccagccactccacgccccggcagcccgagagctccgcccagccgacgagctccagccccatgacctcccccgcgcagagcaccctgctcatgtccgccgcccccaccgccgtgcagagcatccacccgagccccacgaaccgctccaagcggaacctggagaccgagatcatcctgaccctcagccagggcctgaagaagtactacgggaagatcctgaagctcctgcacctgaccctcgaggaggacacggagggcctgctggagtggtgcaagcgcaacctcgggtccaactgcgacgacgacttcttccagaagcggatcgaggagttcttcatgaccggcgagggctacttcaacgaggtcctgcagttcaagacccccagcaccgtgtccccgacggagcccagccacgcccgcctgcccaccgcggagcccttcaagtcctacttcgccaaggggttcctcagcatcgactccggctacttcagcgccaagtgctactcccggagctccaccagcgggctgcagctgatcaacgtgacccagcacccggcccgcatcgccgagacgcccggccccaagaccacctccctcaagaccatcaactgcatcaacctgcgggcgagcgtcttcaaggagaaccgcgagatcgagatctccgtgctgctcccccagatcgccgtgaacctgagcaactgccacgtcgtgatcaacagccacgtgtgcgactactccctggacacggacggcccggtccggctcccccgcatcaaccacgaggggaccttcatccccggcacctacaagatcgtgatcgacaagaagaacaagctgaacgaccggtgcaccctggtgacgaactgcgtcatcaaggggcgcgaggtgcggaagggccagagcgtgctccgccagtacaagaccgagatcaagatcgggaaggcctccaccggcagccggaagctgctgtccaaggagcccggcgacgactgcatcagccgcacccagctcatgcgcacggagaccgccgagatccacgacgacaactacgggggcccgggggacaagatcaccatctgcaacggctccaccatcgtcgaccagcggctggggagcgagctgggctgctacacgatcaaccgcgtgaagtccttcaagctctgcgagaacagcgccaccggcaaggcgtgcgaggtcgactccacccccgtgaagtgccggcaggggttctgcctgaagatcacccaggagggccgcgggcacgtgaagctgagccggggctccgaggtcgtgctcgacgcctgcgacagctcctgcgaggtgatgatccccaaggggaccggcgacatcctggtcgactgcagcggcgggcagcagcacttcctgaaggacaacctgatcgacctcgagtgcccccacatcccgctgctgggcaagctcgccatctacatctgccgcatgtccaaccacccccggacgaccatggccttcctgttctggttcgggttcggctacgtgatcacgtgcatcctgtgcaaggccctcttctacagcctgatcatcatcggcaccctggggaagaagatcaagcagtaccgcgagctcaagccccagacctgcaccatctgcgagaccgcgcccgtgaacgccatcgacgccgagatgcacgacctgaactgctcctacaacatctgcccgtactgcgccagccggctgaccagcgacggcctcgcgcgccacgtcacgcagtgccccaagcggaaggagaaggtggaggagaccgagctgtacctgaacctcgagcgcatcccctggatcgtgcggaagctgctgcaggtctccgagagcaccggggtggtgctcaagcgctccagctggctgatcgtcctgctcgtgctgctgaccgtgtccctcagccccgtccagtccgccccggtgggccacgggaagacgatcgagacctaccagacccgggagggcttcaccagcatctgcctgttcatgctgggctccatcctcttcatcgtgagctgcatcgtcaaggggctggtggactccgtgagcgactccttcttccccggcctgagcgtctgcaagacgtgctccatcagctccatcaacgggttcgagatcgagagccacaagtgctactgctccctcttctgctgcccctactgccgccactgcagcgccgaccgggagatccaccagctgcacctgagcatctgccgcaagcggcgcaccggctccaacgtgatgctcgccgtgtgcaagcgcatgtgcttccgggccaccatcgaggtcagccgccgggcgctgctgatccgctccatcatcaacaccacgttcgtgatctgcatcctcaccctgaccatctgcgtggtcagcacctccgccgtggagatggagaacctgccggccgggacgtgggagcgggaggaggacctcaccaacttctgccaccaggagtgccaggtgaccgagaccgagtgcctgtgcccctacgaggccctggtcctccgcaagcccctgttcctggacagcatcgtgaagggcaagaagaacctcctgaactccacgagcctggagacctccctcagcatcgaggccccctggggcgcgatcaacatccagtccaccttcaagccgaccgtgagcgccgccaacatcgccctgtcctggagctccgtcgagcaccgggggaacaagatcctggtgagcggccgctccgagagcatcatgaagctcgaggagcggacgggggtgtcctggaacctgggcgtcgaggacgccagcgagagcaagctgctcaccgtgtccatcatggacctgagccagatgtactcccccgtgttcgagtacctgagcggggaccgccaggtcgaggagtggcccaaggcgacctgcaccggcgactgccccgagcggtgcggctgcacgtccagcacgtgcctccacaaggagtggccgcactcccgcaactggcggtgcaaccccacctggtgctggggcgtggggaccgggtgcacgtgctgcggcgtggacgtcaaggacctgttcatcgaccacatgttcgtgaagtggaaggtggagtacatcaagaccgaggccatcgtctgcgtggagctgaccagccaggagcgccagtgctccctcatcgaggccgggacccggttcaacctgggccccgtgaccatcaccctgagcgagccccgcaacatccagcagaagctcccgcccgagatcatcaccctgcaccccaagatcgaggagggcttcttcgacctgatgcacgtccagaaggtgctctccgccagcaccgtctgcaagctgcagtcctgcacccacgggatccccggcgacctccaggtgtaccacatcgggaacctgctgaagggcgaccgggtgaacggccacctgatccacaagatcgagccgcacttcaacacgagctggatgtcctgggacgggtgcgacctcgactactactgcaacatgggcgactggcccagctgcacctacaccggggtcacccagcacaaccacgcggccttcgtgaacctgctgaacatcgagacggactacaccaagaccttccacttccactccaagcgcgtgaccgcccacggcgagacgccccagctcgacctgaaggcccggcccgcctacggggcgggcgagatcaccgtcctggtggaggtggccgacatggagctccacaccaagaaggtcgagatcagcggcctgaagttcgcctccctggcctgcaccgggtgctacgcctgcagcagcggcatctcctgcaaggtgcgcatccacgtggacgagccggacgagctcacggtccacgtcaagagcaacgaccccgacgtggtggcggcctccaccagcctgatggcccggaagctggagtccgggaccgacagcaccttcaaggccttctccgccatgcccaagacgagcctctgcttctacatcgtggagcgcgagtactgcaagtcctgcagcgaggacgacacccagaagtgcgtggagaccaagctggagcagccccagtccatcctgatcgagcacaagggcaccatcatcgggaagcagaacgacacgtgcaccgcgaaggccagctgctggctcgagtccgtcaagagcttcttctacggcctgaagaacatgctgggctccgtgttcgggaacttcttcatcggcatcctcctgttcctggccccgttcgtgctcctggtcctgttcttcatgttcgggtggaagatcctgttctgcttcaagtgctgccgccggacccgcggcctcttcaagtaccggcacctgaaggaggacgaggagaccgggtaccgccggatcatcgagcgcctgaacagcaagaagggcaagaaccggctcctggacggcgagcgcctggccgaccggaagatcgcggagctgttctccacgaagacccacatcgggtga

SEQ ID NO: 11966 - RNA, 5067 nt, synthetic construct
  misc_feature 1..5067: note = derived and/or modified CDS sequence (opt1) from CCHFV(ROS/HUVLV-100)__DQ206448.1__GP
  source 1..5067: mol_type = other RNA
atgcccaccaacatcatgcacaccctgctcgtgtgcttcatcctgtacctgcagctcctgggcctcgggggcgcccaccgccagagcaacgccacggagcacaacgggaccaacaccaccacggcgccgtccaccagccagtcccccaagcccctggtcagcaccgcgcccccgcacgccctggagtccagcaccatcaagcccacgacccccgtgtccgagaccgagggcagcggggagaccacgcccccgcccaacaccacccagggcccctccccgcccgaggccacccccgagcggcccacgaccaccgccaccagcacgccctccaccgacaacaccaacagcaccacgcacgtgaccgacaacaacccgacctccaccatcagcacgtcccccagctccagcccctccacccccagcaccccgcagggcatccaccaccccgcccgcaacctgctcagcgtctccagccccaagaccgccacgacccccaccccgacctcccccggggagatcagctccgagacgagctccctgcacagcgccatgtcccggaccagcaccctgtacaccgccacccaggtgtccacggagaacgcgaaccacagcgcgccccgccagtccgagagctccgcccagcagaccaccaccagccccatgacgtccccggcccagagcatcctcgtgatgtccgccgcccccaccgccatccagaacatccaccccagcccgaccaaccggagcaagcgcaacctggagatggagatcatcctgaccctctcccagggcctgaagaagtactacgggaagatcctgaagctcctgcacctgacgctcgaggaggacaccgagggcctgctggagtggtgcaagcggaacctcgggagcaactgcgacgacgacttcttccagaagcgcatcgaggagttcttcatgaccggcgagggctacttcaacgaggtcctgcagttcaagaccctgtccacgctcagccccaccgagccctcccacgcccggcccccgaccgtggagcccttcaagagctacttcgccaaggggttcctgtccatcgacagcggctacttctccgccaagtgctacccccgcctgagcacctccgggctccagctgatcaacgtgacgcagcaccccgcgcggatcgccgagaccccgggccccaagaccaccagcctgaagacgatcaactgcatcaacctccgcgcctccgtcttcaaggagcaccgggagatcgagatcaacgtgctgctgccccagatcgccgtgaacctcagcaactgccacgtcgtgatcaactcccacgtgtgcgactacagcctggacaccgacggccccgtccgcctgccgcacatctaccacgaggggaccttcatccccggcacctacaagatcgtgatcgacaagaagaacaagctcaacgaccggtgcacgctggtgaccaactgcgtcatcaaggggcgcgaggtgcggaagggccagtccgtgctgcgccagtacaagaccgagatcaagatcgggaaggccagcaccggcagccggaagctcctgtccgaggagcccggcgacgactgcatcagccgcacgcagctgctccggaccgagaccgcggagatccacgacgacaactacgggggccccggggacaagatcaccatctgcaacggctccacgatcgtcgaccagcgcctggggagcgagctgggctgctacaccatcaaccgcgtgaagtccttcaagctctgcgagaacagcgccaccggcaagacctgcgagatcgactccacgccggtgaagtgccggcaggggttctgcctgaagatcacccaggagggccgcgggcacgtcaagctgagccggggctccgaggtggtcctggacgcctgcgacagctcctgcgaggtgatgatccccaaggggaccggcgacatcctcgtggactgcagcggcgggcagcagcacttcctgaaggacaacctgatcgacctcggctgcccccacatccccctgctggggaagatggccatctacatctgccgcatgtccaaccacccgcggaccaccatggccttcctcttctggttcagcttcggctacgtcatcacgtgcatcttctgcaaggcgctgttctactccctgatcatcatcggcaccctcgggaagaagatcaagcagtaccgcgagctgaagccccagacctgcaccatctgcgagacggcccccgtgaacgccatcgacgccgagatgcacgacctgaactgcagctacaacatctgcccctactgcgcgtcccggctcaccagcgacggcctggcccgccacgtgccgcagtgccccaagcggaaggagaaggtcgaggagaccgagctgtacctcaacctggagcgcatcccctggatcgtgcggaagctgctccaggtgtccgagagcaccggggtcgccctgaagcgcagctcctggctgatcgtgctcctggtgctgctcacggtcagcctgtccccggtgcagagcgcccccgtgggccacgggaagaccatcgagacctaccagacccgggagggcttcacgtccatctgcctgttcatgctcggcagcatcctgttcctggtctcctgcctcgtgaaggggctggtggacagcgtctccgacagcttcttccccggcctgtccgtgtgcaagacctgcagcatcgggtccatcaacggcttcgagatcgagagccacaagtgctactgctccctcttctgctgcccctactgccgccactgcagcgccgaccgggagatccaccagctgcacctgtccatctgcaagaagcgcaagaccgggagcaacgtgatgctcgcggtctgcaagcggatgtgcttccgcgccaccatcgaggcctcccggcgcgccctgctgatccgcagcatcatcaacacgaccttcgtgatctgcatcctcaccctgaccatctgcgtggtcagcacgtccgccgtggagatggagaacctgccgagcggcacctgggagcgggaggaggacctcaccaacttctgccaccaggagtgccaggtgaccgagacggagtgcctgtgcccctacgaggcgctggtcctccgcaagcccctgttcctggactccatcgtgaagggcatgaagaacctcctgaacagcacctccctggagaccagcctctccatcgaggccccctggggcgccatcaacgtgcagagcaccttcaagccgacggtctccaccgccaacatcgccctgagctggtccagcgtggagcaccgggggaacaagatcctggtgaccgggcgctccgagagcatcatgaagctcgaggagcggaccggcgtctcctgggacctgggggtggaggacgcgagcgagtccaagctgctcacggtgagcatcatggacctgtcccagatgtacagccccgtcttcgagtacctgagcggcgaccgccaggtggaggagtggcccaaggcgacctgcaccggcgactgccccgagcggtgcgggtgcacctccagcacgtgcctccacaaggagtggccgcactcccgcaactggcggtgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgaccagccaggagcgccagtgctccctcatcgaggccggcacccggttcaacctgggccccgtcaccatcacgctgagcgagccccgcaacatccagcagaagctcccgcccgagatcatcaccctgcaccccaaggtggaggaggggttcttcgacctgatgcacgtgcagaaggtcctctccgccagcaccgtgtgcaagctgcagtcctgcacccacggcatccccggggacctccaggtgtaccacatcggcaacctgctgaagggcgaccgggtcaacgggcacctgatccacaagatcgagccgcacttcaacacgagctggatgtcctgggacggctgcgacctcgactactactgcaacatgggggactggcccagctgcacctacaccggcgtgacccagcacaaccacgccgccttcgtcaacctgctgaacatcgagacggactacaccaagaccttccacttccactccaagcgcgtgaccgcccacggggacacgccccagctcgacctgaaggcccggcccacctacggcgcgggcgagatcaccgtgctggtcgaggtggccgacatggagctccacaccaagaaggtggagatcagcgggctgaagttcgcctccctggcctgcacgggctgctacgcctgcagctccgggatcagctgcaaggtccgcatccacgtggacgagccggacgagctcaccgtgcacgtcaagtccagcgaccccgacgtggtggcggccagcacctccctgatggcccggaagctggagttcggcaccgacagcacgttcaaggccttctccgccatgcccaagaccagcctctgcttctacatcgtcgagcgcgagtactgcaagtcctgcagcgaggaggacacccagaagtgcgtggacaccaagctggagcagccccagtccatcctgatcgagcacaaggggacgatcatcggcaagcagaacgacacgtgcaccgcgaaggccagctgctggctcgagtccgtcaagagcttcttctacggcctgaagaacatgctggggtccgtgttcggcaacttcttcatcgggatcctcctgttcctggccccgttcgtgctgctcgtgctgttcttcatgttcggctggaagatcctgttctgcttcaagtgctgccggcgcacccgggggctcctgaagtaccgcctgctcaaggacgacgaggagaccggctaccgccggatcatcgagcgcctgaacaacaagaagggcaagaaccggctgctcgacggggagcgcctggccgaccggaagatcgcggagctgttcagcaccaagacccacatcggctga

SEQ ID NO: 11967 - RNA, 5067 nt, synthetic construct
  misc_feature 1..5067: note = derived and/or modified CDS sequence (opt1) from CCHFV(5180-R-2011)__KR814874.1__GP
  source 1..5067: mol_type = other RNA
atgcccaccaacatcatgcacaccctgctcgtgtgcttcatcctgtacctgcagctcctgggcctcgggggcgcccaccgccagagcaacgccacggagcacaacgggaccaacaccaccacggcgccgtccaccagccagtcccccaagccgcccgtcagcaccgccccgccctacgcccccgagtccagcaccatcaagcccacgacccccgcctccgagaccgagggcagcggggagaccacgcccccgcccaacaccacccagggcccctccccgcccgaggccacccccgagcggcccgcgacgaccgccaccagcaccccctccacggacaacaccaacagcaccacccacgccacggacaacaaccccacctccaccatcagcacctcccccagctccagcccgtccacgcccagcacgccccagggcatccaccaccccgcccgcaacctgctgagcgtgtccagcccgaagaccgcgaccacccccacccccacctcccccggggacatcagctccgagaccagctccctgcacagcgccatgtcccggacgccgaccctccacaccgccacccaggccagcaccgagaacgccaaccactccgcgccccgccagagcgagtccagcgcccagcagacgaccacctcccccatgaccagcccggcccagcccatcctggtgatgtccgccgcccccacggcgatccagaacatccaccccagcccgaccaaccggtccaagcgcaacctggagatggagatcatcctcaccctgagccagggcctgaagaagtactacgggaagatcctcaagctgctgcacctcaccctggaggaggacacggagggcctgctcgagtggtgcaagcggaacctggggagcaactgcgacgacgacttcttccagaagcgcatcgaggagttcttcatgaccggcgagggctacttcaacgaggtcctgcagttcaagaccctctccaccctgagccccacggagccctcccacgcccggcccccgaccgtggagcccttcaagagctacttcgccaaggggttcctgtccatcgacagcggctacttctccgccaagtgctacccccgcctcagcacctccgggctgcagctgatcaacgtgacccagcaccccgcccggatcgcggagacgccgggccccaagaccaccagcctcaagaccatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacacggacggccccgtccgcctcccgcacatctaccacgaggggaccttcatccccggcacctacaagatcgtgatcgacaagaagaacaagctgaacgaccggtgcaccctggtgacgaactgcgtcatcaaggggcgcgagatccggaagggccagtccgtgctccgccagtacaagaccgagatcaagatcgggaaggccagcaccggctcccggaagctgctgagcgaggagcccggcgacgactgcatcagccgcacccagctcctgcggacggagaccgccgagatccacgacgacaactacgggggccccggggacaagatcaccatctgcaacggctccaccatcgtggaccagcgcctggggagcgagctcggctgctacacgatcaaccgcgtcaagtccttcaagctgtgcgagaacagcgcgaccggcaagacctgcgagatcgactccaccccggtgaagtgccggcaggggttctgcctgaagatcacgcaggagggccgcgggcacgtgaagctcagccggggctccgaggtcgtgctggacgcctgcgacaccagctgcgaggtgatgatccccaaggggaccggcgacatcctggtcgactgctccggcgggcagcagcacttcctgaaggacaacctcatcgacctgggctgcccccacatccccctgctcgggaagatggccatctacatctgccgcatgagcaaccacccgcggaccaccatggccttcctgttctggttctccttcggctacgtgatcacgtgcatcttctgcaaggcgctgttctacagcctcatcatcatcggcaccctggggaagaagatcaagcagtaccgcgagctgaagccccagacctgcaccatctgcgagacggcccccgtcaacgccatcgacgccgagatgcacgacctcaactgctcctacaacatctgcccgtactgcgccagccggctgacctccgacggcctggcgcgccacgtgccccagtgccccaagcggaaggagaaggtggaggagaccgagctctacctgaacctggagcgcatcccctggatcgtccggaagctcctccaggtgagcgagtccaccggggtggccctgaagcgcagctcctggctcatcgtcctgctggtgctcctgacggtgagcctgagcccggtccagtccgcccccgtgggccacgggaagaccatcgagacctaccagacccgggagggcttcacgagcgtgtgcctcttcatgctgggctccatcctgttcctcgtcagctgcctggtgaaggggctggtggactccgtcagcgactccttcttccccggcctcagcgtgtgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtctgcaagcggatgtgcttccgcgcgaccatcgaggccagccggcgcgccctgctcatccgctccatcatcaacaccacgttcgtgatctgcatcctgaccctgaccatctgcgtggtcagcacctccgccgtggagatggagaacctcccgagcggcacgtgggagcgggaggaggacctgaccaacttctgccaccaggagtgccaggtgaccgagaccgagtgcctgtgcccctacgaggccctcgtcctgcgcaagcccctgttcctcgacagcatcgtgaagggcatgaagaacctgctgaactccacgagcctcgagacctccctgagcatcgaggcgccctggggcgccatcaacgtgcagtccaccttcaagccgaccgtcagcacggccaacatcgccctgtcctggagctccgtggagcaccgggggaacaagatcctcgtgaccgggcgcagcgagtccatcatgaagctggaggagcggaccggcgtcagctgggacctgggggtggaggacgcgtccgagagcaagctcctgaccgtgtccatcatggacctgagccagatgtactcccccgtcttcgagtacctcagcggcgaccgccaggtggaggagtggcccaaggccacgtgcaccggcgactgccccgagcggtgcgggtgcacctcctccacgtgcctgcacaaggagtggccgcacagccgcaactggcggtgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctcaccagccaggagcgccagtgcagcctgatcgaggccggcacccggttcaacctgggccccgtcaccatcaccctctccgagccccgcaacatccagcagaagctgccgcccgagatcatcacgctgcaccccaaggtggaggaggggttcttcgacctcatgcacgtgcagaaggtcctgagcgcctccaccgtgtgcaagctgcagagctgcacccacggcatccccggggacctccaggtgtaccacatcggcaacctgctgaagggcgaccgggtcaacgggcacctcatccacaagatcgagccgcacttcaacacctcctggatgagctgggacggctgcgacctggactactactgcaacatgggggactggccctcctgcacgtacaccggcgtgacccagcacaaccacgcggccttcgtgaacctgctcaacatcgagaccgactacacgaagaccttccacttccacagcaagcgcgtcaccgcccacggggacacgccccagctggacctgaaggcccggcccacctacggcgccggcgagatcaccgtgctcgtcgaggtggcggacatggagctgcacaccaagaaggtggagatctccgggctgaagttcgccagcctcgcctgcaccggctgctacgcctgctccagcgggatctcctgcaaggtccgcatccacgtggacgagccggacgagctgacggtgcacgtcaagagcaacgaccccgacgtggtggccgcgtccaccagcctgatggcccggaagctcgagttcggcaccgactccaccttcaaggccttcagcgccatgcccaagacgagcctgtgcttctacatcgtcgagcgcgagtactgcaagtcctgcagcgaggaggacacccagaagtgcgtggacaccaagctggagcagccgcagtccatcctcatcgagcacaaggggaccatcatcggcaagcagaacgacacgtgcaccgcgaaggccagctgctggctggagtccgtcaagagcttcttctacggcctgaagaacatgctcgggtccgtgttcggcaacttcttcatcgggatcctgctgttcctcgcccccttcgtgctgctggtgctgttcttcatgttcggctggaagatcctcttctgcttcaagtgctgccggcgcacccgggggctgctgaagtaccgcctcctgaaggacgacgaggagaccggctaccgccggatcatcgagcgcctgaacaacaagaagggcaagaaccggctcctggacggggagcgcctggccgaccggaagatcgccgagctgttcagcacgaagacccacatcggctga

SEQ ID NO: 11968 - RNA, 5067 nt, synthetic construct
  misc_feature 1..5067: note = derived and/or modified CDS sequence (opt1) from CCHFV(5170-R-2011)__KR814873.1__GP
  source 1..5067: mol_type = other RNA
atgcccttcaacatcatgcacaccctgctcgtgtgcttcatcctgtacctgcagctcagcggcctggggggcgcccacgggcagtccaacgagaccgagcacaacggcacgaacaccaccaccgtcccggggacgagccagtcccccaagccccccgccagcaccaccctgcagcacaccccggagtccagcacggtgaagctcaccacccccacctccgagacggagggcagcggcgagaccaccccccccccgaacaccacgcaggggctgcccccccccggcaccaccccggagcgctccgcgaccacggccaccagcacctccagcaccgacaacatgaactccacgacccaggtgaccgacaacacccccacgagcaccgtctccatcagcccctccagctcccccagcatgccgagcacctcccaggggatccactaccccatccggagcctgctctccgtgagctcccccaagaccgtgacgacccccaccccgatcagccccggcgagatgtcccccgagaccagctcccagcacagcgccatgtcccgcatccccacgctgtacaccgccacccaggtcagcaccgagaacaccaaccggtccacgccgcgccagagcgagtccagcgtgcagcccgccacccagtcccccatcaccagccccgcgcagaccatcctgctcatgtccgccgccccgaaggccatccaggacatgcaccccagccccacgaaccggagcaagcgcaacctggaggtggagatcatcctgaccctctcccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagcccgaccgagctgtcccacgtgcggctgcccacggcggagcccttcaagagctacttcgccaagggcttcctctccatcgacagcggctacttctccgccaagtgctacccccgcagctccaccagcgggctgcagctgatcaacgtgacccagcacccggcccggatcgccgagacccccggccccaagacgacctccctcaagaccatcaactgcatcaacctgcgcgcgagcgtcttcaaggagcaccgggaggtggagatcaacgtgctgctcccccagatcgccgtcaacctgtccaactgccacgtggtgatcaacagccacgtctgcgactactccctggacaccgacgggccggtgcgcctcccccggatccaccacgagggcacgttcatccccgggacctacaagatcgtgatcgacaagaagaacaagctgaacgaccgctgcagcctggtcaccaactgcgtgatcaagggccgggaggtgcgcaagggccagagcgtcctccggcagtacaagaccgagatcaagatcgggaaggcctccacgggcagccgcaagctgctgtccgaggagcccggggacgactgcatcagccggacccagctcctgaagaccgagaccgccgagatccacgacgacaactacggcgggccgggcgacaagatcacgatctgcaacggctccaccatcgtggaccagcgcctggggagcgagctcggctgctacaccatcaaccgcgtcaagtccttcaagctgtgcgagaacagcgccaccgggaagacgtgcgagatcgactccacccccgtgaagtgccggcagggcttctgcctgaagatcacccaggaggggcgcggccacgtgaagctgagccggggctccgaggtcgtgctcgacgtgtgcgacagctcctgcgagatcatgatccccaaggggaccggcgacatcctggtcgactgcagcgggggccagcagcacttcctgaaggacaacctcatcgacctgggctgcccccacatcccgctgctcgggaagatggcgatctacatctgccgcatgtccaaccacccccggacgaccatggccttcctgttctggttcagcttcggctacgtgatcacctgcatcttctgcaaggccctgttctactccctcatcatcatcgggaccctgggcaagaagatcaagcagtaccgcgagctgaagccccagacctgcacgatctgcgagaccgcccccgtgaacgccatcgacgcggagatgcacgacctcaactgcagctacaacatctgcccgtactgcgcctcccggctgaccagcgaggggctggcccgccacgtcacccagtgccccaagcggaaggagaaggtggaggagacggagctctacctgaacctggagcgcatcccctggatcgtgcggaagctcctgcaggtcagcgagtccaccggcgtggccctgaagcgcagctcctggctcatcgtgctgctggtcctcctgaccgtgagcctgtcccccgtgcagagcgccccggtcggccacgggaagaccatcgagacgtaccagacccgggagggcttcacctccatctgcctcttcatgctggggagcatcctgttcatcgtgtcctgcctcgtgaagggcctggtcgacagcgtgtccgacagcttcttccccgggctgtccgtgtgcaagacctgcagcatcggctccatcaacggcttcgagatcgagagccacaagtgctactgctccctcttctgctgcccctactgccgccactgcagcgcggaccgggagatccaccagctgcacctgtccatctgcaagaagcgcaagacggggagcaacgtcatgctcgccgtgtgcaagcggatgtgcttcaaggccaccatcgaggccagccgccgggcgctgctgatccgctccatcatcaacaccaccttcgtgatctgcatcctcacgctggccatctgcgtcgtgagcacctccgccgtggagatggaggacctgccggccggcacctgggagcgcgaggaggacctcaccaacttctgccaccaggagtgccaggtcacggagaccgagtgcctgtgcccctacgaggccctggtgctccggaagcccctgttcctggacagcatcgtgaaggggatgaagaacctcctgaactccaccagcctggagacctccctcagcatcgaggcgccctggggcgccatcaacgtccagtccacgttcaagccgaccgtgagcaccgccaacatcgccctgtcctggagctccgtggagcaccgcgggaacaagatcctggtcaccggccggagcgagtccatcatgaagctcgaggagcgcacgggcgtgagctgggacctgggggtggaggacgcctccgagagcaagctgctcaccgtctccatcatggacctgagccagatgtacagccccgtgttcgagtacctgtccggcgaccggcaggtggaggagtggcccaaggcgacctgcaccggggactgccccgagcgctgcggctgcacgagctccacctgcctccacaaggagtggccgcacagccggaactggcgctgcaaccccacctggtgctggggggtcggcaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggccggcacccgcttcaacctggggcccgtcacgatcaccctgtccgagccccggaacatccagcagaagctcccgcccgagatcatcaccctgcaccccaagatcgaggagggcttcttcgacctgatgcacgtgcagaaggtgctcagcgcctccaccgtctgcaagctgcagagctgcacgcacggcatccccggggacctgcagatctaccacatcggcaacctcctgaagggggaccgcgtgaacggccacctgatccacaagatcgagccgcacttcaacacctcctggatgagctgggacgggtgcgacctcgactactactgcaacatgggcgactggccctcctgcacctacaccggcgtcacgcagcacaaccacgccgcgttcgtgaacctgctgaacatcgagaccgactacaccaagaccttccacttccacagcaagcgggtgacggcccacggggacaccccccagctcgacctgaaggcccgccccacctacggcgccggggagatcaccgtcctggtggaggtggcggacatggagctccacacgaagaaggtcgagatctccggcctgaagttcgccagcctgacctgcaccgggtgctacgcctgctccagcggcatctcctgcaaggtgcggatccacgtggacgagccggacgagctcaccgtccacgtgaagagcagcgaccccgacgtggtcgccgcctccacgagcctgatggcgcgcaagctggagttcggcaccgactccaccttcaaggccttcagcgccatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacgggctgaagaacatgctgggcagcgtgttcgggtccttcttcgtgggcatcctcctgttcctggcgccgttcgtcctgctcgtgctgttcttcatgttcggctggaagatcctgttctgcttcaagtgctgccgccggacccgcgggctcttcaagtaccggcacctgaaggacgacgaggagaccggctaccgccgcatcatcgagcggctgaacagcaagaaggggaagaaccgcctcctggacggcgagcggctggccgaccgcaagatcgccgagctcttctccaccaagacgcacatcggctga

SEQ ID NO: 11969 - RNA, 5067 nt, synthetic construct
  misc_feature 1..5067: note = derived and/or modified CDS sequence (opt1) from CCHFV(4701-ST-2009)__KR814872.1__GP
  source 1..5067: mol_type = other RNA
atgcccatcaacatcatgcacaccctgctcgtgtgcttcatcctgtacctgcagctcagcggcctcgggggcgcccacgggcagtccaacgccaccgagcacaacggcacgaacaccaccaccgcgccggggacgagccagtcccccaagccgcccgccagcaccaccctgccccacacccccgagtccagcacggtcaagctcaccacccccacctccgagacggagggcagcggcgagaccacgcccccgcccaacaccacccaggggctgcccctgaccggcaccacccccgagcgctccgccacgaccgccaccagcacctccagcacggacaacatgaactccaccacccaggtgaccgacaacacgccgaccagcaccgtgtccatcagcccctccagctccagcagcatgccctccacgccccaggggacccaccacccggtccggagcctcctgtccgtgagctcccccaagaccgtgaccacccccacgcccatgagcccgggcgagatgtcccccgagaccagctcccagcacagcgccatgtcccgcgtccccaccctgtacaccgcgacccaggtgagcacggagaacaccgaccggtccacgccccgccagagcgagtccagcgtgcagccggccacccagtcccccatcaccagccccgcccagaccatcctcctgatgtccgccgcgcccaaggccatccaggacatgcacccgagccccaccaaccggagcaagcgcaacctggaggtcgagatcatcctcaccctgtcccaggggctgaagaagtactacggcaagatcctcaagctgctgcacctcacgctggaggaggacaccgagggcctgctcgagtggtgcaagcggaacctggggagcaactgcgacgacgacttcttccagaagcgcatcgaggagttcttcatcaccggcgaggggtacttcaacgaggtgctgcagttcaagaccctctccacgctgagccccaccgagccgtcccacgtgcggctgcccaccgccgagcccttcaagagctacttcgccaagggcttcctctccatcgacagcggctacttctccgccaagtgctacccccgcagctccaccagcgggctgcagctgatcaacgtcacgcagcacccggcgcggatcgccgagacccccggccccaagaccacctccctcaagacgatcaactgcatcaacctgcgcgccagcgtgttcaaggagcaccgggaggtggagatcaacgtcctgctcccccagatcgccgtgaacctgtccaactgccacgtggtcatcaacagccacgtgtgcgactactccctggacaccgacgggccggtgcgcctcccccggatccaccacgagggcaccttcatccccgggacctacaagatcgtcatcgaccgcaagaacaagctgaacgaccggtgcagcctggtgacgaactgcgtgatcaagggccgcgaggtccggaagggccagagcgtgctccgccagtacaagaccgagatcaagatcgggaaggcctccaccggcagccggaagctgctgtccgaggagcccggggacgactgcatcagccgcacccagctcctgaagacggagaccgcggagatccacgacgacaactacggcgggccgggcgacaagatcaccatctgcaacggctccaccgtcgtggaccagcgcctggggagcgagctcggctgctacacgatcaaccgggtgaagtccttcaagctgtgcgagaacagcgccaccgggaagacctgcgagatcgactccacccccgtcaagtgccgccagggcttctgcctgaagatcacgcaggaggggcggggccacgtgaagctgagccgcggctccgaggtggtcctcgacgcctgcgacagctcctgcgagatcatgatccccaaggggaccggcgacatcctggtggactgcagcgggggccagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggcgctgttctactccctcatcatcatcgggaccctgggcaagaagatcaagcagtaccgggagctgaagccccagacctgcaccatctgcgagaccgcccccgtcaacgccatcgacgccgagatgcacgacctcaactgcagctacaacatctgcccgtactgcgcctcccgcctgacgagcgacgggctggcgcggcacgtgacccagtgccccaagcgcaaggagaaggtggaggagaccgagctctacctgaacctggagcggatcccctggatcgtccgcaagctcctccaggtgagcgagtccaccggcgtggccctgaagcggagctcctggctgatcgtcctgctggtgctcctgacggtgagcctgtcccccgtccagagcgccccggtgggccacgggaagaccatcgagacctaccagacccgcgagggcttcacgtccatctgcctcttcatgctggggagcatcctgttcatcgtgtcctgcctcgtcaagggcctggtggacagcgtgtccgacagcttcttccccgggctgtccgtctgcaagacctgcagcatcggctccatcaacggcttcgagatcgagagccacaagtgctactgctccctcttctgctgcccctactgccggcactgcagcgccgaccgcgagatccaccagctgcacctgtccatctgcaagaagcggaagaccgggagcaacgtgatgctcgcggtgtgcaagcgcatgtgcttcaaggccaccatcgaggccagccggcgcgccctgctgatccgctccatcatcaacacgaccttcgtcatgtgcatcctcaccctggccatctgcgtggtgagcacctccgcggtcgagatggaggacctgccggccggcacgtgggagcgggaggaggacctcaccaacttctgccaccaggagtgccaggtgaccgagaccgagtgcctgtgcccctacgaggccctggtgctccgcaagcccctgttcctggacagcatcgtcaaggggatgaagaacctcctgaactccacgagcctggagacctccctcagcatcgaggccccctggggcgccatcaacgtgcagtccaccttcaagccgaccgtgagcacggcgaacatcgccctgtcctggagctccgtcgagcaccgggggaacaagatcctggtgaccggccgcagcgagtccatcatgaagctcgaggagcggaccggcgtgagctgggacctgggggtcgaggacgcctccgagagcaagctgctcaccgtgtccatcatggacctgagccagatgtacagccccgtgttcgagtacctgtccggcgaccgccaggtcgaggagtggcccaaggccacgtgcaccggggactgccccgagcggtgcggctgcaccagctccacgtgcctccacaaggagtggccgcacagccgcaactggcggtgcaaccccacctggtgctggggcgtggggaccggctgcacgtgctgcggggtggacgtcaaggacctgttcaccgaccacatgttcatcaagtggaaggtggagtacatcaagaccgaggccatcgtgtgcgtcgagctgacctcccaggagcgccagtgcagcctcatcgaggcgggcacccggttcaacctggggcccgtgaccatcaccctgtccgagccccgcaacatccagcagaagctcccgcccgagatcatcacgctgcaccccaagatcgaggagggcttcttcgacctgatgcacgtgcagaaggtcctcagcgcctccaccgtgtgcaagctgcagagctgcacccacggcatccccggggacctgcagatctaccacatcggcaacctcctgaagggggaccgggtcaacggccacctgatccacaagatcgagccgcacttcaacacctcctggatgagctgggacgggtgcgacctcgactactactgcaacatgggcgactggccctcctgcacgtacaccggcgtgacccagcacaaccacgccgccttcgtgaacctgctgaacatcgagaccgactacacgaagaccttccacttccacagcaagcgcgtcaccgcgcacggggacacgccccagctcgacctgaaggcccggcccacctacggcgccggggagatcaccgtgctggtggaggtcgccgacatggagctccacaccaagaaggtggagatctccggcctgaagttcgccagcctgacctgcacggggtgctacgcgtgctccagcggcatctcctgcaaggtgcgcatccacgtcgacgagccggacgagctcaccgtgcacgtcaagagcagcgaccccgacgtggtggccgcctccaccagcctgatggcccggaagctggagttcggcaccgactccacgttcaaggccttcagcgcgatgcccaagacctccctctgcttctacatcgtggagcgcgagtactgcaagagctgctccgaggacgacaccaagaagtgcgtcgacaccaagctggagcagccccagagcatcctgatcgagcacaaggggacgatcatcggcaagcagaacgacacgtgcaccgccaaggcctcctgctggctcgagagcgtgaagtccttcttctacgggctgaagaacatgctgggcagcgtgttcgggggcttcttcgtcggcatcctcctgttcctggccccgttcgtgctgctcgtgctgttcttcatgttcgggtggaagatcctgttctgcttcaagtgctgccggcgcacccggggcctcttcaagtaccgccacctgaaggacgacgaggagaccgggtaccgccggatcatcgagcgcctgaactccaagaagggcaagaaccggctcctggacggcgagcgcctggccgaccggaagatcgcggagctgttcagcaccaagacccacatcgggtga

SEQ ID NO: 11970 - RNA, 5067 nt, synthetic construct
  misc_feature 1..5067: note = derived and/or modified CDS sequence (opt1) from CCHFV(4574-ST-2008)__KR814870.1__GP
  source 1..5067: mol_type = other RNA
atgcccaccaacatcatgcacaccctgctcgtgtgcttcatcctgtacctgcagctcctgggcccggggggcgcccacgggcagcccaacgccacggagcacaaccgcaccaacaccaccacggcgcccagcacctcccagagccccaagccgcccgtctccaccgcccccccccacgccctggagagcccgaccatcaagtccacgacccccaccagcgagaccgagggctccggggagacgaccagcccccccaacaccacccagggcccgtccctccccgagacgacccccaagcggcccgccaccaccgccacgagcaccccgtccaccgacaacaccaacagcacgacccacgtgaccgacaacaaccccacctccacgatcagcacctcccccagctccagcccctccaccccgagcaccccccgcggcatccaccaccccgcgcggaacctgctgagcgtgtccagccccaagacggccaccaccccgacccccacgtcccccggggagatcagctccgagaccagctccctccacagcgccatgtcccgcaccagcaccctgtacaccgccacgcaggcgtccaccgagaacgccaaccacagcgccccccggcagtccgagagcccggcccagcccaccaccacgtccctgatgaccagccccgcccagtccatcctcgtcatgagcgcggccccgaccgccatccagaacatccacccctcccccaccaaccgcagcaagcggaacctggagatggagatcatcctgacgctcagccagggcctgaagaagtactacgggaagatcctgaagctcctgcacctgaccctcgaggaggacaccgagggcctgctggagtggtgcaagcgcaacctcgggtccaactgcgaggacgacttcttccagaagcggatcgaggagttcttcatgaccggcgagggctacttcaacgaggtgctgcagttcaagacgctgagcaccctctcccccaccgagccgagccacgcccgcccccccaccgtggagcccttcaagtcctacttcgccaaggggttcctgagcatcgactccggctacttcagcgcgaagtgctacccgcggtccagcacgtccgggctgcagctcatcaacgtcacccagcaccccgcccgcatcgccgagacccccggccccaagaccacgagcctgaagaccatcaactgcatcaacctgcgggcctccgtgttcaaggagcaccgcgagatcgagatcaacgtgctcctgccgcagatcgccgtcaacctgagcaactgccacgtggtgatcaactcccacgtctgcgactacagcctcgacaccgacggccccgtgcggctgccccacatctaccacgaggggaccttcatccccggcacgtacaagatcgtgatcgacaagaagaacaagctgaacgaccgctgcaccctcgtcaccaactgcgtgatcaaggggcgggaggtgcgcaagggccagtccgtcctgcggcagtacaagaccgagatcaagatcgggaaggtgagcacgggcagccgcaagctgctctccgaggagagcggcgacgactgcatctcccggacccagctgctgcgcaccgagaccgcggagatccacgacgacaactacgggggcccgggggacaagatcacgatctgcaacggcagcaccatcgtggaccagcgcctcgggtccgagctgggctgctacaccatcaaccgggtcaagagcttcaagctgtgcgagaactccgccaccggcaagacgtgcgagatcgacagcacccccgtgaagtgccgccaggggttctgcctcaagatcacccaggagggccgggggcacgtgaagctgtcccgcggcagcgaggtcgtgctggacgcctgcgactccagctgcgaggtcatgatccccaaggggaccggcgacatcctggtggactgctccggcgggcagcagcacttcctcaaggacaacctgatcgacctgggctgcccccacatcccgctcctggggaagatggccatctacatctgccggatgagcaaccacccccgcaccacgatggccttcctgttctggttctccttcggctacgtgatcacctgcctcttctgcaaggcgctgttctacagcctgatcatcatcggcaccctcgggaagaagatcaagcagtaccgggagctgcgcccccagacctgcacgatctgcgagaccgcccccgtcaacgccatcgacgccgagatgcacgacctgaactgctcctacaacatctgcccgtactgcgcgagccggctcacctccgacggcctggcccgccacgtgccccagtgccccaagcggaaggagaaggtggaggagaccgagctgtacctcaacctggagcgcatcccgtggatcgtccggaagctgctccaggtgagcgagagcacgggggtggccctgaagcgctccagctggctgatcgtcctcctggtgctgctcaccgtgtccctgagccccgtccagtccgcccccgtgggccacgggaagaccatcgagacctaccagacgcgggagggcttcaccagcatctgcctgttcatgctcggctccatcctgttcctggtgagctgcctcgtcaaggggctggtggactccgtgagcgactccttcttccccggcctgagcgtctgcaagacctgctccatcgggagcatcaacggcttcgagatcgagtcccacaagtgctactgcagcctcctgtgctgcccgtactgccgccactgctccgccgaccgggagatccaccagctgcacctcagcatctgcaagaagcgcaagaccgggtccaacgtgatgctggcggtgtgcaagcggatgtgcttccgcgccacgatcgaggccagccgccgggccctgctcatccgcagcatcatcaacaccaccttcgtcatctgcatcctgaccctgacgatctgcgtggtgtccaccagcgccgtcgagatggagaacctcccctccggcacctgggagaaggaggaggacctgaccaacttctgccaccaggagtgccaggtgacggagaccgagtgcctgtgcccctacgaggcgctcgtgctgcggaagcccctgttcctcgacagcatcgtcaagggcatgaagaacctgctgaactccaccagcctcgagacctccctgagcatcgaggccccgtggggggccatcaacgtgcagtccacgttcaagcccaccgtgagcaccgccaacatcgccctgtcctggagctccgtcgagcaccgcggcaacaagatcctcgtgaccgggcggagcgagtccatcatgaagctggaggagcgcacgggcgtgagctgggacctgggggtcgaggacgcgtccgagagcaagctcctgaccgtgtccatcatggacctgagccagatgtacagccccgtgttcgagtacctctccggcgaccggcaggtcgaggagtggcccaaggccacctgcaccggcgactgcccggagcgctgcgggtgcacgagctccacctgcctgcacaaggagtggccccacagccggaactggcgctgcaaccccacctggtgctggggcgtggggaccggctgcacctgctgcggggtggacgtcaaggacctgttcacggaccacatgttcgtgaagtggaaggtggagtacatcaagaccgaggccatcgtctgcgtggagctcacctcccaggagcggcagtgcagcctgatcgaggccggcacccgcttcaacctgggccccgtgacgatcaccctctccgagccgcggaacatccagcagaagctgccccccgagatcatcaccctgcaccccaaggtcgaggaggggttcttcgacctcatgcacgtgcagaaggtgctgagcgcgtccaccgtctgcaagctgcagagctgcacgcacggcatcccgggggacctccaggtgtaccacatcggcaacctgctgaagggcgaccgcgtgaacgggcacctcatccacaagatcgagccccacttcaacacctcctggatgagctgggacggctgcgacctggactactactgcaacatgggggactggccctcctgcacctacaccggcgtcacgcagcacaaccacgccgccttcgtgaacctgctcaacatcgagaccgactacaccaagaccttccacttccacagcaagcgggtcacggcccacggggacaccccccagctggacctgaaggcccgcccgacctacggcgcgggcgagatcaccgtgctcgtggaggtcgccgacatggagctgcacacgaagaaggtggagatctccgggctgaagttcgccagcctcgcctgcaccggctgctacgcctgctccagcgggatctcctgcaaggtgcggatccacgtcgacgagcccgacgagctgaccgtgcacgtgaagagcagcgaccccgacgtcgtggcggcctccaccagcctgatggcccgcaagctcgagttcggcacggactccaccttcaaggccttcagcgccatgcccaagacctccctgtgcttctacatcgtggagcgggagtactgcaagagctgctccgaggaggacacccagaagtgcgtcgacacgaagctggagcagccgcagagcatcctcatcgagcacaaggggaccatcatcggcaagcagaacgacacctgcaccgcgaaggcctcctgctggctggagagcgtgaagtccttcttctacggcctgaagaacatgctcgggagcgtgttcggcaacttcttcatcgggatcctgctgttcctggcccccttcgtcctcctggtgctgttcttcatgttcggctggaagatcctcttctgcttcaagtgctgccgccgggcccgcgggctgctgaagtaccgccacctcaaggacgacgaggagacgggctaccggaagatcatcgagcgcctgaacaacaagaagggcaagaaccggctgctcgacggggagcgcctggcggaccggaagatcgccgagctgttctccaccaagacccacatcggctga

SEQ ID NO: 11971 - RNA, 5067 nt, synthetic construct
  misc_feature 1..5067: note = derived and/or modified CDS sequence (opt1) from CCHFV(4495-ST-2008)__KR814869.1__GP
  source 1..5067: mol_type = other RNA
atgcccaccaacatcatgcacaccctgctcgtgtgcttcatcctgtacctgcagctcctgggcccggggggcgcccacgggcagcccaacgccacggagcacaaccgcaccaacaccaccacggcgcccagcacctcccagagccccaagccgcccgtctccaccgcccccccccacgccctggagagcccgaccatcaagtccacgacccccaccagcgagaccgagggctccggggagacgaccccccccccgaacaccacccagggccccagcccccccgagacgaccccggagcggcccgccaccaccgccacgtccacccccagcaccgacaacaccaactccacgacccacgtgaccgacaacaaccccaccagcacgatctccaccagcccgtccagctcccccagcaccccctccaccccccgcggcatccaccacccggcgcggaacctcctgagcgtgagctcccccaagacggccaccacccccacccccacgagcccgggggagatctccagcgagacctccagcctgcactccgccatgagccgcacctccaccctctacaccgccacgcaggcgagcaccgagaacgccaaccactccaccccccggcagagcgagtcccccgcccagccgaccacgaccagcctgatgacctcccccgcccagagcatcctggtcatgtccgccgcgcccaccgccatccagaacatccaccccagcccgacgaaccgctccaagcggaacctcgagatggagatcatcctgaccctgagccagggcctcaagaagtactacgggaagatcctgaagctgctccacctgaccctggaggaggacaccgagggcctcctggagtggtgcaagcgcaacctggggagcaactgcgacgacgacttcttccagaagcggatcgaggagttcttcatgacgggcgagggctacttcaacgaggtgctccagttcaagaccctgtccaccctgagccccaccgagccctcccacgcccgccccccgacggtggagcccttcaagagctacttcgccaaggggttcctctccatcgacagcggctacttctccgccaagtgctacccccggagctccaccagcgggctgcagctgatcaacgtcacccagcaccccgcgcgcatcgccgagaccccgggccccaagacgacctccctcaagaccatcaactgcatcaacctgcgggccagcgtgttcaaggagcaccgcgagatcgagatcaacgtgctgctcccccagatcgccgtcaacctgtccaactgccacgtggtgatcaacagccacgtctgcgactactccctggacaccgacggccccgtgcggctcccgcacatctaccacgaggggacgttcatccccggcacctacaagatcgtgatcgacaagaagaacaagctgaacgaccgctgcaccctggtcaccaactgcgtgatcaaggggcgggaggtgcgcaagggccagagcgtcctccggcagtacaagacggagatcaagatcgggaaggtgtccaccggcagccgcaagctgctgagcgaggagtccggcgacgactgcatcagccggacccagctcctgcgcaccgagacggccgagatccacgacgacaactacgggggccccggggacaagatcaccatctgcaacggctccaccatcgtggaccagcgcctggggagcgagctcggctgctacaccatcaaccgggtcaagtccttcaagctgtgcgagaacagcgcgacgggcaagacctgcgagatcgactccacccccgtgaagtgccgccaggggttctgcctgaagatcacccaggagggccgggggcacgtgaagctcagccgcggctccgaggtcgtgctggacgcctgcgacagctcctgcgaggtcatgatcccgaaggggaccggcgacatcctggtggactgcagcggcgggcagcagcacttcctgaaggacaacctcatcgacctgggctgcccccacatccccctgctcgggaagatggccatctacatctgccggatgtccaaccacccccgcacgaccatggccttcctgttctggttcagcttcggctacgtgatcacctgcctgttctgcaaggccctcttctactccctgatcatcatcggcaccctggggaagaagatcaagcagtaccgggagctccgcccgcagacgtgcaccatctgcgagaccgcgcccgtcaacgccatcgacgccgagatgcacgacctgaactgcagctacaacatctgcccctactgcgcctcccggctgaccagcgacggcctcgcgcgccacgtgccgcagtgccccaagcggaaggagaaggtggaggagacggagctgtacctgaacctcgagcgcatcccctggatcgtccggaagctgctgcaggtgtccgagagcaccggggtggccctcaagcgcagctcctggctgatcgtcctgctcgtgctgctgaccgtgagcctctcccccgtccagagcgccccggtgggccacgggaagaccatcgagacgtaccagacccgggagggcttcacctccatctgcctgttcatgctgggcagcatcctcttcctggtgtcctgcctggtcaaggggctcgtggacagcgtgtccgacagcttcttccccggcctgtccgtctgcaagacctgcagcatcgggtccatcaacggcttcgagatcgagagccacaagtgctactgctccctgctctgctgcccctactgccgccactgcagcgccgaccgggagatccaccagctgcacctgtccatctgcaagaagcgcaagacggggagcaacgtgatgctcgccgtgtgcaagcggatgtgcttccgcgcgaccatcgaggcctcccgccgggccctgctgatccgcagcatcatcaacaccaccttcgtcatctgcatcctcacgctgaccatctgcgtggtgagcacctccgccgtcgagatggagaacctgcccagcggcacctgggagaaggaggaggacctcacgaacttctgccaccaggagtgccaggtgaccgagaccgagtgcctgtgcccgtacgaggccctggtgctccggaagcccctgttcctggactccatcgtcaagggcatgaagaacctcctgaacagcacctccctggagacgagcctctccatcgaggcgccctggggggccatcaacgtgcagagcaccttcaagcccaccgtgtccaccgccaacatcgccctgagctggtccagcgtcgagcaccgcggcaacaagatcctggtgacggggcggtccgagagcatcatgaagctcgaggagcgcaccggcatctcctgggacctgggggtggaggacgccagcgagtccaagctgctcaccgtcagcatcatggacctgtcccagatgtacagcccggtgttcgagtacctgagcggcgaccggcaggtggaggagtggcccaaggcgacctgcacgggcgactgccccgagcgctgcgggtgcacctccagcacctgcctccacaaggagtggccccactcccggaactggcgctgcaacccgacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgaccagccaggagcggcagtgctccctcatcgaggccggcacgcgcttcaacctgggccccgtgaccatcaccctgagcgagccccggaacatccagcagaagctccccccggagatcatcaccctgcaccccaaggtggaggaggggttcttcgacctgatgcacgtccagaaggtgctctccgccagcacggtgtgcaagctgcagtcctgcacccacggcatccccggggacctgcaggtctaccacatcggcaacctcctgaagggcgaccgcgtgaacgggcacctgatccacaagatcgagccccacttcaacaccagctggatgtcctgggacggctgcgacctcgactactactgcaacatgggggactggccgagctgcacctacacgggcgtgacccagcacaaccacgcggccttcgtcaacctgctgaacatcgagaccgactacaccaagacgttccacttccactccaagcgggtgaccgcccacggggacaccccccagctcgacctgaaggcccgccccacctacggcgccggcgagatcacggtcctggtggaggtggcggacatggagctccacaccaagaaggtcgagatcagcgggctgaagttcgcctccctggcctgcaccggctgctacgcctgcagctccgggatcagctgcaaggtgcggatccacgtggacgagcccgacgagctcaccgtccacgtgaagtccagcgacccggacgtggtcgccgcgagcacgtccctgatggcccgcaagctggagttcggcaccgacagcaccttcaaggccttctccgccatgcccaagaccagcctctgcttctacatcgtggagcgggagtactgcaagtcctgcagcgaggaggacacgcagcgctgcgtggacaccaagctggagcagccccagtccatcctgatcgagcacaaggggaccatcatcggcaagcagaacgacacctgcacggccaaggcgagctgctggctcgagtccgtcaagagcttcttctacggcctgaagaacatgctggggtccgtgttcggcaacttcttcatcgggatcctcctgttcctggccccgttcgtgctgctcgtcctgttcttcatgttcggctggaagatcctgttctgcttcaagtgctgccggcgcgcccgcgggctcctgaagtaccggcacctgaaggacgacgaggagaccggctaccgcaagatcatcgagcggctcaacaacaagaagggcaagaaccgcctgctggacggggagcggctcgccgaccgcaagatcgcggagctgttcagcaccaagacccacatcggctga

SEQ ID NO: 11972 - RNA, 5067 nt, synthetic construct
  misc_feature 1..5067: note = derived and/or modified CDS sequence (opt1) from CCHFV(3809-ST-2007)__KR814867.1__GP
  source 1..5067: mol_type = other RNA
atgcccaccaacatcatgcacaccctgctcgtgtgcttcatcctgtacctgcagctcctgggcctcgggggcgcccaggggcagagcaacgccacggagcacaacgagaccaacaccaccacggcgccgtccaccagccagtcccccaagccgcccgtcagcaccacgcccctgcacgccctggagtccagcaccatcaagcccaccacccccgcccgcgagaccgagggctccggggagacgacgcccccgcccaacaccacccagggccccagcccgcccgaggccacccccgagcggcccgccaccaccgcgacctccgcccccagcacggacaacaccaactccaccacccacgtgacggacaacaacccgaccagcaccatctccaccagcccctccagctcccccagcacgcccttcaccccgcagggcatccaccaccccgcccgcaacctgctctccgtgagcagccccaagaccgccaccacgcccaccccgacctcccccggggagctgagctccgagaccagctccctgcacagcgcgatctcccggacgagcaccctctacaccgccacccaggtctccaccgagaacgccaaccacagcgcgccccgccagtccgagagctccgcccagcccacgaccaccagcccgatgacctcccccgcccagagcatcctggtgatgtccgccgcccccacggccatccagaacatccacccgagccccaccaaccggtccaagcgcaacctggagatggagatcatcctcaccctgagccagggcctgaagaagtactacgggaagatcctcaagctgctgcacctcaccctggaggaggacacggagggcctgctcgagtggtgcaagcggaacctggggagcaactgcgacgacgacttcttccagaagcgcatcgaggagttcttcatgaccggcgagggctacttcaacgaggtgctgcagttcaagaccctctccaccctgagccccacggagccctcccacgcccggccgcccgcggtcgagcccttcaagagctacttcgccaaggggttcctgtccatcgacagcggctacttctccgccaagtgctacccccgcagctccaccagcgggctccagctgatcaacgtgacccagcacccggcccggatcgccgagacccccggccccaagacgacctccctgaagaccatcaactgcatcaacctccgcgcgagcgtgttcaaggagcaccgggagatcgagatcaacgtcctgctgccccagatcgccgtgaacctctccaactgccacgtggtcatcaacagccacgtgtgcgactactccctggacaccgacggcccggtgcgcctgccccacatctaccacgaggggacgttcatccccggcacctacaagatcgtcatcgacaagaagaacaagctcaacgaccggtgcaccctggtgaccaactgcgtgatcaaggggcgcgaggtccggaagggccagagcgtgctgcgccagtacaagacggagatcaagatcgggaaggcctccaccggcagccggaagctcctgagcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctggacgcgtgcgactccagctgcgaggtcatgatccccaaggggacgggcgacatcctcgtggactgctccggcgggcagcagcacttcctgaaggacaacctgatcgacctcggctgcccccacatcccgctgctggggaagatggccatctacatctgccgcatgagcaaccacccccggaccaccatggccttcctcttctggttctccttcggctacgtgatcacgtgcatcttctgcaaggccctgttctacagcctgatcatcatcggcaccctcgggaagaagatcaagcagtaccgcgagctgaagccccagacctgcaccatctgcgagaccgcgcccgtcaacgccatcgacgccgagatgcacgacctgaactgctcctacaacatctgcccgtactgcgccagccggctcacctccgacggcctggcccgccacgtgccccagtgccccaagcggaaggagaaggtggaggagacggagctgtacctcaacctggagcgcatcccgtggatcgtccggaagctgctccaggtgagcgagtccaccggggtggcgctgaagcgcagcagctggctgatcgtcctcctggtgctgctcaccgtgtccctgagccccgtccagtccgcccccgtgggccacgggaagaccatcgagacgtaccagacccgggagggcttcaccagcatctgcctgttcatgctcggctccatcctgttcctggtgagctgcctcgtcaaggggctggtggactccgtgagcgactccttcttccccggcctgagcgtctgcaagacctgctccatcgggagcgtgaacggcttcgagatcgagtcccacaagtgctactgcagcctcttctgctgcccgtactgccgccactgctccgccgaccgggagatccaccagctgcacctgagcgtgtgcaagaagcgcaagacggggtccaacgtcatgctcgccgtgtgcaagcggatgtgcttccgcgccaccatcgaggcgagccggcgcgccctgctgatccgctccatcatcaacaccaccttcgtgatctgcatcctcacgctgaccatctgcgtcgtgagcaccagcgccgtggagatggagaacctgcccgccggcacctgggagcgggaggaggacctcacgaacttctgccaccaggagtgccaggtcaccgagaccgagtgcctgtgcccctacgaggccctggtgctccgcaagcccctgttcctggactccatcgtgaagggcatgaagaacctcctgaacagcacctccctggagacgagcctctccatcgaggcgccgtggggcgccatcaacgtccagagcaccttcaagcccaccgtgtccaccgccaacatcgccctgagctggtccagcgtggagcaccgggggaacaagatcctggtcacggggcgctccgagagcatcatgaagctcgaggagcggaccggcgtgtcctgggacctgggggtggaggacgcgagcgagtccaagctgctcaccgtcagcatcatggacctgtcccagatgtacagccccgtgttcgagtacctgtccggcgaccgccaggtggaggagtggcccaaggcgacctgcacgggcgactgcccggagcggtgcgggtgcaccagctccacgtgcctccacaaggagtggccccacagccgcaactggcggtgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgaccagccaggagcgccagtgctccctcatcgaggccggcacccggttcaacctgggccccgtgaccatcaccctgagcgagccgcgcaacatccagcagaagctcccgcccgagatcatcaccctgcaccccaaggtggaggaggggttcttcgacctgatgcacgtccagaaggtgctctccgccagcacggtgtgcaagctgcagtcctgcacccacggcatccccggggacctgcaggtctaccacatcggcaacctcctgaagggcgaccgggtgaacgggcacctgatccacaagatcgagccccacttcaacaccagctggatgtcctgggacggctgcgacctcgactactactgcaacatgggggactggcccagctgcacctacacgggcgtcacccagcacaaccacgccgccttcgtgaacctgctgaacatcgagaccgactacaccaagacgttccacttccactccaagcgcgtgaccgcccacggggacacgccccagctcgacctgaaggcccggccgacctacggcgccggcgagatcaccgtcctggtggaggtggcggacatggagctccacaccaagaaggtcgagatcagcgggctgaagttcgcctccctggcctgcaccggctgctacgcctgcagctccgggatcagctgcaaggtgcgcatccacgtggacgagcccgacgagctcaccgtccacgtgaagtccagcgaccccgacgtggtcgccgcgtccacgagcctgatggcccggaagctggagttcggcaccgacagcaccttcaaggccttctccgccatgcccaagaccagcctctgcttctacatcgtggagaaggagtactgccgctcctgcagcgaggaggacacgcagaagtgcgtggacaccaagctggagcagccgcagtccatcctgatcgagcacaaggggaccatcatcggcaagcagaacgacacgtgcaccgcgaaggccagctgctggctcgagtccgtcaagagcttcttctacggcctgaagaacatgctggggtccgtgttcggcaacttcttcatcgggatcctcctgttcctgacccccttcgtgctgctcgtcctgttcttcatgttcggctggaagatcctgttctgcttcaagtgctgccggcgcacccgggggctcctgaagtaccgccacctgaaggacgacgaggagaccggctaccgccggatcatcgagcgcctcaacaacaagaagggcaagaaccggctgctggacggggagcgcctcgccgaccggaagatcgccgagctgttcagcacgaagacccacatcggctga

SEQ ID NO: 11973 - RNA, 5067 nt, synthetic construct
  misc_feature 1..5067: note = derived and/or modified CDS sequence (opt1) from CCHFV(3756-ST-2007)__KR814866.1__GP
  source 1..5067: mol_type = other RNA
atgcccatcaacatcatgcacaccctgctcgtgtgcttcatcctgtacctgcagctcagcggcctggggggcgcccacgggcagtccaacgccaccgagcacaaccgcacgaacaccaccaccgtcccgggcacgagccagtcccccaagccccccgcgagcaccaccctgccgcacacccccgagtccagcacggtgaagctcaccacccccacctccgagacggaggggagcggcgagaccacccccccgcccaacaccacgcagggcctgcccctgcccgggaccaccccggagcggtccgccaccacggccaccagcacctccagcaccgacaacatgaacacgaccacccaggtgaccgacaacacgcccacctccaccgtcagcatctcccccagctccagcccctccatgccgagcaccagccagggcatccactaccccgtgcgctccctcctgagcgtgtccagccccaagacggtcaccacccccaccccgatgtcccccggggagatgagccccgagacgtccagccagcactccgccatgagccggatccccaccctgtacaccgccacccaggtgtccaccgagaacatcaaccgcagcacgccgcggcagtccgagagctccgtgcagcccgcgacccagagccccatcacctcccccgcccagaccatcctcctgatgagcgccgccccgaaggcgatccaggacatgcacccctcccccacgaaccgcagcaagcggaacctggaggtcgagatcatcctcaccctgagccagggcctgaagaagtactacgggaagatcctcaagctgctgcacctcaccctggaggaggacaccgagggcctgctcgagtggtgcaagcgcaacctgggctccaactgcgacgacgacttcttccagaagcggatcgaggagttcttcatcacgggggagggctacttcaacgaggtgctgcagttcaagaccctcagcaccctgtccccgaccgagcccagccacgtgcgcctgcccacggccgagcccttcaagtcctacttcgccaaggggttcctcagcatcgactccggctacttcagcgccaagtgctacccgcggtccagcacctccggcctgcagctgatcaacgtcacccagcaccccgcccgcatcgcggagacccccgggcccaagacgaccagcctcaagaccatcaactgcatcaacctgcgggcctccgtgttcaaggagcaccgcgaggtggagatcaacgtcctgctcccgcagatcgccgtgaacctgagcaactgccacgtggtcatcaactcccacgtgtgcgactacagcctggacaccgacggccccgtgcggctcccccgcatccaccacgaggggacgttcatccccggcacctacaagatcgtcatcgaccggaagaacaagctgaacgaccgctgctccctggtgaccaactgcgtgatcaaggggcgggaggtccgcaagggccagagcgtgctccggcagtacaagaccgagatcaagatcggcaaggccagcacggggtcccgcaagctgctgagcgaggagccgggcgacgactgcatctcccgcacccagctcctgaagaccgagaccgccgagatccacgacgacaactacgggggccccggggacaagatcacgatctgcaacggcagcaccatcgtcgaccagcggctgggctccgagctcgggtgctacaccatcaaccgcgtgaagagcttcaagctgtgcgagaactccgcgaccggcaagacgtgcgagatcgacagcacccccgtgaagtgccggcaggggttctgcctgaagatcacccaggagggccgcgggcacgtcaagctgtcccggggcagcgaggtggtgctcgacgcctgcgactccagctgcgagatcatgatccccaagggcaccggggacatcctggtcgactgctccggcgggcagcagcacttcctgaaggacaacctcatcgacctgggctgcccgcacatccccctgctcggcaagatggccatctacatctgccgcatgagcaaccacccccggacgaccatggccttcctgttctggttctccttcgggtacgtgatcacctgcatcttctgcaaggccctgttctacagcctcatcatcatcggcaccctggggaagaagatcaagcagtaccgcgagctgaagccccagacctgcacgatctgcgagaccgcgccggtgaacgccatcgacgccgagatgcacgacctcaactgctcctacaacatctgcccctactgcgccagccggctgacctccgacggcctggcccgccacgtcacccagtgccccaagcggaaggagaaggtggaggagacggagctctacctgaacctggagcgcatcccctggatcgtgcggaagctcctgcaggtcagcgagagcaccggggtggcgctgaagcgctccagctggctcatcgtgctgctggtcctcctgaccgtgtccctgagcccggtgcagtccgcccccgtcggccacggcaagaccatcgagacgtaccagacccgggaggggttcaccagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccgtactgccgccactgctccgccgaccgggagatccaccagctgcacctgagcatctgcaagaagcgcaagacgggctccaacgtcatgctcgccgtgtgcaagcggatgtgcttcaaggcgaccatcgaggccagccgccgcgccctgctgatccggagcatcatcaacaccaccttcgtgatctgcatcctcacgctggccatctgcgtcgtgtccaccagcgccgtggagatggaggacctgcccgcggggacctgggagcgcgaggaggacctcaccaacttctgccaccaggagtgccaggtcacggagaccgagtgcctgtgcccctacgaggccctggtgctccggaagcccctgttcctggactccatcgtgaagggcatgaagaacctcctgaacagcacctccctggagaccagcctctccatcgaggccccgtggggggccatcaacgtccagagcacgttcaagcccaccgtgtccaccgccaacatcgcgctgagctggtccagcgtggagcaccgcggcaacaagatcctggtcaccgggcggtccgagagcatcatgaagctcgaggagcgcacgggcgtgtcctgggacctgggcgtggaggacgccagcgagtccaagctgctcaccgtcagcatcatggacctgtcccagatgtacagccccgtgttcgagtacctgagcggggaccggcaggtggaggagtggcccaaggccacctgcaccggcgactgcccggagcgctgcgggtgcacgtccagcacctgcctccacaaggagtggccccactcccggaactggcgctgcaaccccacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctgaccagccaggagcggcagtgctccctcatcgaggccgggacccgcttcaacctgggccccgtcacgatcaccctgagcgagccgcggaacatccagcagaagctcccccccgagatcatcaccctgcaccccaagatcgaggaggggttcttcgacctgatgcacgtgcagaaggtgctctccgcgagcaccgtctgcaagctgcagtcctgcacgcacggcatcccgggcgacctgcagatctaccacatcgggaacctcctgaagggcgaccgcgtgaacgggcacctgatccacaagatcgagccccacttcaacaccagctggatgtcctgggacggctgcgacctcgactactactgcaacatgggggactggcccagctgcacctacaccggcgtcacgcagcacaaccacgccgccttcgtgaacctgctgaacatcgagaccgactacaccaagaccttccacttccactccaagcgggtgacggcccacggcgacaccccccagctcgacctgaaggcgcgcccgacctacggggccggcgagatcaccgtcctggtggaggtggccgacatggagctccacacgaagaaggtcgagatcagcgggctgaagttcgcctccctgacctgcaccggctgctacgcctgcagctccgggatcagctgcaaggtgcggatccacgtggacgagcccgacgagctcaccgtccacgtgaagtccagcgaccccgacgtggtcgcggccagcacgtccctgatggcccgcaagctggagttcggcaccgacagcaccttcaaggccttctccgccatgcccaagaccagcctctgcttctacatcgtggagcgggagtactgcaagtcctgcagcgaggacgacacgaagaagtgcgtggacaccaagctggagcagccgcagtccatcctgatcgagcacaagggcaccatcatcgggaagcagaacgacacctgcacggcgaaggccagctgctggctcgagtccgtcaagagcttcttctacggcctgaagaacatgctggggtccgtgttcggcagcttcttcgtggggatcctcctgttcctgacccccttcgtcctgctcgtgctgttcttcatgttcggctggaagatcctgttctgcttcaagtgctgccgccggacccgcggcctcttcaagtaccgccacctgaaggacgacgaggagaccgggtaccggcgcatcatcgagcggctgaactccaagaagggcaagaaccgcctcctggacggggagcggctggccgaccgcaagatcgccgagctcttcagcacgaagacccacatcggctga

SEQ ID NO: 11974 - RNA, 5067 nt, synthetic construct
  misc_feature 1..5067: note = derived and/or modified CDS sequence (opt1) from CCHFV(81-R-2014)__KR814865.1__GP
  source 1..5067: mol_type = other RNA
atgcccaccaacatcatgcacaccctgctcgtgtgcttcatcctgtacctgcagctcctgggcctggggggcgcccacgggcagagcaacgccacggagcacaacggcaccaacaccaccacggtcccgtccaccagccagtcccccaagcccctcgtgagcaccacccccccgcacgcgctggagtccagcacgatcaagcccaccacccccacctccgagacggaggggagcggcgagaccgcccccctgccgaacaccacccagggccccccccccccggagacgacccccgagcgccccgccaccaccgtgacgtccacccccagcaccgacaacaccaactccacgatccacgtcaccgacaacaacccgaccagcaccatctccacgagcccctccagctcccccagcaccccctccaccccgcaggggatccaccaccccgcccggagcctcctgagcgtgtccagccccaagaccgccacgacccccaccccgacctcccccggcgagatcaacagcgagacgtccagcctgcactccgcgatgagccgcacccccaccctccacaccgccacccaggtgtccacggagaacgccaaccacagcgccccccggcagtccgagagctccgcgcagccgaccaccaccagcctgatgacgtcccccgcccagagcatcctgctcatgtccgccgcccccaccgccatccagaacacccacccgagccccaccaaccgctccaagcggaacctggagatggagatcatcctgacgctcagccaggggctgaagaagtactacggcaagatcctgaagctcctgcacctgaccctcgaggaggacaccgaggggctgctggagtggtgcaagcgcaacctcggcagcaactgcgacgacgacttcttccagaagcggatcggcgagttcttcatgaccggggagggctacttcaacgaggtcctgcagttcaagacgctgtccaccctcagccccaccgagccctcccacgcgcgcctgccgaccgtggagcccttcaagagctacttcgccaaggggttcctgtccatcgacagcggctacttctccgccaagtgctacccccggagctccacgagcggcctccagctgatcaacgtgacccagcaccccgcccgcatcgccgagaccccggggcccaagaccacgtccctgaagaccatcaactgcatcaacctccgggcgagcgtcttcaaggagcaccgcgagatcgagatcaacgtgctgctgccccagatcgccgtgaacctctccaactgccacgtcgtgatcaacagccacgtgtgcgactactccctggacaccgacggccccgtccggctgccgcacatctaccacgaggggaccttcatccccggcacgtacaagatcgtgatcgacaagaagaacaagctcaacgaccgctgcaccctggtgaccaactgcgtcatcaaggggcgggaggtgcgcaagggccagagcgtgctgcggcagtacaagaccgagatcaagatcggcaaggcctccacggggagccgcaagctcctgagcgaggagcccggcgacgactgcatctcccggacccagctgctccgcaccgagaccgccgagatccacgacgacaactacgggggccccggggacaagatcacgatctgcaacggcagcaccatcgtcgaccagcggctgggctccgagctggggtgctacaccatcaaccgcgtgaagagcttcaagctgtgcgagaactccgccaccggcaagacgtgcgagatcgacagcaccccggtgaagtgccgccaggggttctgcctcaagatcacccaggagggccgggggcacgtcaagctgtcccgcggcagcgaggtggtcctggacgcgtgcgactccagctgcgaggtgatgatccccaagggcaccggggacatcctcgtggactgctccggcgggcagcagcacttcctgaaggacaacctgatcgacctcggctgcccccacatccccctgctgggcaagatggccatctacatctgccggatgagcaaccacccgcgcaccacgatggccttcctcttctggttctccttcgggtacgtcatcacctgcatcttctgcaaggccctgttctacagcctgatcatcatcggcaccctcgggaagaagatcaagcagtaccgggagctgaagccccagacctgcacgatctgcgagaccgcccccgtgaacgcgatcgacgccgagatgcacgacctgaactgctcctacaacatctgcccctactgcgccagccgcctcacctccgacggcctggcccggcacgtgccgcagtgccccaagcgcaaggagaaggtcgaggagaccgagctgtacctcaacctggagcggatcccctggatcgtgcgcaagctgctccaggtgagcgagtccacgggggtcgcgctgaagcggagcagctggctgatcgtgctcctggtgctgctcaccgtctccctgagcccggtgcagtccgcccccgtgggccacggcaagaccatcgagacctaccagacgcgcgaggggttcaccagcatctgcctgttcatgctcggctccatcctgttcctggtcagctgcctcgtgaaggggctggtggactccgtcagcgactccttcttccccggcctgagcgtgtgcaagacctgctccatcgggagcatcaacggcttcgagatcgagtcccacaagtgctactgcagcctcttctgctgcccctactgccggcactgctccgccgaccgcgagatccaccagctgcacctgagcatctgcaagaagcggaagaccggctccaacgtgatgctcgccgtctgcaagcgcatgtgcttccgggccacgatcgaggcgagccgccgggccctgctgatccgctccatcatcaacaccaccttcgtgatctgcatcctcaccctgacgatctgcgtggtcagcaccagcgccgtggagatggagaacctgccggccgggacctgggagcgcgaggaggacctcaccaacttctgccaccaggagtgccaggtgacggagaccgagtgcctgtgcccctacgaggccctggtcctccggaagcccctgttcctggactccatcgtgaagggcatgaagaacctcctgaacagcacctccctggagaccagcctctccatcgaggcgccctggggggccatcaacgtgcagagcacgttcaagccgaccgtctccaccgccaacatcgccctgagctggtccagcgtggagcaccgcggcaacaagatcctggtgaccgggcggtccgagagcatcatgaagctcgaggagcgcacgggcgtctcctgggacctgggcgtggaggacgccagcgagtccaagctgctcaccgtgagcatcatggacctgtcccagatgtacagccccgtcttcgagtacctgtccggggaccggcaggtggaggagtggcccaaggcgacctgcaccggcgactgccccgagcgctgcgggtgcacgagcagcacctgcctccacaaggagtggccgcactcccggaactggcgctgcaaccccacctggtgctggggcgtggggaccggctgcacctgctgcggcgtcgacgtgaaggacctgttcacggaccacatgttcgtgaagtggaaggtcgagtacatcaagaccgaggccatcgtgtgcgtggagctgaccagccaggagcggcagtgctccctcatcgaggccgggacccgcttcaacctgggccccgtcacgatcaccctgagcgagccccggaacatccagcagaagctcccgcccgagatcatcaccctgcaccccaaggtggaggaggggttcttcgacctgatgcacgtgcagaaggtcctctccgccagcaccgtgtgcaagctgcagtcctgcacgcacggcatccccggcgacctgcaggtgtaccacatcgggaacctcctgaagggcgaccgcatcaacgggcacctgatccacaagatcgagccgcacttcaacaccagctggatgtcctgggacggctgcgacctcgactactactgcaacatgggggactggcccagctgcacctacaccggcgtcacgcagcacaaccacgcggccttcgtgaacctgctgaacatcgagaccgactacaccaagaccttccacttccactccaagcgggtcacggcccacggcgacaccccccagctcgacctgaaggcccgccccacctacggggccggcgagatcaccgtgctggtggaggtcgcggacatggagctccacacgaagaaggtggagatcagcgggctgaagttcgcctccctggcctgcaccggctgctacgcctgcagctccgggatcagctgcaaggtgcggatccacgtcgacgagccggacgagctcaccgtgcacgtgaagtccagcgaccccgacgtcgtggccgcgtccaccagcctgatggcccgcaagctggagttcggcacggacagcaccttcaaggccttctccgccatgcccaagaccagcctctgcttctacatcgtggagcgggagtactgcaagtcctgcagcgaggaggacacccagaagtgcgtcgacacgcgcctggagcagccccagtccatcctgatcgagcacaagggcaccatcatcgggaagcagaacgacacctgcaccgccaaggcgagctgctggctcgagtccgtgaagagcttcttctacggcctgaagaacatgctggggtccgtgttcggcaacttcttcatcgggatcctgctcttcctggccccgttcgtcctgctcgtgctgttcttcatgttcggctggaagatcctgttctgcttcaagtgctgccggcgcacgcggggcctcctgaagtaccgccacctgaaggacgacgaggagaccgggtaccgccggatcatcgagcgcctcaacaacaagaagggcaagaaccggctgctggacggggagcgcctcgccgaccggaagatcgccgagctgttcagcaccaagacccacatcggctga

SEQ ID NO: 11975 - RNA, 5067 nt, synthetic construct
  misc_feature 1..5067: note = derived and/or modified CDS sequence (opt1) from CCHFV(75-ST-2010)__KR814864.1__GP
  source 1..5067: mol_type = other RNA
atgcccaccaacatcatgcacaccctgctcgtgtgcttcatcctgtacctgcagctcctgggcccggggggcgcccacgggcagcccaacgccacggagcacaaccgcaccaacaccaccacggcgcccagcacctcccagagccccaagccgcccgtctccaccgcccccccccacgccctggagagcccgaccatcaagtccacgacccccaccagcgagaccgagggctccggggagacgaccccccccccgaacaccacccagggccccagcctccccgagacgacccccgagcggccggccaccaccgccacgtccacccccagcaccgacaacaccaactccacgacccacgtgaccgacaacaaccccaccagcacgatctccaccagcccctccagctccccgagcaccccctccaccccccgcggcatccaccaccccgcgcggaacctgctgagcgtgagctccccgaagacggccaccacccccacccccacgagccccggggagatctccagcgagacctccagcctccactccgccatgagccgcacctccaccctgtacaccgccacgcaggcgagcaccgagaacgccaaccactccgccccgcggcagagcgagtcccccgcccagcccaccaccacgagcctgatgacctccccggcccagagcatcctcgtcatgtccgcggcccccaccgccatccagaacatccaccccagccccaccaaccgctccaagcggaacctggagatggagatcatcctgacgctcagccagggcctgaagaagtactacgggaagatcctgaagctcctgcacctgaccctcgaggaggacaccgagggcctgctggagtggtgcaagcgcaacctcgggagcaactgcgacgacgacttcttccagaagcggatcgaggagttcttcatgaccggcgagggctacttcaacgaggtgctgcagttcaagacgctgtccaccctcagcccgaccgagccctcccacgcccgcccccccaccgtggagccgttcaagagctacttcgccaaggggttcctgtccatcgacagcggctacttctccgcgaagtgctacccccggagctccacgagcgggctgcagctcatcaacgtcacccagcaccccgcccgcatcgccgagacccccggcccgaagaccacgtccctgaagaccatcaactgcatcaacctgcgggccagcgtgttcaaggagcaccgcgagatcgagatcaacgtgctcctgccccagatcgccgtcaacctgtccaactgccacgtggtgatcaacagccacgtctgcgactactccctcgacaccgacggccccgtgcggctgccccacatctaccacgaggggaccttcatcccgggcacgtacaagatcgtgatcgacaagaagaacaagctgaacgaccgctgcaccctcgtcaccaactgcgtgatcaaggggcgggaggtgcgcaagggccagagcgtcctgcggcagtacaagaccgagatcaagatcgggaaggtgtccacgggcagccgcaagctgctcagcgaggagtccggcgacgactgcatcagccggacccagctgctgcgcaccgagaccgcggagatccacgacgacaactacgggggccccggggacaagatcacgatctgcaacggctccaccatcgtggaccagcgcctcgggagcgagctgggctgctacaccatcaaccgggtcaagtccttcaagctgtgcgagaacagcgccaccggcaagacgtgcgagatcgactccacccccgtgaagtgccgccaggggttctgcctcaagatcacccaggagggccgggggcacgtgaagctgagccgcggctccgaggtcgtgctggacgcctgcgacagctcctgcgaggtcatgatccccaaggggaccggcgacatcctggtggactgcagcggcgggcagcagcacttcctcaaggacaacctgatcgacctgggctgcccgcacatccccctcctggggaagatggccatctacatctgccggatgtccaaccacccccgcaccacgatggccttcctgttctggttcagcttcggctacgtgatcacctgcctcttctgcaaggcgctgttctactccctgatcatcatcggcaccctcgggaagaagatcaagcagtaccgggagctgcgcccccagacctgcacgatctgcgagaccgccccggtcaacgccatcgacgccgagatgcacgacctgaactgcagctacaacatctgcccctactgcgcgtcccggctcaccagcgacggcctggcccgccacgtgccccagtgcccgaagcggaaggagaaggtggaggagaccgagctgtacctcaacctggagcgcatcccctggatcgtccggaagctgctccaggtgtccgagagcacgggggtggccctgaagcgcagctcctggctgatcgtcctcctggtgctgctcaccgtgagcctgtcccccgtccagagcgcccccgtgggccacgggaagaccatcgagacctaccagacgcgggagggcttcacctccatctgcctgttcatgctcggcagcatcctgttcctggtgtcctgcctcgtcaaggggctggtggacagcgtgtccgacagcttcttcccgggcctgtccgtctgcaagacctgcagcatcgggtccatcaacggcttcgagatcgagagccacaagtgctactgctccctcctgtgctgcccctactgccgccactgcagcgccgaccgggagatccaccagctgcacctctccatctgcaagaagcgcaagaccgggagcaacgtgatgctggcggtgtgcaagcggatgtgcttccgcgccacgatcgaggcctcccgccgggccctgctcatccgcagcatcatcaacaccaccttcgtcatctgcatcctgaccctgacgatctgcgtggtgagcacctccgccgtcgagatggagaacctccccagcggcacctgggagaaggaggaggacctgaccaacttctgccaccaggagtgccaggtgacggagaccgagtgcctgtgcccctacgaggcgctcgtgctgcggaagccgctgttcctcgactccatcgtcaagggcatgaagaacctgctgaacagcacctccctcgagaccagcctgtccatcgaggccccctggggggccatcaacgtgcagagcacgttcaagcccaccgtgtccaccgccaacatcgccctgagctggtccagcgtcgagcaccgcggcaacaagatcctcgtgaccgggcggtccgagagcatcatgaagctggaggagcgcacgggcgtgtcctgggacctgggggtcgaggacgcgagcgagtccaagctcctgaccgtgagcatcatggacctgtcccagatgtacagccccgtgttcgagtacctcagcggcgaccggcaggtcgaggagtggccgaaggccacctgcaccggcgactgccccgagcgctgcgggtgcacgtccagcacctgcctgcacaaggagtggccccactcccggaactggcgctgcaaccccacctggtgctggggcgtggggaccggctgcacctgctgcggggtggacgtcaaggacctgttcacggaccacatgttcgtgaagtggaaggtggagtacatcaagaccgaggccatcgtctgcgtggagctcaccagccaggagcggcagtgctccctgatcgaggccggcacccgcttcaacctgggcccggtgacgatcaccctcagcgagccccggaacatccagcagaagctgccccccgagatcatcaccctgcacccgaaggtcgaggaggggttcttcgacctcatgcacgtgcagaaggtgctgtccgcgagcaccgtctgcaagctgcagtcctgcacgcacggcatccccggggacctccaggtgtaccacatcggcaacctgctgaagggcgaccgcgtgaacgggcacctcatccacaagatcgagccccacttcaacaccagctggatgtcctgggacggctgcgacctggactactactgcaacatgggggactggcccagctgcacctacaccggcgtcacgcagcacaaccacgccgccttcgtgaacctgctcaacatcgagaccgactacaccaagaccttccacttccactccaagcgggtcacggcccacggggacaccccgcagctggacctgaaggcccgccccacctacggcgcgggcgagatcaccgtgctcgtggaggtcgccgacatggagctgcacacgaagaaggtggagatcagcgggctgaagttcgcctccctcgcctgcaccggctgctacgcctgcagctccgggatcagctgcaaggtgcggatccacgtcgacgagcccgacgagctgaccgtgcacgtgaagtccagcgaccccgacgtcgtggcggccagcacctccctgatggcccgcaagctcgagttcggcacggacagcaccttcaaggccttctccgccatgccgaagaccagcctgtgcttctacatcgtggagcgggagtactgcaagtcctgcagcgaggaggacacccagaagtgcgtcgacacgaagctggagcagccccagtccatcctcatcgagcacaaggggaccatcatcggcaagcagaacgacacctgcaccgcgaaggccagctgctggctggagtccgtgaagagcttcttctacggcctgaagaacatgctcgggtccgtgttcggcaacttcttcatcgggatcctgctgttcctggcccccttcgtcctcctggtgctgttcttcatgttcggctggaagatcctcttctgcttcaagtgctgccgccgggcccgcgggctgctgaagtaccgccacctcaaggacgacgaggagacgggctaccggaagatcatcgagcgcctgaacaacaagaagggcaagaaccggctgctcgacggggagcgcctggcggaccggaagatcgccgagctgttcagcaccaagacccacatcggctga

SEQ ID NO: 11976 - RNA, 5067 nt, synthetic construct
  misc_feature 1..5067: note = derived and/or modified CDS sequence (opt1) from CCHFV(75-R-2012)__KR814863.1__GP
  source 1..5067: mol_type = other RNA
atgcccaccaacatcatgcacaccctgctggtgtgcttcatcctgtacctgcagctcctgggcctcggcggggcccaccgccagagcaacgccaccgggcacaacgggaccaacaccaccaccgccccctccaccagccagtcccccaagcccctcgtgagcaccgcgcccccgcacgccctggagtccagcatcatcaagcacaccacgcccgtgtccgagaccgaggggagcggcgagaccacgccgccgcccaacaccacccagggccccagccccctggagaccacccccgagcggcccgccaccaccgccaccagcaccccctccaccgacaacaccaacagcaccacccacgtgacggacaacaaccccacctccaccatcagcacctcccccagctccagcccgtccacgcccagcacgccccaggggatccaccaccccgcccgcaacctcctgagcgtctccagcctgaagaccgccaccacgccgacccccacctcccccggcgagatcagctccgagaccagctccctccacagcgccatgtcccggacgagcaccctgtacaccgccacccaggtgtccaccgagaacgcgaaccacagcgcgccccgccagtccgagagctccgcccagcagacgaccaccagcccgatgacctcccccgcccagagcatcctggtgatgtccgccgcgcccacggccatccagaacacccaccccagcccgaccaaccggagcaagcgcaacctcgagatggagatcatcctgaccctgtcccaggggctcaagaagtactacggcaagatcctgaagctgctccacctgacgctggaggaggacaccgaggggctcctggagtggtgcaagcggaacctgggcagcaactgcgacgacgacttcttccagaagcgcatcgaggagttcttcatgaccggcgaggggtacttcaacgaggtcctccagttcaagaccctgtccacgcagagccccaccgagccctcccacgcccggccgcccaccgtggagcccttcaagagctacttcgccaagggcttcctgtccatcgacagcgggtacttctccgccaagtgctacccccgcctcagcacctccggcctgcagctgatcaacgtgacgcagcacccggcgcggatcgccgagacccccggccccaagaccaccagcctcaagacgatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacaccgacgggccggtccgcctcccccacatctaccacgagggcaccttcatccccgggacctacaagatcgtgatcgacaagaagaacaagctgaacgaccggtgcacgctggtgaccaactgcgtcatcaagggccgcgaggtgcggaaggggcagtccgtgctccgccagtacaagaccgagatcaagatcggcaaggccagcaccggcagccggaagctgctgtccgaggagcccggggacgactgcatcagccgcacgcagctcctgcggaccgagaccgcggagatccacgacgacaactacggcgggccgggcgacaagatcaccatctgcaacgggtccacgatcgtcgaccagcgcctgggcagcgagctcggctgctacaccatcaaccgcgtgaagtccttcaagctgtgcgagaacagcgccaccgggaagacctgcgagatcgactccgcccccgtgaagtgccggcagggcttctgcctgaagatcacgcaggaggggcgcggccacgtcaagctgagccgggggtccgaggtggtcctcgacgcctgcgacagctcctgcgaggtgatgatccccaagggcaccggcgacatcctggtggactgcagcgggggccagcagcacttcctgaaggacaacctcatcgacctggggtgcccccacatcccgctgctcggcaagatggccatctacatctgccgcatgtccaaccacccccggaccaccatggcgttcctgttctggttcagcttcggctacgtcatcacgtgcatcttctgcaaggccctgttctactccctcatcatcatcgggacgctgggcaagaagatcaagcagtaccgcgagctgaagccccagacctgcaccatctgcgagaccgcccccgtgaacgccatcgacgcggagatgcacgacctcaactgcagctacaacatctgcccgtactgcgcctcccggctgacgagcgacgggctggcccgccacgtgccccagtgccccaagcggaaggagaaggtcgaggagaccgagctctacctgaacctggagcgcatcccctggatcgtgcggaagctcctccaggtgtccgagagcaccggcgtcgccctgaagcgcagctcctggctcatcgtgctgctggtgctcctgaccgtcagcctgtccccggtgcagagcgcccccgtggggcacggcaagacgatcgagacctaccagacccgggagggcttcacctccatctgcctcttcatgctggggagcatcctgttcctcgtctcctgcctggtgaagggcctggtgaacagcgtctccgacagcttcttccccgggctctccgtgtgcaagacgtgcagcatcggctccatcaacgggttcgagatcgagagccacaagtgctactgctccctgttctgctgcccgtactgccgccactgcagcgcggaccgggagatccaccagctgcacctctccatctgcaagaagcgcaagaccggcagcaacgtgatgctggccgtctgcaagcggatgtgcttccgcgccaccatcgaggcctcccggcgcgccctgctcatccgcagcatcatcaacaccacgttcgtgatctgcatcctgaccctgaccatctgcgtggtcagcacctccgcggtggagatggagaacctccccagcggcacgtgggagcgggaggaggacctgaccaacttctgccaccaggagtgccaggtgaccgagaccgagtgcctgtgcccctacgaggccctcgtcctgcgcaagcccctgttcctcgactccatcgtgaaggggatgaagaacctgctgaacagcacgtccctcgagaccagcctgtccatcgaggccccgtggggcgccatcaacgtgcagagcaccttcaagcccaccgtctccacggccaacatcgcgctgagctggtccagcgtggagcaccgggggaacaagatcctcgtgaccggccgctccgagagcatcatgaagctggaggagcggaccggggtctcctgggacctgggcgtggaggacgccagcgagtccaagctcctgaccgtgagcatcatggacctgtcccagatgtacagccccgtcttcgagtacctcagcggcgaccgccaggtggaggagtggcccaaggccacgtgcaccggggactgcccggagcggtgcggctgcacctcctccacgtgcctgcacaaggagtggccccactcccgcaactggcggtgcaaccccacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctcacgagccaggagcgccagtgctccctgatcgaggcgggcacccggttcaacctggggcccgtcaccatcaccctcagcgagccgcgcaacatccagcagaagctgccgcccgagatcatcacgctgcaccccaaggtggaggagggcttcttcgacctcatgcacgtgcagaaggtcctgtccgccagcaccgtgtgcaagctgcagtcctgcacccacgggatcccgggcgacctccaggtgtaccacatcggcaacctgctgaagggggaccgggtcaacggccacctcatccacaagatcgagccccacttcaacaccagctggatgtcctgggacgggtgcgacctggactactactgcaacatgggcgactggcccagctgcacgtacaccggggtgacccagcacaaccacgccgccttcgtcaacctgctcaacatcgagaccgactacacgaagaccttccacttccactccaagcgcgtgaccgcccacggcgacacgccccagctggacctgaaggcgcggccgacgtacggcgccggggagatcaccgtgctcgtcgaggtggccgacatggagctgcacaccaagaaggtggagatcagcggcctgaagttcgcctccctcgcctgcaccgggtgctacgcgtgcagctccggcatcagctgcaaggtccgcatccacgtggacgagcccgacgagctgacggtgcacgtcaagtccagcgaccccgacgtggtggccgccagcacctccctgatggcccggaagctcgagttcgggaccgacagcaccttcaaggccttctccgcgatgcccaagacgagcctgtgcttctacatcgtcgagcgcgagtactgcaagtcctgcagcgaggaggacacccagaagtgcgtggacaccaagctggagcagccgcagtccatcctcatcgagcacaagggcaccatcatcggcaagcagaacgacacgtgcaccgccaaggccagctgctggctggagtccgtcaagagcttcctgtacgggctcaagaacatgctgggctccgtcttcgggaacttcttcatcggcatcctgctgttcctcgcccccttcgtgctgctggtgctgttcttcatgttcgggtggaagatcctgttctgcttcaagtgctgccggcgcacccggggcctgctcaagtaccgcctgctgaaggacgacgaggagaccggctaccgccggatcatcgagcgcctcaacaacaagaaggggaagaaccggctgctggacggcgagcgcctcgcggaccggaagatcgccgagctgttcagcacgaagacccacatcgggtga

SEQ ID NO: 11977 - RNA, 5067 nt, synthetic construct
  misc_feature 1..5067: note = derived and/or modified CDS sequence (opt1) from CCHFV(52-R-2014)__KR814862.1__GP
  source 1..5067: mol_type = other RNA
atgcccaccaacatcatgcacaccctgctcgtgtgcttcatcctgtacctgcagctcctgggcctcgggggcgcccaccgccagagcaacgccacggagcacaacgggaccaacaccaccacggcgccgtccaccagccagtcccccaagccgcccgtcagcaccgccccgccccacgcccccgagtccagcaccatcaagcccacgacccccgcctccgagaccgagggcagcggggagaccacgcccccgcccaacaccacccagggcccctccccgcccgaggccacccccgagcggcccgcgacgaccgccaccagcaccccctccacggacaacaccaacagcaccacccacgccacggacaacaaccccacctccaccatcagcacctcccccagctccagcccgtccacgcccagcacgccccagggcatccaccaccccgcccgcaacctgctgagcgtgtccagcccgaagaccgcgaccacccccacccccacctcccccggggacatcagctccgagaccagctccctgcacagcgccatgtcccggacgccgaccctccacaccgccacccaggccagcaccgagaacgccaaccactccgcgccccgccagagcgagtccagcgcccagcagacgaccacctcccccatgaccagcccggcccagcccatcctggtgatgtccgccgcccccacggcgatccagaacatccaccccagcccgaccaaccggtccaagcgcaacctggagatggagatcatcctcaccctgagccagggcctgaagaagtactacgggaagatcctcaagctgctgcacctcaccctggaggaggacacggagggcctgctcgagtggtgcaagcggaacctggggagcaactgcgacgacgacttcttccagaagcgcatcgaggagttcttcatgaccggcgagggctacttcaacgaggtcctgcagttcaagaccctctccaccctgagccccacggagccctcccacgcccggcccccgaccgtggagcccttcaagagctacttcgccaaggggttcctgtccatcgacagcggctacttctccgccaagtgctacccccgcctcagcacctccgggctgcagctgatcaacgtgacccagcaccccgcccggatcgcggagacgccgggccccaagaccaccagcctcaagaccatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacacggacggccccgtccgcctcccgcacatctaccacgaggggaccttcatccccggcacctacaagatcgtgatcgacaagaagaacaagctgaacgaccggtgcaccctggtgacgaactgcgtcatcaaggggcgcgaggtgcggaagggccagtccgtgctccgccagtacaagaccgagatcaagatcgggaaggccagcaccggctcccggaagctgctgagcgaggagcccggcgacgactgcatcagccgcacccagctcctgcggacggagaccgccgagatccacgacgacaactacgggggccccggggacaagatcaccatctgcaacggctccaccatcgtcgaccagcgcctcgggagcgagctcggctgctacacgatcaaccgcgtgaagtccttcaagctgtgcgagaacagcgcgaccggcaagacctgcgagatcgactccaccccggtgaagtgccggcaggggttctgcctgaagatcacgcaggagggccgcgggcacgtcaagctcagccggggctccgaggtggtgctggacgcctgcgacaccagctgcgaggtcatgatccccaaggggaccggcgacatcctggtggactgctccggcgggcagcagcacttcctgaaggacaacctcatcgacctgggctgcccccacgtccccctgctcgggaagatggccatctacatctgccgcatgagcaaccacccgcggaccaccatggccttcctgttctggttctccttcggctacgtgatcacgtgcatcttctgcaaggcgctgttctacagcctcatcatcatcggcaccctggggaagaagatcaagcagtaccgcgagctgaagccccagacctgcaccatctgcgagacggcccccgtgaacgccatcgacgccgagatgcacgacctcaactgctcctacaacatctgcccgtactgcgccagccggctgacctccgacggcctggcgcgccacgtcccccagtgccccaagcggaaggagaaggtggaggagaccgagctctacctgaacctggagcgcatcccctggatcgtgcggaagctcctgcaggtcagcgagtccaccggggtggccctgaagcgcagctcctggctcatcgtgctgctggtcctcctgacggtgagcctgagcccggtgcagtccgcccccgtcggccacgggaagaccatcgagacctaccagacccgggagggcttcacgagcgtgtgcctcttcatgctgggctccatcctgttcctcgtgagctgcctggtcaaggggctggtggactccgtgagcgactccttcttccccggcctcagcgtctgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtgtgcaagcggatgtgcttccgcgcgaccatcgaggccagccggcgcgccctgctcatccgctccatcatcaacaccacgttcgtcatctgcatcctgaccctgaccatctgcgtggtgagcacctccgccgtcgagatggagaacctcccgagcggcacgtgggagcgggaggaggacctgaccaacttctgccaccaggagtgccaggtgaccgagaccgagtgcctgtgcccctacgaggccctcgtgctgcgcaagcccctgttcctcgacagcatcgtcaagggcatgaagaacctgctgaactccacgagcctcgagacctccctgagcatcgaggcgccctggggcgccatcaacgtgcagtccaccttcaagccgaccgtgagcacggccaacatcgccctgtcctggagctccgtcgagcaccgggggaacaagatcctcgtgaccgggcgcagcgagtccatcatgaagctggaggagcggaccggcgtgagctgggacctgggggtcgacgacgcgtccgagagcaagctcctgaccgtgtccatcatggacctgagccagatgtactcccccgtgttcgagtacctcagcggcgaccgccaggtcgaggagtggcccaaggccacgtgcaccggcgactgccccgagcggtgcgggtgcacctcctccacgtgcctgcacaaggagtggccgcacagccgcaactggcggtgcaaccccacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcaccagccaggagcgccagtgcagcctgatcgaggccggcacccggttcaacctgggccccgtgaccatcaccctctccgagccccgcaacatccagcagaagctgccgcccgagatcatcacgctgcaccccaaggtcgaggaggggttcttcgacctcatgcacgtgcagaaggtgctgagcgcctccaccgtctgcaagctgcagagctgcacccacggcatccccggggacctccaggtgtaccacatcggcaacctgctgaagggcgaccgggtgaacgggcacctcatccacaagatcgagccgcacttcaacacctcctggatgagctgggacggctgcgacctggactactactgcaacatgggggactggccctcctgcacgtacaccggcgtcacccagcacaaccacgcggccttcgtgaacctgctcaacatcgagaccgactacacgaagaccttccacttccacagcaagcgcgtcaccgcccacggggacacgccccagctggacctgaaggcccggcccacctacggcgccggcgagatcaccgtgctcgtggaggtcgcggacatggagctgcacaccaagaaggtggagatctccgggctgaagttcgccagcctcgcctgcaccggctgctacgcctgctccagcgggatctcctgcaaggtgcgcatccacgtcgacgagccggacgagctgacggtgcacgtcaagagcaacgaccccgacgtggtggccgcgtccaccagcctgatggcccggaagctcgagttcggcaccgactccaccttcaaggccttcagcgccatgcccaagacgagcctgtgcttctacatcgtggagcgcgagtactgcaagtcctgcagcgaggaggacacccagaagtgcgtcgacaccaagctggagcagccgcagtccatcctcatcgagcacaaggggaccatcatcggcaagcagaacgacacgtgcaccgcgaaggccggctgctggctggagagcgtgaagtccttcttctacgggctgaagaacatgctcggcagcgtgttcgggaacttcttcatcggcatcctgctgttcctcgcccccttcgtcctgctggtgctgttcttcatgttcgggtggaagatcctcttctgcttcaagtgctgccggcgcacccggggcctgctgaagtaccgcctcctgaaggacgacgaggagaccggctaccgccggatcatcgagcgcctgaacaacaagaaggggaagaaccggctcctggacggcgagcgcctggccgaccggaagatcgccgagctgttctccacgaagacccacatcgggtga

SEQ ID NO: 11978 - RNA, 5067 nt, synthetic construct
  misc_feature 1..5067: note = derived and/or modified CDS sequence (opt1) from CCHFV(47-ST-2013)__KR814861.1__GP
  source 1..5067: mol_type = other RNA
atgcccatcaacatcatgcacaccctgctggcctgcttcatcctgtacctgcagctcagcggcctcggcggggcccacgggcagtccaacgcgaccgagcacaacgggaccaacaccaccaccgtgccggggaccagccagtcccccaagccgcccgccagcaccaccctgccgcacacccccgagtccagcacggtcaagctcaccacccccacctccgagaccgagggcagcggcgagaccacgcccccgcccaacaccacccaggggctgcccccgcccggcaccacccccgagcgctccgccaccaccgccaccagcacctccagcaccgacaacatgaactccacgacccagatgaccgggaacacccccacgcccaccgtgaacatgagcccctccagctcccccagcatgccctccaccagccagggcatccactaccccgtgcggagcctgctctccgtcccgagccccaagaccgccacgacccccacccccgtgtccccgggggagatgagccccgagacctccagccagcactccgcgacgagccgcatccccaccctgtacaccgccacccaggtgtccaccgagaacacgaaccggagcacgccccgccagtccaagagctccgtgcagccggccacccagagccccatcacgccgcccgcccagacgatcctgctcatgtccgcggcccccaaggccatccaggacatgcaccccagccccaccaaccggtccaagcgcaacctggaggtggagatcatcctgaccctcagccagggcctgaagaagtactacggcaagatcctgaagctcctgcacctgaccctcgaggaggacacggaggggctgctggagtggtgcaagcggaacctcggctccaactgcgacgacgacttcttccagaagcgcatcgaggagttcttcatcaccggggagggctacttcaacgaggtgctgcagttcaagaccctgagcaccctcagccccacggagccctcccacgtccggctgcccaccgccgagcccttcaagagctactacgccaagggcttcctgtccctcgacagcgggtacttctccgcgaagtgctacccgcgcagctccaccagcggcctgcagctgatcaacgtgacccagcaccccgcccggatcgccgagacgcccgggcccaagaccacctccctcaagaccatcaactgcatcaacctgcgcgccagcgtgttcaaggagcaccgggaggtcgagatcaacgtgctgctcccgcagatcgccgtgaacctgtccaactgccacgtcgtgatcaacagccacgtgtgcgactaccccctggacacggacggccccgtccgcctcccccggatccaccacgaggggaccttcatcccgggcacctacaagatcgtgatcgacaagaagaacaagctgaacgaccgctgctccctggtgaccaactgcgtcatcaagggccgggaggtgcgcaaggggcagagcgtgctccggcagtacaagacggagatcaagatcggcaaggcgtccaccgggagccgcaagctgctgtccgaggagcccggcgacgactgcatcagccggacccagctcctgaagaccgagacggccgagatccacgacgacaactacgggggccccggcgacaagatcaccatctgcaacgggagcaccatcgtcgaccagcgcctgggctccgagctcgggtgctacaccatcaaccgcgtcaagtccttcaagctgtgcaagaactccgccacgggcaagacctgcgagatcgacagcacccccgtcaagtgccggcaggggttctgcctgaagatcacccaggagggccgcggccacgtgaagctgtcccgggggagcgaggtggtcctcgacgcctgcgactccagctgcgagatcatgatcccgaagggcacgggggacatcctggtggactgctccggcggccagcagcacttcctgaaggacaacctcatcgacctggggtgcccccacatccccctgctcggcaagatggccatctacatctgccgcatgagcaaccacccccggaccaccatggcgttcctgttctggttctccttcgggtacgtgatcacgtgcatcttctgcaaggccctgttctacagcctcatcatcatcggcaccctggggaagaagatcaagcagtaccgcgagctgaagccgcagacgtgcaccatctgcgagaccgcccccgtcaacgccatcgacgccgagatgcacgacctcaactgctcctacaacatctgcccctactgcgcgagccggctgacctccgacggcctggcccgccacgtgacgcagtgcccgaagcggaaggagaaggtggaggagaccgagctctacctgaacctggagcgcatcccctggatcgtccggaagctcctccaggtgagcgagtccaccggcgtggccctgaagcgcagctcctggctcatcgtcctgctggtgctcctgaccgtgagcctgagccccgtccagtccgcccccgtggggcacggcaagacgatcgagacctaccagacccgggaggggttcaccagcatctgcctcttcatgctgggctccatcctgttcatcgtgagctgcctcgtcaaggggctggtggactccgtgagcgactccttcttcccgggcctgagcgtctgccgcacgtgctccatcggcagcatcaacgggttcgagatcgagtcccacaagtgctactgcagcctcttctgctgcccctactgccggcactgctccgcggaccgcgagatccaccagctgcacctgagcatctgcaagaagcggaagaccggctccaacgtgatgctcgccgtgtgcaagcgcatgtgcttcaaggccaccatcgaggccagccggcgcgccctgttcatccgctccatcatcaacaccacgttcgtgacctgcatcctgaccctcgcgatctgcgtggtgagcacctccgccgtcgagatggaggacctgcccgccgggacgtgggagcgggaggaggacctgaccaacttctgccaccaggagtgccaggtgaccgagaccgagtgcctctgcccctacgaggccctggtgctgcgcaagccgctgttcctggacagcatcgtcaagggcatgaagaacctgctcaacagcacgtccctggagaccagcctgtccatcgaggccccctggggcgcgatcaacgtgcagagcaccttcaagcccaccgtgtccacggccaacatcgccctcagctggtccagcgtcgagcaccggggcaacaagatcctggtgaccggccgctccgagagcatcatgaagctggaggagcggaccggggtgtcctgggacctcggcgtcgaggacgccagcgagtccaagctgctgaccgtgagcatcatggacctctcccagatgtacagccccgtgttcgagtacctgtccggggaccgccaggtcgaggagtggccgaaggccacgtgcaccggcgagtgccccgagcggtgcgggtgcaccagcagcacgtgcctgcacaaggagtggccccacagccgcaactggcggtgcaaccccacctggtgctggggcgtgggcaccgggtgcacgtgctgcggcgtggacgtcaaggacctcttcaccgaccacatgttcatcaagtggaaggtggagtacatcaagaccgaggcgatcgtgtgcgtcgagctgacgagccaggagcgccagtgctccctgatcgaggccgggacccggttcaacctcggcccggtgaccatcaccctgagcgagccccgcaacatccagcagaagctgccgcccgagatcatcacgctccacccgaagatcgaggagggcttcttcgacctgatgcacgtgcagaaggtcctgtccgccagcaccgtgtgcaagctccagtcctgcacccacgggatccccggcgacctgcagatctaccacatcgggaacctgctcaagggcgaccgggtgaacgggcacctgatccacaagatcgagccccacttcaacaccagctggatgtcctgggacggctgcgacctggactactactgcaacatgggcgactggcccagctgcacgtacaccggggtcacccagcacaaccacgccgcgttcgtgaacctcctgaacatcgagaccgactacacgaagaccttccacttccactccaagcgcgtcaccgcccacggcgacaccccgcagctggacctcaaggcccggcccacgtacggggccggcgagatcaccgtgctggtggaggtcgccgacatggagctgcacaccaagaaggtggaggtgagcgggctcaagttcgcgtccctggcctgcaccggctgctacgcctgcagctccggcatcagctgcaaggtccgcatccacgtggacgagcccgacgagctgacggtgcacgtcaagtccagcgaccccgacgtggtggccgcctccaccagcctcatggcgcggaagctggagttcgggaccgactccaccttcaaggccttcagcgccatgccgaagacgagcctgtgcttctacatcgtcgagcgcgagtactgcaagtcctgcagcgaggacgacaccaagaagtgcgtggacaccaagctcgagcagccccagtccatcctgatcgagcacaagggcaccatcatcgggaagcagaacgacacgtgcaccgccaaggccagctgctggctggagtccgtcaagagcttcttctacggcctcaagaacatgctggggtccgtcttcggcaacttcttcgtgggcatcctcctgttcctggcgcccttcgtgctgctggtcctcttcttcatgttcgggtggaagatcctgttctgcttcaagtgctgccggcgcacccggggcctgttcaagtaccgccacctcaaggacgacgaggagaccgggtaccgccggatcatcgagcgcctgaacagcaagaagggcaagaaccggctgctcgacggcgagcgcctggccgaccggaagatcgccgagctgttctccacgaagacccacatcgggtga

SEQ ID NO: 11979 - RNA, 5067 nt, synthetic construct
  misc_feature 1..5067: note = derived and/or modified CDS sequence (opt1) from CCHFV(46-ST-2012)__KR814860.1__GP
  source 1..5067: mol_type = other RNA
atgcccaccaacatcatgcacaccctgctcgtgtgcttcatcctgtacctgcagctcctgggcctcgggggcgcccacgggcagagcaacgccacggagcacaacggcaccaacaccaccacggtcccgtccaccagccagtcccccaagcccctggtgagcaccacgcccccgcacgcgctggagtccagcaccatcaagcccaccacccccacctccgagacggaggggagcggcgagaccgcgcccctgccgaacaccacccaggggcccccgccgcccgagacgacccccgagcgccccgccaccaccgtgacgtccacccccagcaccgacaacacctccagcacgatccacgtcaccgacaacaaccccacctccaccatcagcacgtcccccagctccagcccctccacccccagcaccccgcaggggatccaccaccccgcccggagcctcctgtccgtgagctcccccaagaccgccacgacccccaccccgaccagccccggcgagatcaactccgagacgagctccctgcacagcgccatgtcccgcacccccaccctccacaccgccacccaggtgagcacggagaacgccaaccactccgcgccccggcagagcgagtccagcgcccagccgaccaccacctccctgatgacgagccccgcccagtccatcctgctcatgagcgccgcccccaccgccatccagaacatccacccgtcccccaccaaccgcagcaagcggaacctggagatggagatcatcctgaccctcagccaggggctgaagaagtactacggcaagatcctgaagctcctgcacctgacgctcgaggaggacaccgaggggctgctggagtggtgcaagcgcaacctcggctccaactgcgacgacgacttcttccagaagcggatcgaggagttcttcatgaccggcgaggggtacttcaacgaggtcctgcagttcaagaccctgagcacgctctcccccaccgagcccagccacgcgcgcctgccgaccgtggagcccttcaagtcctacttcgccaagggcttcctgagcgtggactccgggtacttcagcgccaagtgctacccccggtccagcacctccggcctccagctgatcaacgtcacgcagcaccccgcccgcatcgccgagaccccgggccccaagaccaccagcctgaagacgatcaactgcatcaacctccgggcgtccgtgttcaaggagcaccgcgagatcgagatcaacgtgctgctgccccagatcgccgtcaacctcagcaactgccacgtggtgatcaactcccacgtctgcgactacagcctggacaccgacgggcccgtgcggctgccgcacatctaccacgagggcaccttcatccccgggacctacaagatcgtgatcgacaagaagaacaagctcaacgaccgctgcacgctggtcaccaactgcgtgatcaagggccgggaggtgcgcaaggggcagtccgtcctgcggcagtacaagaccgagatcaagatcggcaaggccagcaccggcagccgcaagctcctgtccgaggagcccggggacgactgcatcagccggacgcagctgctccgcaccgagaccgccgagatccacgacgacaactacggcgggcccggcgacaagatcaccatctgcaacgggtccacgatcgtggaccagcggctgggcagcgagctgggctgctacaccatcaaccgcgtgaagtccttcaagctgtgcgagaacagcgccaccgggaagacctgcgagatcgactccacgccggtcaagtgccgccagggcttctgcctcaagatcacccaggaggggcggggccacgtgaagctgagccgcgggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgcccccacatccccctgctgggcaagatggccatctacatctgccggatgtccaaccacccgcgcaccaccatggccttcctcttctggttcagcttcggctacgtgatcacgtgcatcttctgcaaggccctgttctactccctgatcatcatcgggaccctcggcaagaagatcaagcagtaccgggagctgaagccccagacctgcaccatctgcgagacggcccccgtgaacgcgatcgacgccgagatgcacgacctgaactgcagctacaacatctgcccctactgcgcctcccgcctcaccagcgacgggctggcccggcacgtcccgcagtgccccaagcgcaaggagaaggtggaggagaccgagctgtacctcaacctggagcggatcccctggatcgtgcgcaagctgctccaggtctccgagagcaccggcgtggcgctgaagcggagctcctggctgatcgtgctcctggtcctgctcacggtgagcctgtccccggtgcagagcgcccccgtcgggcacggcaagaccatcgagacctaccagacccgcgagggcttcacgtccatctgcctgttcatgctcgggagcatcctgttcctggtgtcctgcctcgtgaagggcctggtcgacagcgtgtccgacagcttcttccccgggctgtccgtgtgcaagacctgcagcatcggctccatcaacgggttcgagatcgagagccacaagtgctactgctccctcttctgctgcccctactgccggcactgcagcgccgaccgcgagatccaccagctgcacctgtccatctgcaagaagcggaagaccggcagcaacgtcatgctcgccgtgtgcaagcgcatgtgcttccgggccaccatcgaggcgtcccgccgggccctgctgatccgcagcatcatcaacgccacgttcgtgatctgcatcctcaccctgaccatctgcgtcgtgagcacctccgccgtggagatggagagcctgccggccggcacgtgggagcgcgaggaggacctcaccaacttctgccaccaggagtgccaggtcaccgagaccgagtgcctgtgcccctacgaggcgctggtgctccggaagcccctgttcctggactccatcgtgaaggggatgaagaacctcctgaacagcacgtccctggagaccagcctctccatcgaggccccctggggcgccatcaacgtccagagcaccttcaagccgaccgtgtccacggccaacatcgccctgagctggtccagcgtggagcaccgcgggaacaagatcctggtcaccggccggtccgagagcatcatgaagctcgaggagcgcaccggggtgtcctgggacctgggcgtggaggacgcgagcgagtccaagctgctcaccgtcagcatcatggacctgtcccagatgtacagccccgtgttcgagtacctgagcggcgaccgccaggtggaggagtggcccaaggccacgtgcaccggggactgccccgagcggtgcggctgcacctccagcacgtgcctccacaaggagtggccgcactcccggaactggcgctgcaaccccacctggtgctggggcgtcggcaccgggtgcacgtgctgcggcgtggacgtgaaggacctgttcaccgaccacatgttcgtcaagtggaaggtggagtacatcaagaccgaggccatcgtgtgcgtcgagctgaccagccaggagcggcagtgctccctcatcgaggccggcacccgcttcaacctggggcccgtgaccatcaccctgagcgagccccggaacatccagcagaagctcccgcccgagatcatcacgctgcaccccaaggtggaggagggcttcttcgacctgatgcacgtccagaaggtgctctccgcgagcaccgtgtgcaagctgcagtcctgcacccacgggatccccggcgacctgcaggtctaccacatcggcaacctcctgaagggggaccgcatcaacggccacctgatccacaagatcgagccgcacttcaacaccagctggatgtcctgggacgggtgcgacctcgactactactgcaacatgggcgactggcccagctgcacgtacaccggggtgacccagcacaaccacgccgccttcgtcaacctgctgaacatcgagaccgactacacgaagaccttccacttccactccaagcgggtgaccgcccacggcgacacgccccagctcgacctgaaggcccgccccacctacggcgcgggggagatcaccgtgctggtcgaggtggccgacatggagctccacaccaagaaggtggagatcagcggcctgaagttcgcctccctggcctgcaccgggtgctacgcctgcagctccggcatcagctgcaaggtccggatccacgtggacgagccggacgagctcacggtgcacgtcaagtccagcgaccccgacgtggtggcggccagcacctccctgatggcccgcaagctggagttcgggaccgacagcaccttcaaggccttctccgccatgcccaagacgagcctctgcttctacatcgtcgagcgggagtactgcaagtcctgcagcgaggaggacacccagaagtgcgtggacacccgcctggagcagccccagtccatcctgatcgagcacaagggcaccatcatcggcaagcagaacgacacgtgcaccgcgaaggccagctgctggctcgagtccgtcaagagcttcttctacgggctgaagaacatgctgggctccgtgttcgggaacttcttcatcggcatcctcctgttcctggccccgttcgtgctgctcgtgctgttcttcatgttcgggtggaagatcctgttctgcttcaagtgctgccggcgcacccggggcctcctgaagtaccgccacctgaaggacgacgaggagaccggctaccgccggatcatcgagcgcctcaacaacaagaaggggaagaaccggctgctggacggcgagcgcctcgccgaccggaagatcgcggagctgttcagcacgaagacccacatcgggtga

SEQ ID NO: 11980 - RNA, 5067 nt, synthetic construct
  misc_feature 1..5067: note = derived and/or modified CDS sequence (opt1) from CCHFV(44-ST-2010)__KR814859.1__GP
  source 1..5067: mol_type = other RNA
atgcccatcaacatcatgcacaccctgctcgtgtgcttcatcctgtacctgcagctcagcggcctggggggcgcccacgggcagtccaacgccaccgagcacaacggcacgaacaccaccaccgtcccggggacgagccagtcccccaagccccccgcgagcaccaccctgccgcacacccccgagtccagcacggtgaagctcaccacccccacctccgagacggagggcagcggcgagaccacccccccgcccaacaccacgcaggggctgccccccccgggcaccacccccgagcgccccgccaccacggccacctccatgagctccaccgacaacatgaacagcaccacgcaggtgaccgacaacacccccacctccacggtcagcatctccccgagctccagcccctccatgcccagcaccagccaggggatccactaccccgtgcggtccctgctcagcgtgtccagcccgaagaccgtcaccacgcccacccccatgtcccccggcgagatgagcccggagacctccagccagcactccgccatgagccgcatccccaccctgtacacggccacccaggtgtccaccgagaacaccaaccggagcaccccccgccagtccgagagctccgcgcagcccgccacgcagagcccgaccacctcccccacccagacgatcctgctcatgagcgccgcccccaaggcgatccaggacatgcacccgtcccccaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgagcaccctctcccccacggagcccagccacgtgcggctgccgaccgccgagcccttcaagtcctacttcgccaagggcttcctgagcatcgactccggctacttcagcgccaagtgctacccccgctccagcacctccgggctccagctgatcaacgtgacccagcaccccgcccggatcgcggagacgccgggccccaagaccaccagcctgaagaccatcaactgcatcaacctccgcgcctccgtcttcaaggagcaccgggaggtggagatcaacgtgctgctgccccagatcgccgtcaacctcagcaactgccacgtggtgatcaactcccacgtctgcgactacagcctggacacggacgggcccgtgcgcctgccgcggatccaccacgagggcaccttcatccccgggacctacaagatcgtgatcgacaagaagaacaagctcaacgaccgctgctccctggtcaccaactgcgtgatcaagggccgggaggtgcgcaagggccagagcgtcctgcggcagtacaagacggagatcaagatcgggaaggccagcaccggctcccgcaagctcctgagcgaggagcccggggacgactgcatctcccggacccagctgctcaagaccgagacggccgagatccacgacgacaactacggcgggcccggcgacaagatcaccatctgcaacggcagcaccatcgtggaccagcgcctggggtccgagctgggctgctacaccatcaaccgcgtcaagagcttcaagctctgcgagaactccgcgacggggaagacctgcgagatcgacagcaccccggtgaagtgccggcagggcttctgcctgaagatcacccaggaggggcgcggccacgtgaagctgtcccggggcagcgaggtcgtgctggacgcctgcgactccagctgcgagatcatgatccccaaggggacgggcgacatcctcgtggactgctccgggggccagcagcacttcctgaaggacaacctgatcgacctcggctgcccccacatccccctgctggggaagatggccatctacatctgccgcatgagcaaccacccgcggaccaccatggccttcctcctgtggttctccttcggctacgtcatcacctgcatcttctgcaaggccctgttctacagcctcatcatcatcgggaccctgggcaagaagatcaagcagtaccgcgagctgaagccccagacgtgcaccatctgcgagaccgcgcccgtgaacgccatcgacgccgagatgcacgacctcaactgctcctacaacatctgcccctactgcgccagccggctgacctccgacgggctggcccgccacgtgacgcagtgcccgaagcggaaggagaaggtcgaggagaccgagctctacctgaacctggagcgcatcccctggatcgtgcggaagctcctgcaggtgagcgagagcaccggcgtcgcgctgaagcgctccagctggctcatcgtgctgctggtgctcctgaccgtctccctgagccccgtgcagtccgccccggtgggccacgggaagacgatcgagacctaccagacccgggagggcttcaccaacatctgcctcttcatgctggggagcatcctgttcatcgtctcctgcctcgtgaagggcctggtggacagcgtctccgacagcttcttccccgggctgtccgtgtgcaagacgtgcagcttcggctccatcaacggcttcgagatcgagagccacaagtgctactgctccctcttctgctgcccctactgccgccactgcagcgccgaccgggagatccaccagctgcacctggggatctgcaagaagcgcaagaccggctccaacgtgatgctcgccgtctgcaagcggatgtgcttcaaggcgaccatcgaggccagccgccgggccctgctgatccgctccatcatcaacaccacgttcgtgatctgcatcctcaccctggccatctgcgtggtcagcaccagcgccgtggagatggagaacctgcccgcggggacctgggagcgcgaggaggacctcacgaacttctgccaccaggagtgccaggtgtccgagaccgagtgcctgtgcccgtacgaggccctggtcctccggaagcccctgttcctggacagcatcgtgaagggcatgaagaacctcctgaactccaccagcctggagacctccctcagcatcgaggccccctggggggccatcaacgtgcagtccacgttcaagcccaccgtcagcaccgccaacatcgcgctgtcctggagctccgtggagcaccgcggcaacaagatcctggtgaccggccggagcgagtccatcatgaagctcgaggagcgcacgggggtcagctgggacctgggcgtggaggacgcctccgagagcaagctgctcaccgtgtccatcatggacctgagccagatgtactccccggtcttcgagtacctgagcggggaccggcaggtggaggagtggcccaaggccacctgcaccggcgactgccccgagcgctgcgggtgcacgagctccacctgcctccacaaggagtggccccacagccggaactggcgctgcaacccgacctggtgctggggcgtgggcaccgggtgcacgtgctgcggcgtcgacgtgaaggacctgttcaccgaccacatgttcatcaagtggaaggtggagtacatcaagaccgaggccatcgtctgcgtggagctgacctcccaggagcggcagtgcagcctcatcgaggccgggacccgcttcaacctgggccccgtgacgatcaccctgtccgagccccggaacatccagcagaagctccccccggagatcatcaccctgcaccccaagatcgaggagggcttcttcgacctgatgcacgtccagaaggtgctcagcgcgtccaccgtgtgcaagctgcagagctgcacgcacgggatccccggcgacctgcagatctaccacatcgggaacctcctgaagggcgaccgcctgaacgggcacctcatccacaagatcgagccccacttcaacacctcctggatgagctgggacggctgcgacctggactactactgcaacatgggcgactggccgtcctgcacctacaccggggtcacgcagcacaaccacgccgccttcgtgaacctgctcaacatcgagaccgactacaccaagaccttccacttccacagcaagcgggtcacggcccacggcgacaccccccagctggacctgaaggcgcgccccacctacggggccggcgagatcaccgtgctcgtggaggtcgccgacatggagctgcacacgaagaaggtggagatctccgggctgaagttcgccagcctcgcctgcaccggctgctacgcgtgctccagcggcatctcctgcaaggtgcggatccacgtcgacgagcccgacgagctgaccgtgcacgtgaagagctccgacccggacgtcgtggccgccagcaccagcctgatggcccgcaagctcgagttcgggacggactccaccttcaaggccttcagcgcgatgcccaagacctccctgtgcttctacatcgtggagcgggagtactgcaagagctgctccgaggacgacaccaagaagtgcgtcgacacgaagctggaccagccccagagcatcctcatcgagcacaagggcaccatcatcgggaagcagaacgacacctgcaccgccaaggcctcctgctggctggagagcgtgaagtccttcttctacggcctgaagaacatgctcgggagcgtgttcggcaacttcttcgtcggcatcctgctgttcctggcccccttcgtgctcctggtgctgttcttcatgtgcgggtggaagatcctcttctgcttcaagtgctgccgccggacgcgcggcctgttcaagtaccggcacctgaaggacgacgaggagaccgggtaccgccgcatcatcgagcggctcaactccaagaagggcaagaaccgcctgctggacggcgagcggctcgccgaccgcaagatcgcggagctgttcagcaccaagtcccacatcgggtga

SEQ ID NO: 11981 - RNA, 5067 nt, synthetic construct
  misc_feature 1..5067: note = derived and/or modified CDS sequence (opt1) from CCHFV(37-R-2013)__KR814858.1__GP
  source 1..5067: mol_type = other RNA
atgcccaccaacatcatgcacaccctgctcgtgtgcttcatcctgtacctgcagctcctgggcctggggggcgcccaccgccagagcaacgccacggagcacaacgggaccaacaccaccacggcgccgtccaccagccagtcccccaagccccccgtcagcaccgccccgccccacgcccccgagacctccacgatcaagcccaccaccccggccagcgagaccgagggctccggggagacgacccccccccccaacaccacccagggcccgagcccccccgaggccacgcccgagcggccggcgaccaccgtgacctccacgcccagcaccgacaacaccaactccaccacgcacgccaccgacaacaaccccaccagcaccatctccacgagcccctccagctccccgagcaccccctccaccccccagggcatccaccaccccgcccgcaacctcctgagcgtgagctccccgaagaccgccacgacccccacccccaccagccccggggacatctccagcgagacgtccagcctgcactccgcgatgagccggaccccgaccctccacaccgccacccaggcctccacggagaacgccaaccacagcgccccccgccagtccgagagctccgcgcagcagaccaccaccagccccatgacgtccccggcccagcccatcctggtcatgagcgccgcccccaccgccatccagaacatccacccctccccgaccaaccggagcaagcgcaacctggagatggagatcatcctcaccctgtcccagggcctgaagaagtactacgggaagatcctcaagctgctgcacctcacgctggaggaggacaccgagggcctgctcgagtggtgcaagcggaacctggggagcaactgcgacgacgacttcttccagaagcgcatcgaggagttcttcatgaccggcgagggctacttcaacgaggtgctgcagttcaagaccctcagcacgctgtcccccaccgagcccagccacgcgcggcccccgaccgtggagcccttcaagtcctacttcgccaaggggttcctgagcatcgactccggctacttcagcgccaagtgctacccccgcctcaccacgtccgggctgcagctgatcaacgtcacccagcaccccgcccggatcgccgagaccccgggccccaagaccacgagcctcaagaccatcaactgcatcaacctgcgcgcgtccgtgttcaaggagcaccgggagatcgagatcaacgtgctgctcccccagatcgccgtcaacctgagcaactgccacgtggtgatcaactcccacgtctgcgactacagcctggacaccgacggccccgtgcgcctcccgcacatctaccacgaggggaccttcatccccggcacgtacaagatcgtgatcgacaagaagaacaagctgaacgaccggtgcaccctggtcaccaactgcgtgatcaaggggcgcgaggtgcggaagggccagtccgtcctccgccagtacaagaccgagatcaagatcgggaaggccagcacgggctcccggaagctgctgagcgaggagcccggcgacgactgcatctcccgcacccagctcctgcggaccgagaccgccgagatccacgacgacaactacgggggccccggggacaagatcacgatctgcaacggcagcaccatcgtggaccagcgcctggggagcgagctcggctgctacaccatcaaccgcgtgaagtccttcaagctgtgcgagaacagcgccaccggcaagacgtgcgagatcgactccaccccggtcaagtgccggcaggggttctgcctgaagatcacccaggagggccgcgggcacgtgaagctcagccggggctccgaggtggtcctggacgcgtgcgacaccagctgcgaggtgatgatccccaaggggaccggcgacatcctggtcgactgctccggcgggcagcagcacttcctgaaggacaacctcatcgacctgggctgcccccacatccccctgctcgggaagatggccatctacatctgccgcatgagcaaccacccgcggacgaccatggccttcctgttctggttctccttcggctacgtgatcacctgcatcttctgcaaggccctgttctacagcctcatcatcatcggcaccctggggaagaagatcaagcagtaccgcgagctgaagccccagacgtgcaccatctgcgagaccgcgcccgtgaacgccatcgacgccgagatgcacgacctcaactgctcctacaacatctgcccgtactgcgccagccggctgacctccgacggcctggcccgccacgtcccccagtgccccaagcggaaggagaaggtggaggagacggagctctacctgaacctggagcgcatcccctggatcgtgcggaagctcctgcaggtcagcgagtccaccggggtggcgctgaagcgcagctcctggctcatcgtgctgctggtcctcctgaccgtgagcctgtccccggtgcagagcgcccccgtcggccacgggaagaccatcgagacgtaccagacccgggagggcttcaccagcgtgtgcctcttcatgctgggctccatcctgttcctcgtgagctgcctggtcaaggggctggtggactccgtgagcgactccttcttccccggcctcagcgtctgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtgtgcaagcggatgtgcttccgcgccacgatcgaggcgagccggcgcgccctgctcatccgctccatcatcaacaccaccttcgtcatctgcatcctgaccctgacgatctgcgtggtgagcacctccgccgtcgagatggagaacctcccgagcggcacctgggagcgggaggaggacctgaccaacttctgccaccaggagtgccaggtgacggagaccgagtgcctgtgcccctacgaggccctcgtgctgcgcaagcccctgttcctcgactccatcgtcaagggcatgaagaacctgctgaacagcaccagcctcgagacctccctgagcatcgaggccccctggggggcgatcaacgtgcagtccacgttcaagccgaccgtgagcaccgccaacatcgccctgtcctggagctccgtcgagcaccggggcaacaagatcctcgtgaccgggcgcagcgagtccatcatgaagctggaggagcggacgggcgtgagctgggacctgggggtcgacgacgcctccgagagcaagctcctgaccgtgtccatcatggacctgagccagatgtactcccccgtgttcgagtacctcagcggcgaccgccaggtcgaggagtggcccaaggcgacctgcaccggcgactgccccgagcggtgcgggtgcacgtccagcacctgcctgcacaaggagtggccgcactcccgcaactggcggtgcaaccccacctggtgctggggcgtggggaccggctgcacctgctgcggggtggacgtcaaggacctgttcacggaccacatgttcgtgaagtggaaggtggagtacatcaagaccgaggccatcgtctgcgtggagctcaccagccaggagcgccagtgcagcctgatcgaggccggcacccggttcaacctgggccccgtgacgatcaccctctccgagccccgcaacatccagcagaagctgccgcccgagatcatcaccctgcaccccaaggtcgaggaggggttcttcgacctcatgcacgtgcagaaggtgctgagcgcctccaccgtctgcaagctgcagagctgcacgcacggcatccccggggacctccaggtgtaccacatcggcaacctgctgaagggcgaccgggtgaacgggcacctcatccacaagatcgagccgcacttcaacacctcctggatgagctgggacggctgcgacctggactactactgcaacatgggggactggccctcctgcacctacaccggcgtcacgcagcacaaccacgccgcgttcgtgaacctgctcaacatcgagaccgactacaccaagaccttccacttccacagcaagcgcgtcacggcccacggggacaccccccagctggacctgaaggcccggcccacctacggcgccggcgagatcaccgtgctcgtggaggtcgccgacatggagctgcacacgaagaaggtggagatctccgggctgaagttcgcgagcctcgcctgcaccggctgctacgcctgctccagcgggatctcctgcaaggtgcgcatccacgtcgacgagccggacgagctgaccgtgcacgtgaagagcaacgaccccgacgtcgtggccgcctccaccagcctgatggcgcggaagctcgagttcggcacggactccaccttcaaggccttcagcgccatgcccaagacctccctgtgcttctacatcgtggagcgcgagtactgcaagagctgcagcgaggaggacacccagaagtgcgtcgacacgaagctggagcagccgcagtccatcctcatcgagcacaaggggaccatcatcggcaagcagaacgtgacctgcaccgccaaggcgagctgctggctggagtccgtgaagagcttcttctacggcctgaagaacatgctcgggtccgtcttcggcaacttcttcatcgggatcctgctgttcctcgcccccttcgtgctgctggtgctgttcttcatgttcggctggaagatcctcttctgcttcaagtgctgccggcgcacgcgggggctgctgaagtaccgcctcctgaaggacgacgaggagaccggctaccgccggatcatcgagcgcctgaacaacaagaagggcaagaaccggctcctggacggggagcgcctggccgaccggaagatcgccgagctcttcagcaccaagacccacatcggctga

SEQ ID NO: 11982 - RNA, 5067 nt, synthetic construct
  misc_feature 1..5067: note = derived and/or modified CDS sequence (opt1) from CCHFV(36-ST-2014)__KR814857.1__GP
  source 1..5067: mol_type = other RNA
atgcccatcaacatcatgcacaccctgctcgtgtgcttcatcctgtacctgcagctcagcggcctggggggcgcccacgggcagtccaacgccaccgagcacaacggcacgaacaccaccaccgtcccggggacgagccagtcccccaagccccccgcgagcaccaccctgccgcacacccccgagtccagcacggtgaagctcaccacccccacctccgagacggagggcagcggcgagaccacccccccgcccaacaccacgcaggggctgccccccccgggcaccacccccgagcgccccgccaccacggccacctccatgagctccaccgacaacatgaacagcaccacgcaggtgaccgacaacacccccacctccacggtcagcatctccccgagctccagcccctccatgcccagcaccagccaggggatccactaccccgtgcggtccctgctcagcgtgtccagcccgaagaccgtcaccacgcccacccccatgtcccccggcgagatgagcccggagacctccagccagcactccgccatgagccgcatccccaccctgtacacggccacccaggtgtccaccgagaacaccaaccggagcaccccccgccagtccgagagctccgcgcagcccgccacgcagagcccgaccacctcccccacccagacgatcctgctcatgagcgccgcccccaaggcgatccaggacatgcacccgtcccccaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgagcaccctctcccccacggagcccagccacgtgcggctgccgaccgccgagcccttcaagtcctacttcgccaagggcttcctgagcatcgactccggctacttcagcgccaagtgctacccccgctccagcacctccgggctccagctgatcaacgtgacccagcaccccgcccggatcgcggagacgccgggccccaagaccaccagcctgaagaccatcaactgcatcaacctccgcgcctccgtcttcaaggagcaccgggaggtggagatcaacgtgctgctgccccagatcgccgtcaacctcagcaactgccacgtggtgatcaactcccacgtctgcgactacagcctggacacggacgggcccgtgcgcctgccgcggatccaccacgagggcaccttcatccccgggacctacaagatcgtgatcgacaagaagaacaagctcaacgaccgctgctccctggtcaccaactgcgtgatcaagggccgggaggtgcgcaagggccagagcgtcctgcggcagtacaagacggagatcaagatcgggaaggccagcaccggctcccgcaagctcctgagcgaggagcccggggacgactgcatctcccggacccagctgctcaagaccgagacggccgagatccacgacgacaactacggcgggcccggcgacaagatcaccatctgcaacggcagcaccatcgtggaccagcgcctggggtccgagctgggctgctacaccatcaaccgcgtcaagagcttcaagctctgcgagaactccgcgacggggaagacctgcgagatcgacagcaccccggtgaagtgccggcagggcttctgcctgaagatcacccaggaggggcgcggccacgtgaagctgtcccggggcagcgaggtcgtgctggacgcctgcgactccagctgcgagatcatgatccccaaggggacgggcgacatcctcgtggactgctccgggggccagcagcacttcctgaaggacaacctgatcgacctcggctgcccccacatccccctgctggggaagatggccatctacatctgccgcatgagcaaccacccgcggaccaccatggccttcctcttctggttctccttcggctacgtcatcacctgcatcttctgcaaggccctgttctacagcctgatcatcatcgggaccctcggcaagaagatcaagcagtaccgcgagctgaagccccagacgtgcaccatctgcgagaccgcgcccgtgaacgccatcgacgccgagatgcacgacctgaactgctcctacaacatctgcccctactgcgccagccggctcacctccgacgggctggcccgccacgtgacgcagtgcccgaagcggaaggagaaggtcgaggagaccgagctgtacctcaacctggagcgcatcccctggatcgtgcggaagctgctccaggtgagcgagagcaccggcgtcgcgctgaagcgctccagctggctgatcgtgctcctggtgctgctcaccgtctccctgagccccgtgcagtccgccccggtgggccacgggaagacgatcgagacctaccagacccgggagggcttcaccaacatctgcctgttcatgctcgggagcatcctgttcatcgtctcctgcctggtgaagggcctcgtggacagcgtctccgacagcttcttccccgggctgtccgtgtgcaagacgtgcagcatcggctccatcaacggcttcgagatcgagagccacaagtgctactgctccctgttctgctgcccctactgccgccactgcagcgccgaccgggagatccaccagctccacctggggatctgcaagaagcgcaagaccggctccaacgtgatgctggccgtctgcaagcggatgtgcttcaaggcgaccatcgaggccagccgccgggccctcctgatccgctccatcatcaacaccacgttcgtgatctgcatcctgaccctcgccatctgcgtggtcagcaccagcgccgtggagatggagaacctgcccgcggggacctgggagcgcgaggaggacctgacgaacttctgccaccaggagtgccaggtgtccgagaccgagtgcctctgcccgtacgaggccctggtcctgcggaagcccctcttcctggacagcatcgtgaagggcatgaagaacctgctcaactccaccagcctggagacctccctgagcatcgaggccccctggggggccatcaacgtgcagtccacgttcaagcccaccgtcagcaccgccaacatcgcgctctcctggagctccgtggagcaccgcggcaacaagatcctggtgaccggccggagcgagtccatcatgaagctggaggagcgcacgggggtcagctgggacctcggcgtggaggacgcctccgagagcaagctgctgaccgtgtccatcatggacctcagccagatgtactccccggtcttcgagtacctgagcggggaccggcaggtggaggagtggcccaaggccacctgcaccggcgactgccccgagcgctgcgggtgcacgagctccacctgcctgcacaaggagtggccccacagccggaactggcgctgcaacccgacctggtgctggggcgtgggcaccgggtgcacgtgctgcggcgtcgacgtgaaggacctcttcaccgaccacatgttcatcaagtggaaggtggagtacatcaagaccgaggccatcgtctgcgtggagctgacctcccaggagcggcagtgcagcctgatcgaggccgggacccgcttcaacctcggccccgtgacgatcaccctgtccgagccccggaacatccagcagaagctgcccccggagatcatcaccctccaccccaagatcgaggagggcttcttcgacctgatgcacgtccagaaggtgctgagcgcgtccaccgtgtgcaagctccagagctgcacgcacgggatccccggcgacctgcagatctaccacatcgggaacctgctcaagggcgaccgcctgaacgggcacctgatccacaagatcgagccccacttcaacacctcctggatgagctgggacggctgcgacctcgactactactgcaacatgggcgactggccgtcctgcacctacaccggggtcacgcagcacaaccacgccgccttcgtgaacctgctgaacatcgagaccgactacaccaagaccttccacttccacagcaagcgggtcacggcccacggcgacaccccccagctcgacctgaaggcgcgccccacctacggggccggcgagatcaccgtgctggtggaggtcgccgacatggagctccacacgaagaaggtggagatctccgggctgaagttcgccagcctggcctgcaccggctgctacgcgtgctccagcggcatctcctgcaaggtgcggatccacgtcgacgagcccgacgagctcaccgtgcacgtgaagagctccgacccggacgtcgtggccgccagcaccagcctgatggcccgcaagctggagttcgggacggactccaccttcaaggccttcagcgcgatgcccaagacctccctctgcttctacatcgtggagcgggagtactgcaagagctgctccgaggacgacaccaagaagtgcgtcgacacgaagctggaccagccccagagcatcctgatcgagcacaagggcaccatcatcgggaagcagaacgacacctgcaccgccaaggcctcctgctggctcgagagcgtgaagtccttcttctacggcctgaagaacatgctggggagcgtgttcggcaacttcttcgtcggcatcctcctgttcctggcccccttcgtgctgctcgtgctgttcttcatgtgcgggtggaagttcctgttctgcttcaagtgctgccgccggacgcgcggcctcttcaagtaccggcacctgaaggacgacgaggagaccgggtaccgccgcatcatcgagcggctgaactccaagaagggcaagaaccgcctcctggacggcgagcggctggccgaccgcaagatcgcggagctcttcagcaccaagtcccacatcgggtga

SEQ ID NO: 11983 - RNA, 5067 nt, synthetic construct
  misc_feature 1..5067: note = derived and/or modified CDS sequence (opt1) from CCHFV(24-R-2012)__KR814856.1__GP
  source 1..5067: mol_type = other RNA
atgcccaccaacatcatgcacaccctgctcgtgtgcttcatcctgtacctgcagctcctgggcctcgggggcgcccaccgccagagcaacgccacggagcacaacgggaccaacaccaccacggcgccgtccaccagccagtcccccaagccgcccgtcagcaccgccccgccccacgcccccgagtccagcaccatcaagcccacgacccccgcctccgagaccgagggcagcggggagaccacgcccccgcccaacaccacccagggcccctccccgcccgaggccacccccgagcggacggcgaccaccgccaccagcacgccctccaccgacaacaccaacagcaccacgcacgccaccgacaacaaccccacctccaccatcagcacgtcccccagctccagcccctccaccccgagcacgccccagggcatccaccaccccgcccgcaacctgctgagcgtgtccagccccaagaccgcgaccaccccgacccccacctcccccggggacatcagctccgagacgagctccctgcacagcgccatgtcccggacccccaccctccacaccgccacccaggccagcacggagaacgccaaccactccgcgccgcgccagagcgagtccagcgcccagcagaccaccacctcccccatgacgagccccgcccagccgatcctggtgatgtccgccgcccccaccgcgatccagaacatccaccccagccccaccaaccggtccaagcgcaacctggagatggagatcatcctcaccctgagccagggcctgaagaagtactacgggaagatcctcaagctgctgcacctcacgctggaggaggacaccgagggcctgctcgagtggtgcaagcggaacctggggagcaactgcgacgacgacttcttccagaagcgcatcgaggagttcttcatgaccggcgagggctacttcaacgaggtcctgcagttcaagaccctctccacgctgagcccgaccgagccctcccacgcccggccgcccaccgtggagcccttcaagagctacttcgccaaggggttcctgtccatcgacagcggctacttctccgccaagtgctacccccgcctcagcacctccgggctgcagctgatcaacgtgacgcagcaccccgcccggatcgcggagacccccggcccgaagaccaccagcctcaagacgatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacaccgacggccccgtccgcctcccccacatctaccacgaggggaccttcatcccgggcacctacaagatcgtgatcgacaagaagaacaagctgaacgaccggtgcacgctggtgaccaactgcgtcatcaaggggcgcgaggtgcggaagggccagtccgtgctccgccagtacaagaccgagatcaagatcgggaaggccagcaccggctcccggaagctgctgagcgaggagcccggcgacgactgcatcagccgcacgcagctcctgcggaccgagaccgccgagatccacgacgacaactacgggggccccggggacaagatcaccatctgcaacggctccacgatcgtcgaccagcgcctggggagcgagctcggctgctacaccatcaaccgcgtgaagtccttcaagctgtgcgagaacagcgcgaccggcaagacctgcgagatcgactccacgcccgtgaagtgccggcaggggttctgcctgaagatcacccaggagggccgcgggcacgtcaagctcagccggggctccgaggtggtgctggacgcctgcgacaccagctgcgaggtcatgatcccgaaggggaccggcgacatcctggtggactgctccggcgggcagcagcacttcctgaaggacaacctcatcgacctgggctgcccccacatccccctgctcgggaagatggccatctacatctgccgcatgagcaaccacccccggaccacgatggccttcctgttctggttctccttcggctacgtcatcacgtgcatcttctgcaaggcgctgttctacagcctcatcatcatcggcaccctggggaagaagatcaagcagtaccgcgagctgaagccgcagacctgcaccatctgcgagaccgcccccgtgaacgccatcgacgccgagatgcacgacctcaactgctcctacaacatctgcccctactgcgccagccggctgacctccgacggcctggcgcgccacgtgccgcagtgccccaagcggaaggagaaggtcgaggagaccgagctctacctgaacctggagcgcatcccctggatcgtgcggaagctcctccaggtgagcgagtccacgggggtcgccctgaagcgcagctcctggctcatcgtgctgctggtgctcctgaccgtcagcctgagccccgtgcagtccgccccggtgggccacgggaagaccatcgagacctaccagacgcgggagggcttcaccagcgtctgcctcttcatgctgggctccatcctgttcctcgtgagctgcctggtgaaggggctggtcgactccgtgagcgactccttcttccccggcctcagcgtgtgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtcatgctggccgtgtgcaagcggatgtgcttccgcgcgaccatcgaggccagccggcgcgccctgctcatccgctccatcatcaacacgaccttcgtgatctgcatcctgaccctgaccatctgcgtcgtgagcacgtccgccgtggagatggagaacctccccagcggcacctgggagcgggaggaggacctgaccaacttctgccaccaggagtgccaggtcaccgagacggagtgcctgtgcccgtacgaggccctcgtgctgcgcaagcccctgttcctcgacagcatcgtgaagggcatgaagaacctgctgaactccaccagcctcgagacctccctgagcatcgaggcgccctggggcgccatcaacgtccagtccaccttcaagcccacggtgagcaccgccaacatcgccctgtcctggagctccgtggagcaccgggggaacaagatcctcgtcaccgggcgcagcgagtccatcatgaagctggaggagcggaccggcgtgagctgggacctgggggtggaggacgcgtccgagagcaagctcctgacggtctccatcatggacctgagccagatgtactccccggtgttcgagtacctcagcggcgaccgccaggtggaggagtggcccaaggcgacctgcaccggcgactgccccgagcggtgcgggtgcacctccagcacgtgcctgcacaaggagtggccccacagccgcaactggcggtgcaacccgacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctcacctcccaggagcgccagtgcagcctgatcgaggccggcacccggttcaacctgggccccgtgaccatcacgctctccgagccccgcaacatccagcagaagctgcccccggagatcatcaccctgcaccccaaggtggaggaggggttcttcgacctcatgcacgtccagaaggtgctgagcgcctccaccgtgtgcaagctgcagagctgcacccacggcatccccggggacctccaggtctaccacatcggcaacctgctgaagggcgaccgggtgaacgggcacctcatccacaagatcgagccccacttcaacacgtcctggatgagctgggacggctgcgacctggactactactgcaacatgggggactggccgtcctgcacctacaccggcgtgacccagcacaaccacgccgccttcgtcaacctgctcaacatcgagacggactacaccaagaccttccacttccacagcaagcgcgtgaccgcccacggggacacgccccagctggacctgaaggcccggcccacctacggcgccggcgagatcaccgtcctcgtggaggtggcggacatggagctgcacaccaagaaggtcgagatctccgggctgaagttcgccagcctcgcctgcacgggctgctacgcctgctccagcgggatctcctgcaaggtgcgcatccacgtggacgagcccgacgagctgaccgtccacgtcaagagcaacgacccggacgtggtggccgcgtccaccagcctgatggcccggaagctcgagttcggcaccgactccacgttcaaggccttcagcgccatgcccaagaccagcctgtgcttctacatcgtggagcgcgagtactgcaagtcctgcagcgaggaggacacccagaagtgcgtggacaccaagctggagcagccccagtccatcctcatcgagcacaaggggacgatcatcggcaagcagaacgacacgtgcaccgcgaaggccagctgctggctggagtccgtcaagagcttcttctacggcctgaagaacatgctcgggtccgtgttcggcaacttcttcatcgggatcctgctgttcctcgccccgttcgtgctgctggtcctgttcttcatgttcggctggaagatcctcttctgcttcaagtgctgccggcgcacccgggggctgctgaagtaccgcctcctgaaggacgacgaggagaccggctaccgccggatcatcgagcgcctgaacaacaagaagggcaagaaccggctcctggacggggagcgcctggccgaccggaagatcgccgagctgttcagcaccaagacccacatcggctga

SEQ ID NO: 11984 - RNA, 5064 nt, synthetic construct
  misc_feature 1..5064: note = derived and/or modified CDS sequence (opt1) from CCHFV(Oman-199809166)__KR864901.1__GP
  source 1..5064: mol_type = other RNA
atgcccgtgaacaccatgcacaccctgctcgtctacgccgtgttctgcctgcagctgtggagcccgggcgggacgcgcggcctctccaacgagacccagcacaacgagaccgggatcacccgggcccccgagggcagccaggggccctccctgcccgtgagcacggcgtccccgatcatgagcgacccctccatcaccaccctgagcgcctccaccagcggcctcgagggctccggggacacgaccccgcccgccatcacccagggcccgaccctgcccgagacgacccccgagcccagcaccaccacggggaccaacgccttctccaccgccatcgcgaacgtcagcacccagacggtgaaggacaccccgacccccaccgtgcagacgtccccgcccagcacccccgacgcctccaccatcccccagggcacccaccacacggcccgcgggctgctcagcgtcaccgtgaccaagcccgaggaggtgcccaccccgacgggccccgagcaggcctccatcgagaccaacagcagccggctggcgacctccaagacccccagcccctccccgacggcccaggtcaccaccgagaacagcaaccccaacacctcccgccagctggtgctcagcacccagcccgccacgtccagccccgtgacctccccggcccagctgaacttcgtccagagcgccaccaccatcgcggtgcaggacgcccacccctcccccacgaaccggagcaagcgcaacctggagatggaggtgatcctcaccctgtcccagggcctgcggaagtactacgggcgcatcctcaagctgctggacctcaccctggaggaggacaccgagggcctgctcgagtggtgcaagcggaacctggggctgacgtgcgacgacaacttcttccagaagcgcatcgaggagttcttcctcaccggcgagggccacttcaacgaggtcctgcagttcaagaccccgagcaccctgtcccccacggagagcgcctccgtggggctccccaccgtggagcccttcaagagctacttcgccaagggcttcctgtccatcgacagcgggtacttcagcgccaagtgctacccgcgggcgtccaacagcggcctgcagctcatcaacgtcacccagcactccgcccgcatcgccgacacccccgggcccaagatcacgaacctgaagaccatcaactgcatcaacctgaaggccctcgtgttcaaggagcaccgggagatcgagatcaacgtgctgctgccccaggtcgccgtgaacctcagcaactgccacgtgcacatcaagtcccacgtctgcgactacagcctggacatcgacggcaccgtgcgcctgccgcggatccaccacgagggcaccttcatccccgggacgtacaagatcgtcatcgacaagaagaacaagcagaacgaccgctgcaacctcgtgaccaactgcgtgatcaagggccgggaggtccgcaaggggcagtccgtgctgcggcagtaccgcaccgagatccggatcggcaaggcgagctccgggagccgccgcctgctctccgaggagagcggcgaggactgcatctcccggacccagctgctgcgcacggagaccgccgagatccacggcgacaactacgggggccccggggacaagatcaccatctgcaacggcagcaccatcgtggaccagcggctcgggtccgagctgggctgctacacgatcaaccgcgtcaagagcttcaagctgtgcgagaactccgccaccggcaagagctgcgagatcgacaacacccccgtgaagtgcaagcaggggttctgcctgaagatcacccaggagggccgggggcacgtgaagctcagccgcgactccgaggtcgtgctggacgcctgcgacagctcctgcgagatcatgatcccgaagggcacgggcgacatcctggtggactgcagcgggggccagcagcacttcctcaaggacaacctgatcgacctggggtgccccaacatccccctcctgggcaagatggccatctacatctgccggatgtccaaccaccccaagaccaccatggcgttcctgttctggttcagcttcgggtacgtcatcacgtgcatcctctgcaaggtgatcttctacctgctgatcgtggtcggcaccctcggcaagaagttcaagcagtaccgcgagctgaagccgcagacctgcaccatctgcgagaccacccccgtgaacgccatcgacgccgagatgcacgacctgaactgctcctacaacatctgcccctactgcgccagccggctcacgtccgacgggctggcgcgccacgtgatgcagtgccccaagcggaaggagaagatcgaggagaccgagctgtacctcaacctggagcgcatcccgtgggtcgtgcggaagctgctccaggtgagcgagtccaccggcgtcgccctgaagcgcagctcctggctgatcgtgctcctggtgctgctcaccgtcagcctgtcccccgtgcagagcgcccccatcgggcacggcaagacgatcgagacctaccagacccgggaggggtacacctccatctgcctgttcgtgctcggcagcatcctgttcatcgtctcccacctgatgaagggcctcgtggacagcgtggggaacagcttcttccccggcctgtccatctgcaagacgtgcagcatcgggtccatcaacggcttcgagatcgagagccacaagtgctactgctccctgttctgctgcccgtactgccgccactgcagcgccgacaaggagatccacaagctccacctgtccatctgcaagaagcggaaggccgggagcaacgtcatgctggcggtgtgcaagcgcatgtgcttccgggccaccatggaggtgtccaacaaggccctcctgatccgcagcgtcatcaacaccaccttcgtggtgtgcatcctgatcctcgccgtctgcgtggtgtccacgagcgccgtcgagatggagtccctgcccgcgggcacctgggagcgcgaggaggacctgaccaacttctgccaccaggagtgccaggtgaccgagacggagtgcctctgcccctacgaggccctggtgctgcggaagcccctcttcctggacagcatcgccaagggcatgaagaacctgctcaactccaccagcctggagacctccctgagcatcgaggccccctggggcgccatcaacgtccagtccaccttcaagcccacggtgagcaccgcgaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgaccgtgtccgtcatggacctcagccagatgtactcccccgtgttcgagtacctgagcggcgaccgccaggtggaggagtggccgaaggccacgtgcaccggcgactgccccgagcggtgcgggtgcacctcctccacgtgcctgcacaaggagtggccccacagccggaactggcgctgcaaccccacctggtgctggggcgtcgggaccggctgcacgtgctgcggcctcgacgtgaaggacctgttcaccgactacatgttcgtcaagtggaaggtggagtacatcaagaccgaggcgatcgtgtgcgtcgagctgaccagccaggagcggcagtgctccctcatcgaggccgggacccgcttcaacctgggcccggtgaccatcacgctgagcgagccccggaacatccagcagaagctcccgcccgagatcgtgaccctgcacccccgcatcgaggaggggttcttcgacctgatgcacgtccagaaggtgctctccgccagcaccgtgtgcaagctgcagagctgcacccacggcgtccccggggacctccaggtgtaccacatcggcaacctgctgaagggcgacaaggtgaacgggcacctgatccacaaggtcgagccccacttcaacacctcctggatgagctgggacggctgcgacctcgactactactgcaacatgggggactggccctcctgcacgtacaccggcgtgacccagcacaaccacgccgccttcgtgaacctgctgaacatcgagaccgactacacgaagaacttccacttccacagcaagcgggtcaccgcgcacggggacaccccgcagctcgacctgaaggcccgccccaactacggcgccggcgagatcaccgtgctggtggaggtcgccgacatggagctccacacgaagaagatcgagatctccgggctgaagttcgccagcctgacctgcaccggctgctacgcgtgctccagcgggatctcctgcaaggtgcggatccacgtggacgagcccgacgagctcaccgtccacgtcaagagcgaggaccccgacatcgtggccgcctccagctccctgatggcccgcaagctggagttcggcacggacagcaccttcaaggccttctccgcgatgccgaagaccagcctctgcttctacatcgtggagcgggagtactgcaagtcctgcagcaaggaggacacccagaagtgcgtgaacgccaagctggagcgcccccagtccatcctgatcgagcacaaggggacgatcatcggcaagcagaacgacacgtgcaccgccaaggccagctgctggctcgagagcgtgaagtccttcttctacggcctgaagaacatgctgagcgggatcttcggcaacgtcttcatcgggatcttcctgttcctcgcgcccttcatcctgctgatcctcttcttcatgttcggctggcggatcctgttctgcttcaagtgctgccgccggacccgcggcctgttcaagtaccgccacctcaaggacgacgaggagaccgggtaccggaagatcatcgagcgcctgaacaacaagaagggcaagaacaagctgctcgacggggagcggctggccgaccgcaagatcgccgagctgttctccaccaagacccacatcggctga

SEQ ID NO: 11985 - RNA, 5064 nt, synthetic construct
  misc_feature 1..5064: note = derived and/or modified CDS sequence (opt1) from CCHFV(Oman_812956)__KY362518.1__GP
  source 1..5064: mol_type = other RNA
atgcccgtgaacaccatgcacaccctgctcgtctacgccgtgttctgcctgcagctgtggagcccgggcgggacgcgcggcctctccaacgagacccagcacaacgagaccgggatcacccgggcccccgagggcagccaggggccctccctgcccgtgagcacggcgtccccgatcatgagcgacccctccatcaccaccctgagcgcctccaccagcggcctcgagggctccggggacacgaccccgcccgccatcacccagggccccaccctgcccgagacgacccccgagcccagcaccaccacggggaccaacgccttctccaccgccatcgcgaacgtcagcacccagacggtgaaggacaccccgacccccaccgtgcagacgtccccgcccagcacccccgacgcctccaccatcccccagggcacccaccacacggcccgcgggctgctcagcgtcaccgtgaccaagcccgaggaggtgcccaccccgacgggccccgagcaggcctccatcgagaccaacagcccccggctggcgaccagcaagaccccctccccgagccccacggcccaggtcaccaccgagaactccaaccccaacaccagccgccagctggtgctctccacccagcccgccacgagctccccggtgaccagccccgcccagctgaacttcgtccagtccgccaccaccatcgcggtgcaggacgcccaccccagcccgacgaaccggtccaagcgcaacctggagatggaggtgatcctcaccctgagccagggcctgcggaagtactacgggcgcatcctcaagctgctggacctcaccctggaggaggacaccgagggcctgctcgagtggtgcaagcggaacctggggctgacgtgcgacgacaacttcttccagaagcgcatcgaggagttcttcctcaccggcgagggccacttcaacgaggtcctgcagttcaagaccccctccaccctgagccccacggagtccgccagcgtggggctccccaccgtggagccgttcaagtcctacttcgccaagggcttcctgagcatcgactccgggtacttcagcgccaagtgctacccccgggcgagcaactccggcctgcagctcatcaacgtcacccagcacagcgcccgcatcgccgacacccccgggcccaagatcacgaacctgaagaccatcaactgcatcaacctgaaggccctcgtgttcaaggagcaccgggagatcgagatcaacgtgctgctgccgcaggtcgccgtgaacctctccaactgccacgtgcacatcaagagccacgtctgcgactactccctggacatcgacggcaccgtgcgcctgccccggatccaccacgagggcaccttcatccccgggacgtacaagatcgtcatcgacaagaagaacaagcagaacgaccgctgcaacctcgtgaccaactgcgtgatcaagggccgggaggtccgcaaggggcagagcgtgctgcggcagtaccgcaccgagatccggatcggcaaggcgtccagcgggtcccgccgcctgctcagcgaggagtccggcgaggactgcatcagccggacccagctgctgcgcacggagaccgccgagatccacggcgacaactacgggggccccggggacaagatcaccatctgcaacggctccaccatcgtggaccagcggctcgggagcgagctgggctgctacacgatcaaccgcgtcaagtccttcaagctgtgcgagaacagcgccaccggcaagtcctgcgagatcgacaacaccccggtgaagtgcaagcaggggttctgcctgaagatcacccaggagggccgggggcacgtgaagctcagccgcgacagcgaggtcgtgctggacgcctgcgactccagctgcgagatcatgatccccaagggcacgggcgacatcctggtggactgctccgggggccagcagcacttcctcaaggacaacctgatcgacctggggtgccccaacatccccctcctgggcaagatggccatctacatctgccggatgagcaaccacccgaagaccaccatggcgttcctgttctggttctccttcgggtacgtcatcacgtgcatcctctgcaaggtgatcttctacctgctgatcgtggtcggcaccctcggcaagaagttcaagcagtaccgcgagctgaagccccagacctgcaccatctgcgagaccacccccgtgaacgccatcgacgccgagatgcacgacctgaactgcagctacaacatctgcccctactgcgcctcccggctcacgagcgacgggctggcgcgccacgtgatgcagtgcccgaagcggaaggagaagatcgaggagaccgagctgtacctcaacctggagcgcatcccctgggtcgtgcggaagctgctccaggtgtccgagagcaccggcgtcgccctgaagcgctccagctggctgatcgtgctcctggtgctgctcaccgtctccctgagccccgtgcagtccgcccccatcgggcacggcaagacgatcgagacctaccagacccgggaggggtacaccagcatctgcctgttcgtgctcggctccatcctgttcatcgtcagccacctgatgaagggcctcgtggactccgtggggaacagcttcttcccgggcctgagcatctgcaagacgtgctccatcgggagcatcaacggcttcgagatcgagtcccacaagtgctactgcagcctgttctgctgcccctactgccgccactgctccgccgacaaggagatccacaagctccacctgagcatctgcaagaagcggaaggccgggtccaacgtcatgctggcggtgtgcaagcgcatgtgcttccgggccaccatggaggtgagcaacaaggccctcctgatccgctccgtcatcaacaccaccttcgtggtgtgcatcctgatcctcgccgtctgcgtggtgagcacgtccgccgtcgagatggagagcctgcccgcgggcacctgggagcgcgaggaggacctgaccaacttctgccaccaggagtgccaggtgaccgagacggagtgcctctgcccgtacgaggccctggtgctgcggaagcccctcttcttcgactccatcgccaagggcatgaagaacctgctgaacagcacctccctcgagaccagcctgtccatcgaggccccctggggcgccatcaacgtccagagcaccttcaagcccacggtgtccaccgcgaacatcgccctgagctggagctccgtggagcaccgcgggaacaagatcctcgtcagcgggcggtccgagagcatcatgaagctggaggagcgcaccggcatctcctgggacctgggggtggaggacgccagcgagtccaagctcctgaccgtgagcgtcatggacctgtcccagatgtacagcccggtgttcgagtacctctccggcgaccgccaggtggaggagtggcccaaggccacgtgcaccggcgactgccccgagcggtgcgggtgcaccagctccacgtgcctgcacaaggagtggccccacagccggaactggcgctgcaacccgacctggtgctggggcgtcgggaccggctgcacgtgctgcggcctggacgtgaaggacctcttcaccgactacatgttcgtcaagtggaaggtggagtacatcaagaccgaggcgatcgtgtgcgtcgagctgacctcccaggagcggcagtgcagcctgatcgaggccgggacccgcttcaacctcggccccgtgaccatcacgctgtccgagccccggaacatccagcagaagctgcccccggagatcgtgaccctccacccccgcatcgaggaggggttcttcgacctgatgcacgtccagaaggtgctgagcgcctccaccgtgtgcaagctccagagctgcacccacggcgtccccggggacctccaggtgtaccacatcggcaacctgctgaagggcgacaaggtgaacgggcacctgatccacaaggtcgagccccacttcaacaccagctggatgtcctgggacggctgcgacctggactactactgcaacatgggggactggccgagctgcacgtacaccggcgtgacccagcacaaccacgccgccttcgtgaacctcctgaacatcgagaccgactacacgaagaacttccacttccactccaagcgggtcaccgcgcacggggacacgccccagctggacctcaaggcccgccccaactacggcgccggcgagatcaccgtgctggtggaggtcgccgacatggagctgcacaccaagaagatcgagatcagcgggctcaagttcgcctccctgacctgcaccggctgctacgcgtgcagctccgggatcagctgcaaggtgcggatccacgtggacgagcccgacgagctgaccgtccacgtgaagtccgaggacccggacatcgtggccgccagctccagcctcatggcccgcaagctggagttcggcacggactccaccttcaaggccttcagcgcgatgcccaagacctccctgtgcttctacatcgtcgagcgggagtactgcaagagctgctccaaggaggacacccagaagtgcgtgaacgccaagctcgagcgcccccagagcatcctgatcgagcacaaggggacgatcatcggcaagcagaacgacacgtgcaccgccaaggcctcctgctggctggagagcgtcaagagcttcttctacggcctcaagaacatgctgtccgggatcttcggcaacgtgttcatcgggatcttcctgttcctggcgcccttcatcctcctgatcctgttcttcatgttcggctggcggatcctcttctgcttcaagtgctgccgccggacccgcggcctgttcaagtaccgccacctgaaggacgacgaggagaccgggtaccggaagatcatcgagcgcctcaacaacaagaagggcaagaacaagctgctggacggggagcggctcgccgaccgcaagatcgccgagctgttcagcaccaagacccacatcggctga

SEQ ID NO: 11986 - RNA, 5064 nt, synthetic construct
  misc_feature 1..5064: note = derived and/or modified CDS sequence (opt1) from CCHFV(Oman)__DQ211632.1__GP
  source 1..5064: mol_type = other RNA
atgcccgtgaacaccatgcacaccctcctcgtctacgccgtgttctgcctgcagctgtggagcccgggcgggacgcgcggcctctccaacgagacccagcacaacgagaccgggatcacccgggcccccgagggcagccaggggccctccctgcccgtgagcacggcgtccccgatcatgagcgacccctccatcaccacccccagcgcctccaccagcggcctggagggctccggggacacgacgcccccggccatcacccagggccccaccccgcccgagaccacccccgagcccagcaccaccacggggaccaacgccttctccaccgccatcgcgaacgtcagcacccagacggtgaaggacacccccacccccaccgtgcagacgtccccgcccagcacccccgacgcctccaccatcccccagggcacccaccacacggcccgcgggctcctgagcgtcaccgtgaccaagccggaggaggtgcccacccccacgggccccgagcaggcctccatcgagaccaacagcccgcggctggcgaccagcaagaccccctcccccagccccacggcccaggtcaccaccgagaactccaacccgaacaccagccgccagctcgtgctgtccacccagcccgccacgagctcccccgtgaccagcccggcccagctgatcttcgtccagtccgccaccaccgtggcggtgcaggacgcccaccccagccccacgaaccggtccaagcgcaacctcgagatggaggtcatcctgaccctgagccagggcctccggaagtactacgggcgcatcctgaagctgctcgacctgaccctggaggaggacaccgagggcctcctggagtggtgcaagcggaacctggggctcacgtgcgacgacaacttcttccagaagcgcatcgaggagttcttcctgaccggcgagggccacttcaacgaggtgctgcagttcaagaccccctccaccctcagctccacggagagcgcctccgtggggctgccgaccgtcgagcccttcaagagctacttcgccaagggcttcctgtccatcgacagcgggtacttcagcgccaagtgctacccccgggcgtccaacagcggcctccagctgatcaacgtgacccagcactccgcccgcatcgccgacacccccgggccgaagatcacgaacctgaagaccatcaactgcatcaacctcaaggccctggtgttcaaggagcaccgggagatcgagatcaacgtcctgctcccccaggtggccgtgaacctgagcaactgccacgtccacatcaagtcccacgtgtgcgactacagcctggacatcgacggcaccgtccgcctcccccggatccaccacgagggcaccttcatccccgggacgtacaagatcgtgatcgacaagaagaacaagcagaacgaccgctgcaacctggtgaccaactgcgtcatcaagggccgggaggtgcgcaaggggcagtccgtgctgcggcagtaccgcaccgagatccggatcggcaaggcgagctccgggagccgccgcctcctgtccgaggagagcggcgaggactgcatctcccggacccagctgctccgcacggagaccgccgagatccacggcgacaactacgggggcccgggggacaagatcaccatctgcaacggcagcaccatcgtcgaccagcggctggggtccgagctgggctgctacacgatcaaccgcgtcaagagcttcaagctctgcgagaactccgccaccggcaagagctgcgagatcgacaacacccccgtgaagtgcaagcaggggttctgcctgaagatcacccaggagggccgggggcacgtgaagctgagccgcgactccgaggtggtgctggacgcctgcgacagctcctgcgagatcatgatccccaagggcacgggcgacatcctcgtcgactgcagcgggggccagcagcacttcctgaaggacaacctgatcgacctcgggtgccccaacatcccgctgctgggcaagatggccatctacatctgccggatgtccaaccaccccaagaccaccatggcgttcctcttctggttcagcttcgggtacgtgatcacgtgcatcctgtgcaaggtgatcttctacctgctcatcgtcgtgggcaccctgggcaagaagttcaagcagtaccgcgagctgaagccccagacctgcaccatctgcgagaccacccccgtgaacgccatcgacgccgagatgcacgacctcaactgctcctacaacatctgcccgtactgcgccagccggctgacgtccgacgggctggcgcgccacgtcatgcagtgccccaagcggaaggagaagatcgaggagaccgagctctacctgaacctggagcgcatcccctgggtggtgcggaagctcctgcaggtcagcgagtccaccggcgtggccctgaagcgcagctcctggctcatcgtgctgctggtcctcctgaccgtgagcctgtcccccgtgcagagcgccccgatcgggcacggcaagacgatcgagacctaccagacccgggaggggtacacctccatctgcctcttcgtcctgggcagcatcctgttcatcgtgtcccacctcatgaagggcctggtggacagcgtcgggaacagcttcttccccggcctgtccatctgcaagacgtgcagcatcgggtccatcaacggcttcgagatcgagagccacaagtgcttctgctccctcttctgctgcccctactgccgccactgcagcgccgacaaggagatccacaagctgcacctgtccatctgcaagaagcggaaggccgggagcaacgtgatgctcgcggtgtgcaagcgcatgtgcttccgggccaccatggaggtctccaacaaggccctgctgatccgcagcgtgatcaacaccaccttcgtggtctgcatcctcatcctggccgtgtgcgtggtctccacgagcgccgtggagatggagtccctgccggcgggcacctgggagcgcgaggaggacctcaccaacttctgccaccaggagtgccaggtgaccgagacggagtgcctgtgcccctacgaggccctggtcctccggaagcccctgttcctggacagcatcgccaagggcatgaagaacctcctgaactccaccagcctggagacctccctcagcatcgaggccccctggggcgccatcaacgtgcagtccaccttcaagccgacggtgagcaccgcgaacatcgccctgagctggtccagcgtcgagcaccgcgggaacaagatcctggtgtccgggcggagcgagtccatcatgaagctcgaggagcgcaccggcatcagctgggacctgggggtggaggacgcctccgagagcaagctgctcaccgtctccgtgatggacctgagccagatgtactcccccgtgttcgagtacctgagcggcgaccggcaggtcgaggagtggcccaaggccacgtgcaccggcgactgccccgagcgctgcgggtgcacctccagcacgtgcctccacaaggagtggccgcactcccggaactggcgctgcaaccccacctggtgctggggcgtggggaccggctgcacgtgctgcggcctggacgtcaaggacctgttcaccgactacatgttcgtgaagtggaaggtggagtacatcaagaccgaggcgatcgtctgcgtggagctcaccagccaggagcggcagtgctccctgatcgaggccgggacccgcttcaacctgggccccgtgaccatcacgctcagcgagccccggaacatccagcagaagctgccgcccgagatcgtcaccctgcacccccgcatcgaggaggggttcttcgacctcatgcacgtgcagaaggtgctgtccgccagcaccgtctgcaagctgcagagctgcacccacggcgtgcccggggacctccaggtgtaccacatcggcaacctgctgaagggcgacaaggtcaacgggcacctcatccacaaggtggagccgcacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaacttccacttccacagcaagcgggtgaccgcgcacggggacacgccccagctggacctgaaggcccgccccaactacggcgccggcgaggtgaccgtcctcgtggaggtggccgacatggagctgcacaccaagaagatcgagatctccgggctgaagttcgccagcctgacctgcaccggctgctacgcgtgctccagcgggatctcctgcaaggtccggatccacgtggacgagccggacgagctcaccgtgcacgtcaagagcgaggaccccgacatcgtggccgcctccagctccctgatggcccgcaagctcgagttcggcacggacagcaccttcaaggccttctccgcgatgcccaagaccagcctgtgcttctacatcgtggagcgggagtactgcaagtcctgcagcaaggaggacacccagaagtgcgtcaacgccaagctggagcgcccccagtccatcctcatcgagcacaaggggacgatcatcggcaagcagaacgacacgtgcaccgccaaggccagctgctggctggagagcgtgaagtccttcttctacggcctgaagaacatgctcagcgggatcttcggcaacgtgttcatcgggatcttcctgttcctggcgccgttcatcctgctcatcctgttcttcatgttcggctggcggatcctgttctgcttcaagtgctgccgccggacccgcggcctcttcaagtaccgccacctgaaggacgacgaggagaccgggtaccggaagatcatcgagcgcctgaacaacaagaagggcaagaacaagctcctggacggggagcggctggccgaccgcaagatcgccgagctgttctccaccaagacccacatcggctga

SEQ ID NO: 11987 - RNA, 5064 nt, synthetic construct
  misc_feature 1..5064: note = derived and/or modified CDS sequence (opt1) from CCHFV(3820-ST-2007)__KR814868.1__GP
  source 1..5064: mol_type = other RNA
atgcccatcaacatcatgcacaccctgctcgtgtgcttcatcctgtacctgcagctcagcggcctggggggcgcccacgggcagtccaacgccaccgagcacaacggcacgaacaccaccaccgtcccggggacgagccagtcccccaagccccccgcgagcaccaccctgccgcacacccccgagtccagcacggtgaagctcaccacccccacctccgagacggagggcagcggcgagaccacccccccgaacaccacgcaggggctgcccctgcccggcaccacccccgagcgctccgccaccacggccaccagcacctccagcaccgacaacatgaactccacgacccaggtgaccgacaacaccccgacgagcaccgtctccatcagcccctccagctccagcagcatgccctccaccagccaggggatccaccaccccgtgcggtccctcctgagcgtgtccagcccgaagaccgtcacgacccccacccccatgtcccccggcgagatgagcccggagacctccagccagcactccgccatgagccgcgtgcccacgctgtacaccgccacccagatctccaccgagaacaccgaccggagcacgccccgccagtccgagagctccgtgcagcccgcgacccagagcccgatcacctcccccgcccagaccatcctcctgatgagcgccgcccccaaggcgatccaggacatgcaccccagcccgacgaaccggtccaagcgcaacctggaggtcgagatcatcctcaccctgagccaggggctgaagaagtactacggcaagatcctcaagctgctgcacctcaccctggaggaggacaccgagggcctgctcgagtggtgcaagcggaacctggggtccaactgcgacgacgacttcttccagaagcgcatcgaggagttcttcatcacgggcgaggggtacttcaacgaggtgctgcagttcaagaccctcagcaccctgtcccccaccgagcccagccacgtgcggctgccgacggccgagcccttcaagtcctacttcgccaagggcttcctcagcatcgactccggctacttcagcgccaagtgctacccccgctccagcacctccgggctgcagctgatcaacgtcacccagcaccccgcccggatcgcggagaccccgggccccaagacgaccagcctcaagaccatcaactgcatcaacctgcgcgcctccgtgttcaaggagcaccgggaggtggagatcaacgtcctgctcccccagatcgccgtgaacctgagcaactgccacgtggtcatcaactcccacgtgtgcgactacagcctggacaccgacgggcccgtgcgcctcccgcggatccaccacgagggcacgttcatccccgggacctacaagatcgtcatcgaccgcaagaacaagctgaacgaccggtgcagcctggtgaccaactgcgtgatcaagggccgcgaggtccggaagggccagtccgtgctccgccagtacaagaccgagatcaagatcgggaagacgagcaccggctcccggaagctgctgagcgaggagcccggggacgactgcatctcccgcacccagctcctgaagaccgagacggccgagatccacgacgacaactacggcagccccggggacaagatcaccatctgcaacggctccaccatcgtcgaccagcgcctgggcagcgagctcgggtgctacaccatcaaccgggtgaagtccttcaagctgtgcgagaacagcgccacgggcaagacctgcgagatcgactccaccccggtgaagtgccgccaggggttctgcctgaagatcacccaggagggccgggggcacgtcaagctgagccgcggctccgaggtggtgctcgacgcgtgcgacagctcctgcgagatcatgatccccaagggcacgggggacatcctggtcgactgcagcggcgggcagcagcacttcctgaaggacaacctcatcgacctgggctgcccccacatccccctgctcggcaagatggccatctacatctgccggatgtccaaccacccgcgcaccaccatggccttcctgttctggttcagcttcgggtacgtgatcacctgcatcttctgcaaggccctgttctactccctcatcatcatcggcaccctggggaagaagatcaagcagtaccgggagctgaagccccagacgtgcaccatctgcgagaccgcccccgtgaacgcgatcgacgccgagatgcacgacctcaactgcagctacaacatctgcccctactgcgccagccgcctgacctccgacggcctggcccggcacgtcacgcagtgcccgaagcgcaaggagaaggtggaggagaccgagctctacctgaacctggagcggatcccctggatcgtgcgcaagctcctgcaggtcagcgagtccaccggggtggccctgaagcggagctcctggctcatcgtgctgctggtcctcctggcggtgagcctgtcccccgtgcagagcgcccccgtcggccacggcaagaccatcgagacgtaccagacccgcgaggggttcacctccatctgcctcttcatgctgggcagcatcctgttcatcgtgtcctgcctcgtgaaggggctggtcgacagcgtgtccgacagcttcttcccgggcctgtccgtgtgcaagacctgcagcatcgggtccatcaacggcttcgagatcgagagccacaagtgctactgctccctcttctgctgcccctactgccggcactgcagcgccgaccgcgagatccaccagctgcacctgagcatctgcaagaagcggaagacgggctccaacgtcatgctcgccgtgtgcaagcgcatgtgcttcaaggcgaccatcgaggccagccggcgcgccctgctgatccgctccatcatcaacaccaccttcgtgatgtgcatcctcacgctggccatctgcgtcgtgagcacctccgccgtggagatggaggacctgcccgcggggacctgggagcgggaggaggacctcaccaacttctgccaccaggagtgccaggtcacggagaccgagtgcctgtgcccgtacgaggccctggtgctccgcaagcccctgttcctggacagcatcgtgaagggcatgaagaacctcctgaactccaccagcctggagacctccctcagcatcgaggccccctggggggccatcaacgtccagtccacgttcaagcccaccgtgagcaccgccaacatcgcgctgtcctggagctccgtggagcaccggggcaacaagatcctggtcaccgggcgcagcgagtccatcatgaagctcgaggagcggacgggcgtgagctgggacctgggcgtggaggacgcctccgagagcaagctgctcaccgtcagcatcatggacctgtcccagatgtacagcccggtgttcgagtacctgtccggggaccgccaggtggaggagtggcccaaggccacctgcaccggcgactgccccgagcggtgcgggtgcacgagctccacctgcctccacaaggagtggccccacagccgcaactggcggtgcaacccgacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctgacctcccaggagcgccagtgcagcctcatcgaggccgggacccggttcaacctgggccccgtcacgatcaccctgtccgagccccgcaacatccagcagaagctccccccggagatcatcaccctgcaccccaagatcgaggaggggttcttcgacctgatgcacgtgcagaaggtgctcagcgcgtccaccgtctgcaagctgcagagctgcacgcacggcatccccggcgacctgcagatctaccacatcgggaacctcctgaagggcgaccgggtgaacgggcacctgatccacaagatcgagccccacttcaacacctcctggatgagctgggacggctgcgacctcgactactactgcaacatgggggactggccgtcctgcacctacaccggcgtcacgcagcacaaccacgccgccttcgtgaacctgctgaacatcgagaccgactacaccaagaccttccacttccacagcaagcgcgtgacggcccacggcgacaccccccagctcgacctgaaggcgcggcccacctacggggccggcgagatcaccgtcctggtggaggtggccgacatggagctccacacgaagaaggtcgagatctccgggctgaagttcgccagcctgacctgcaccggctgctacgcctgctccagcgggatcagctgcaaggtgcgcatccacgtggacgagcccgacgagctcaccgtccacgtgaagtccagcgacccggacgtggtcgcggcctccacgagcctgatggcccggaagctggagttcggcaccgactccaccttcaaggccttcagcgccatgcccaagacctccctctgcttctacatcgtggagcgcgagtactgcaagagctgctccgaggacgacacgaagaagtgcgtggacaccaagctggagcagccccagagcatcctgatcgagcacaagggcaccatcatcgggaagcagaacgacacctgcacggcgaaggcctcctgctggctcgagagcgtcaagtccttcttctacggcctgaagaacatgctggggagcgtgttcggctccttcttcgtggggatcctcctgttcctggcccccttcgtcctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaacagcaagaagggcaagaaccggctcctggacggggagcgcctggccgaccggaagatcgccgagctcttctccaccaagacgcacatcggctga

SEQ ID NO: 11988 - RNA, 5058 nt, synthetic construct
  misc_feature 1..5058: note = derived and/or modified CDS sequence (opt1) from CCHFV(SR3)__AJ538199.1__GP
  source 1..5058: mol_type = other RNA
atgcacatcagcctgatgtacgccgtgttctgcctccagctgtgcggcctggggaagaccaacggcccccacaacgggaccgagcacaacaacacgcacgtcatgaccaccccggacgactcccagagccccgagccccccgtgtccaccgccctcccggtgacgcccgaccccagcaccgtcaccccctccaccccggcgagcggcctggaggggtccggcgaggtgtacacgagctcccccatcaccaccaagggcctgagcctccccgaggccacctccgagcccccggccacgaccagcgtggtcacctccagcgcctccgacaccgacagctccacgcaggccgcgggggacacccccacccccaccgtgcgcacgagcctgccctccagcccgagcaccccctccaccagccagggcacccactaccccgtgcggtccctgctcagcgtcacgtcccccaagccggaggagacccccacccccagcaagtccgggaaggacgacctggccaccaacagcccccacccggccacgtcccgccccaccaccccccccaccacggcccagaagccgaccgagaacaacagccacaacaccaccgagcagctggagtccctcacgcacctggcgaccctgggcctcatgatcagccccacccagaccgtgctgccccagtccgtgaccagcatcgccatccaggacatccacaactccccgacgaaccggagcaagcgcaacctggacatggagatcatcctcaccctgtcccaggggctgaagaagtactacggcaagatcctcaagctgctgcacctcaccctggaggaggacaccgagggcctgctcgagtggtgcaagcggaacctggggctggactgcgacgacacgttcttccagaagcgcatcgaggagttcttcatcaccggcgaggggcacttcaacgaggtcctccagttccggaccctgggcaccctgagcacgaccgagtccacccacgccggcagccccaccgtggagcccttcaagagctacttcgccaaggggttcctctccatcgacagcggctacttctccgccaagtgctacagccgcacgtccaacagcgggctgcagctgatcaacgtgacccggcactccacccgcatcgcggacacccccggcccgaagatcacgaacctcaagaccatcaactgcatgaacctgaaggccagcgtcttcaaggagcaccgggaggtggagatcaacgtgctgctcccccaggtcgccgtgaacctgtccaactgccacgtggccatcaagagccacatctgcgactactccctggacaccgacggggccatccgcctcccccagatccaccacgagggcaccttcatccccggcacgtacaagatcgtcatcgacaagaagagccggctgaacgaccgctgcaccctgttcaccaactgcgtgatcaaggggcgggaggtgcgcaagggccagtccgtcctccggcagtacaagaccgagatccgcatcgggcgggcgagcacgggctcccgccggctgctgagcgaggagtccggggacgactgcatcagccgcacccagctcctgcgcaccgagaccgccgaggtgcacggcgacaactacggcgggccgggcgacaagatcacgatctgcaacgggagcaccgtcgtggaccagcggctgggctccgagctggggtgctacaccatcaaccgcgtgcggagcttcaagctctgcgagaactccgccaccggcaagagctgcgagatcgactccatccccgtcaagtgcaagcagggctactgcctgaagatcacgcaggaggggcgcggccacgtgaagctgagccgggggtccgaggtggtcctcgacgtgtgcgacagctcctgcgaggtgatgatccccaagggcaccggcgacatcctggtcgactgcagcgggggccagcagcacttcctgaaggacaacctcgtggacctggggtgccccaagatcccgctgctcggcaagatggccatctacatctgccgcatgtccaaccaccccaagaccaccatggccttcctgttctggttcagcttcgggtacgtgatcacgtgcatcctgtgcaaggcgatcttcttcctcctgatcatcttcggcaccctgggcaagcggttcaagcagtaccgcgagctcaagccccagacctgcaccatctgcgagaccacgcccgtcaacgccatcgacgccgagatgcacgacctgaactgctcctacaacatctgcccgtactgcgccagccggctgacctccgacgggctcgcccgccacgtgacccagtgcccccggcgcaaggagaaggtggaggagaccgagctgtacctgaacctcgagcggatcccctgggtcgtgcgcaagctgctgcaggtgagcgagtccacgggcaccgtcctcaagcggagctcctggctgatcgtgctgctcgtgctgttcaccgtcagcctgagccccgtgcagtccgcgccgatcgggcacggcaagaccatcgagacgtaccgcgtgcgggaggagtacaccagcatctgcctcttcgtcctggggtccatcctgttcatcgtgagcttcctcatgaagggcctggtggacggcgtcgggaacatcttcttccccggcctgtccgtgtgcaagacctgcagcatcgggtccatcaacggcttcgagatcgagagccacaagtgctactgctccctcttctgctgcccctactgccgccactgcagcgccgacggggagatccaccagctgcacctgtccatctgcaagaagcggaagaccggcagcaacgtgatgctcgccgtctgcaagcgcatgtgcttccgcgccacgatggaggtgtccaacaaggcgctgttcatccggagcatcatcaacaccaccttcgtgatgtgcatcctgaagggcgagttcgccgccgtcaagtccatccaccccatcgagatggagagcctcccggccgggacctgggagcgcgaggaggacctgacgaacttctgccaccaggagtgccaggtgaccgagaccgagtgcctgtgcccctacgaggccctcgtgctgcggcgccccctgttcctcgactccatcgtcaagggcatgaagaacctgctgaacagcacctccctcgagacgagcctgagcatcgaggcgccgtggggggccatcaacgtgcagtccacctacaagcccaccgtgagcaccgccaacatcgccctgtcctggagctccgtcgagcaccggggcaacaaggtgctcgtgagcgggcgctccgagagcatcatgaagctggaggagcggacgggcatctcctgggacctgggcgtcgaggacgccagcgagtccaagctcctgaccgtgagcgtgatggacctgtcccagatgtacagccccgtcttcgagtacctctccggggaccgccaggtggaggagtggcccaaggcgacctgcaccggcgactgcccggagcggtgcgggtgcacgagctccacctgcctgcacaaggagtggccccacagccgcaactggcggtgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgacctcccaggagcgccagtgcagcctgatcgaggccgggacgcggttcaacctcggcagcgtcaccatcaccctgtccgagccccgcaacatccagcagaagctgccgcccgagatcatcaccctccaccccaagatcgaggaggggttcttcgacctgatgcacgtgcagaaggtgctgagcgcctccaccgtctgcaagctccagagctgcacgcacggcgtgcccggcgacctgcaggtgtaccacatcgggaacctgctcaagggcgaccgggtcaacgggcacctgatccacaagatcgagcagcacttcaacacctcctggatgagctgggacggctgcgacctggactactactgcaacatgggggactggccgtcctgcacctacaccggcgtgacgcagcacaaccacgccagcttcgtgaacctcctgaacatcgagaccgactacaccaagaccttccacttccactccaagcgcgtcacggcgcacggcgacaccccccagctggacctcaaggcccggcccacctacggggccggcgagatcaccgtgctggtggaggtcgccgacatggagctgcacacgaagaagatcgagatcagcgggctcaagttcgcgggcctgacctgcaccgggtgctacgcctgctccagcggcatctcctgcaaggtgcgcatccacgtggacgagcccgacgagctgaccgtccacgtgaagagcgacgacccggacgtggtcgccgcctccagctccctcatggcccggaagctggagttcggcacggacagcaccttcaaggcgttctccgccatgcccaagaccagcctgtgcttctacatcgtggagcgcgagtactgcaagagctgcaacaaggaggacacccagaagtgcgtgaacacgaagctcgagcagccccagtccatcctgatcgagcacaaggggaccatcatcggcaagcagaacaacacctgcaccgccaaggccagctgctggctggagtccgtcaagagcttcttctacgggctcaagaacatgctgggcggcatcttcgggaacgtgttcatcggcatcttcacgttcctgacccccttcatcctgctcatcctgttcttcatgttcgggtggcggatcctgttctgcttcaagtgctgccgccgcacccggggcctcttcaagtaccgccacctgaaggacgacgaggagaccgggtaccggaagatcatcgagcgcctgaacaacaagaagggcaagaaccggctcctggacggcgagcgcctggccgaccggaagatcgcggagctcttctccacgaagacccacatcgggtga

SEQ ID NO: 11989 - RNA, 5055 nt, synthetic construct
  misc_feature 1..5055: note = derived and/or modified CDS sequence (opt1) from CCHFV(SPU 187/90)__KJ682814.1__GP
  source 1..5055: mol_type = other RNA
atgcacatcagcctcatgtacgccgtgctctgcctgcagctgtgctccctcggcgagacccaccgcagccacaacgagatcgggcacaacaagaccgacgtcatgacgacccccggcgacaacctgtccagcgagcagccggtgtccaccgccctgagcatcacccccgacccctccacggtgacccccaccaccccggcgagcgggtccgagggcagcggggaggtctacacgtccagccccatcaccaccgagtccctcagcctgcccgagaccacgcccgagctgccggccaccaccggcatcgactccagctccgccagcggcgtggactccagcacccaggccgccgggggcacgagcgcgctcaccgtgcggacctccctgcccaacagcccctccacccccagcacgccgcaggacacctaccaccccgtccgcatcctgctctccgtgaccgggcccggccccgaggagaccagcacgccgtccgggagcggcaaggagtccagcgccacctccagcctgcaccccatctccgaccggctgcccacgcccccggccaccgcccagggccccaccgagaacaacagccacaacgcgaccgagcaccccaagcccctcacccagtccgccaccccggggctgatgacgagccccacccagatcgtgcacccccagtccgccaccagcatcaccgtccaggacacgtacccctccccgaagaaccgcagcaagcggaacctggagatggagatcatcctcaccctgagccagggcctgaagaagtactacgggaagatcctccgcctgctgcggctcaccctggaggaggacaccgagggcctgctcgagtggtgcaagcgcaacctgggcctggactgcgacgacaccttcttccagaagcggatcgaggagttcttcatcacgggggagggccacttcaacgaggtgctccagttcaagacccccgggaccctgtccaccacggagagcacccccgccgagctgccgaccgccgagcccttcaagtcctacttcgcgaagggcttcctcagcatcgactccgggtactacagcgccaagtgctactccggcaccagcaactccggcctgcagctgatcaacatcacgcgccacagcacccggatcgtggacacccccgggcccaagatcaccaacctcaagacgatcaactgcatcaacctgaaggcctccatcttcaaggagcaccgcgaggtcgagatcaacgtgctgctcccgcagatcgccgtgaacctgagcaactgccacgtcgtgatcaagtcccacgtgtgcgactacagcctggacatcgacggcaccgtccggctcccccacatctaccacgagggggtgttcatccccggcacctacaagatcgtgatcgacaagaagaacaagctgaacgaccgctgcaccctgttcacgaactgcgtcatcaaggggcgggaggtgcgcaagggccagtccgtgctccggcagtacaagaccgagatccgcatcggcaaggccagcaccgggtcccggcgcctgctgagcgaggagcccagcgacgactgcatctcccggacccagctcctgcgcacggagaccgcggagatccacggcgacaactacgggggcccgggggacaagatcaccatctgcaacggcagcaccatcgtcgaccagcgcctgggctccgagctggggtgctacacgatcaaccgggtcaagagcttcaagctctgcgagaactccgccaccggcaagagctgcgagatcgactccgtgcccgtgaagtgccgccaggggtactgcctgcggatcacccaggagggccgcggccacgtgaagctgagccgggggtccgaggtcgtgctcgacgcctgcgacaccagctgcgagatcatgatccccaagggcacgggggacatcctggtggactgctccggcgggcagcagcacttcctgaaggacaacctcatcgacctgggctgccccaagatcccgctgctcggcaagatggccatctacatctgccgcatgagcaaccaccccaagaccaccatggccttcctgttctggttctccttcgggtacgtcatcacgtgcatcctgtgcaaggcgatcttctacctcctgatcatcatcggcaccctggggaagcggttcaagcagtaccgcgagctcaagccccagacctgcaccatctgcgagaccacgcccgtgaacgccatcgacgccgagatgcacgacctgaactgcagctacaacatctgcccgtactgcgcctcccggctgaccagcgacggcctcgcccgccacgtgacccagtgccccaagcggaaggagaaggtcgaggagaccgagctgtacctgaacctcgagcgcatcccctgggtggtgcggaagctgctgcaggtctccgagagcaccggggtggcgctcaagcgctccagctggctgatcgtgctgctcgtcctgttcacggtgagcctgtcccccgtgcagagcgccccgatcggccacggcaagaccatcgaggcctaccgggcccgcgaggggtacacctccatctgcctcttcgtcctgggcagcatcctgttcgtggtgtcctgcctcatgaaggggctggtcgacagcgtgggcaactccttcttccccgggctgagcatctgcaagacctgctccatcggcagcatcaacggcttcgagatcgagtcccacaagtgctactgcagcctcttctgctgcccctactgccggcactgctccgcggacaaggagatccacaagctgcacctgagcatctgcaagaagcgcaagacggggtccaacgtgatgctcgccgtctgcaagcggatgtgcttccgcgccaccatggaggtgagcaaccgcgccctgttcatccggtccatcatcaacaccaccttcgtgctgtgcatcctcatcctggccgtctgcgtggtgagcacgtccgcggtcgagatggagaacctgcccgccggcacctgggagcgcgaggaggacctcaccaacttctgccaccaggagtgccaggtgaccgagacggagtgcctgtgcccgtacgaggccctggtgctccggcgccccctgttcctggacagcatcgtcaaggggatgaagaacctcctgaacagcacctccctggagaccagcctctccatcgaggccccctggggcgccatcaacgtgcagagcacctacaagccgacggtgtccaccgcgaacatcgccctgagctggtccagcgtcgagcaccgggggaacaagatcctggtgtccggccgcagcgagtccatcatgaagctcgaggagcggaccggcatcagctgggacctgggggtggaggacgcctccgagagcaagctgctcaccgtctccgtgatggacctgagccagatgtactcccccgtgttcgagtacctgagcggcgaccgccaggtcgaggagtggcccaaggccacgtgcaccggggactgccccgagcggtgcggctgcacctccagcacgtgcctccacaaggagtggccgcacagccgcaactggcggtgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccaggagcgccagtgcagcctgatcgaggcgggcacccggttcaacctggggcccgtgaccatcacgctctccgagccccgcaacatccagcagaagctgccgcccgagatcatcaccctgcacccccggatcgaggagggcttcttcgacctcatgcacgtgcagaaggtcctgagcgcctccaccgtgtgcaagctgcagagctgcacccacggcgtccccggggacctccaggtgtaccacatcggcaacctgctgaagggggacaaggtgaacggccacctcatccacaagatcgagccgcacttcaacacgtcctggatgagctgggacgggtgcgacctggactactactgcaacatgggcgactggccctcctgcacctacaccggcgtcacccagcacaaccacgccagcttcgtgaacctgctcaacatcgagaccgactacacgaagaacttccacttccactccaagcgcgtgaccgcccacggggacacgccccagctggacctgaaggcgcggcccacctacggcgccggggagatcaccgtcctcgtggaggtggccgacatggagctgcacaccaagaagatcgagatcagcggcctgaagttcgcctccctgacctgcaccgggtgctacgcctgcagctccggcatcagctgcaaggtccgcatccacgtggacgagccggacgagctcacggtgcacgtcaagtccgacgaccccgacgtggtggcggccagctccagcctgatggcccggaagctcgagttcggcaccgacagcatcttcaaggccttctccgccatgcccaagaccagcctgtgcttctacatcgtcgagcgcgagcactgcaagtcctgcagcgaggaggacaccaagaagtgcgtgaacacgaagctggagcagccccagtccatcctcatcgagcacaaggggaccatcatcggcaagcagaacagcacgtgcaccgcgaagacctcctgctggctggagagcgtgaagtccttcttctacgggctgaagaacatgctgagcggcatcttcggcaacgtcttcatcgggatcttcctcttcctggccccgttcatcctgctcatcctgttcttcatgttcggctggcggatcctgttctgcttcaagtgctgccgccgcacccggggcctcttcaagtaccgccacctgaaggacgacgaggagaccgggtaccggcgcatcatcgagcggctgaacaacaagaaggggaagaacaagctcctggacggcgagcgcctggccgaccggcgcatcgccgagctgttctccaccaagacgcacatcggctga

SEQ ID NO: 11990 - RNA, 5055 nt, synthetic construct
  misc_feature 1..5055: note = derived and/or modified CDS sequence (opt1) from CCHFV(SPU 48/90)__KJ682813.1__GP
  source 1..5055: mol_type = other RNA
atgcacatcagcctgatgtacgccgtgctctgcctgcagctgtgcggcctcggggagacccaccgctcccacaacgagaccggccacaacaagacggacgtcgccaccacccccggggacaacctgagctccgagcagctggtgagcaccgcgctctccatcacgccggaccccagcaccgtgacccccaccacgtccgccagcggcctggaggggtccggcgaggtctacaccagctccctgatcaccaccgagagcctctccctgctggagacgacccccaagctcccgaccaccacgggcatcgacaccagctccgccagcgacgtggactccagcacccaggccgccggggacacctccgcgctgacggtgcggaccagcccgcccagcaacccctccacccccagcacgccccaggacacccaccaccccatgcgcaacctgctctccgtcaccagccccggcccggaggagacctccacccccagcgggtccggcaaggagagccccgccacgtccagcccccacccggtgtccaaccggagccagaccccgcccgccaccgcccaggggcccaccgaggacaactcctacaacgcgacggagcaccccgagcacctgacccagagcgccacctccggcctgatgaccagccccacgcagatcgtgcacccccagtccgccaccagcatcaccgtccaggacacctacccctccccgaccaaccgcagcaagcggaacctcgagatggagatcatcctgacgctgagccagggcctcaagaagtactacgggaagatcctgcgcctgctccggctgaccctggaggaggacaccgagggcctcctggagtggtgcaagcgcaacctggggctcgactgcgacgacaccttcttccagaagcggatcgaggagttcttcatcacgggcgagggccacttcaacgaggtgctgcagttcaagacccccgggaccctgtccaccacggagagcacccccgccgagcccccgaccgccgagcccttcaagtcctacttcgcgaagggcttcctcagcatcgactccgggtactacagcgccaagtgctactccggcaccagcaactccgggctgcagctgatcaacatcacgcgccacagcaccaagatcgccgacacccccggcccgaagatcaccaacctcaagacgatcaactgcatcaacctgaaggcctccatcttcaaggagcaccgggaggtggagatcaacgtcctgctcccccaggtggccgtgaacctgagcaactgccacgtcgtgatcaagtcccacgtgtgcgactaccccctggacatcgacggcaccgtccgcctcccccacatctaccacgagggggtgttcatcccgggcacctacaagatcgtgatcgacaagaagaccaagctgaacgaccggtgcacgctgttcaccgactgcgtcatcaaggggcgcgaggtgcggaagggccagagcgtgctccgccagtacaagaccgagatccggatcgggaagacctccacgggcagccgccggctgctgtccgaggagcccagcgacgactgcatcagccgcacccagctcctgcggaccgagaccgcggagatccacggcgacaactacgggggccccggggacaagatcacgatctgcaacggctccaccatcgtcgaccagcgcctggggagcgagctgggctgctacaccatcaaccgcgtgaagtccttcaagctctgcgagaacagcgccaccggcaagtcctgcgtcatcgacagcgtgcccgtgaagtgccggcaggggtactgcctgcgcatcacgcaggagggccgggggcacgtcaagctgtcccgcggcagcgaggtggtgctcgacgcctgcgacacctcctgcgagatcatgatcccgaagggcaccggggacatcctggtcgactgcagcggcgggcagcagcacttcctgaaggacaacctcatcgacctgggctgccccaagatccccctgctcgggaagatggccatctacatctgccggatgtccaaccaccccaccacgaccatggccttcctgttctggttcagcttcggctacgtgatcacgtgcatcctgtgcaaggcgatcttctacctcctgatcatcatcggcaccctggggaagcgcttccggcagtaccgcgagctcaagccgcagacctgcaccatctgcgagaccacccccgtgaacgccatcgacgccgagatgcacgacctgaactgctcctacaacatctgcccctactgcgccagccggctgacctccgacggcctcgcccgccacgtcacgcagtgccccaagcggaaggagaaggtggaggagaccgagctgtacctgaacctcgagcgcatcccgtgggtggtccggaagctgctccaggtgagcgagtccaccggggtggcgctcaagcgcagctcctggctgatcgtcctgctcgtgctgttcaccgtgagcctgagccccgtccagtccgcccccatcggccacgggaagacgatcgaggcctaccgggcccgcgagggctacaccagcatctgcctcttcgtgctgggctccatcctgttcgtggtcagctgcctcatgaagcggctggtggactccgtggggaacagcttcttccccggcctgtccatctgcaagacctgcagcatctccagcatcaacgggttcgagatcgagtcccacaagtgctactgcagcctcttctgctgcccgtactgccgccactgctccgcggacaaggagatccacaagctgcacctgagcatctgcaagaagcggaagaccggctccaacgtcatgctcgccgtgtgcaagcgcatgtgcttccgcgccacgatggaggtgagcgaccgggccctgttcatccgctccatcatcaacaccaccttcgtcctgtgcatcctcatcctggccgtgtgcgtggtcagcacctccgcggtggagatggagaacctgcccgccgggacgtgggagcgggaggaggacctcaccaacttctgccaccaggagtgccaggtgaccgagaccgagtgcctgtgcccctacgaggccctggtcctccgcaagcccctgttccgggacagcatcgtgaagggcatgaagaacctgctcaacagcacgtccctggagaccagcctgtccatcgaggccccgtggggcgccatcaacgtgcagagcacctacaagcccaccgtctccacggcgaacatcgccctcagctggtccagcgtggagcaccgcgggaacaagatcctggtgtccggccggagcgagtccatcatgaagctggaggagcgcaccgggatcagctgggacctcggcgtcgaggacgcctccgagagcaagctgctgaccgtgtccgtgatggacctcagccagatgtactcccccgtcttcgagtacctgagcggggaccgccaggtggaggagtggccgaaggcgacctgcacgggcgactgccccgagcggtgcggctgcacctccagcacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggagtacatcaagaccgaggccatcgtctgcgtggagctgacctcccaggagcggcagtgcagcctcatcgaggccggcacccgcttcaacctggggccggtgaccatcaccctgtccgagccccggaacatccagcagaagctcccgcccgagatcatcaccctgcacccccgcatcgaggagggcttcttcgacctgatgcacgtccagaaggtgctcagcgcctccacggtctgcaagctgcagagctgcacccacggggtgcccggcgacctccaggtgtaccacatcgggaacctgctgaagggcgacaaggtcaacggccacctgatccacaagatcgagccccacttcaacacctcctggatgagctgggacgggtgcgacctcgactactactgcaacatgggcgactggccctcctgcacctacacgggggtgacccagcacaaccgggccagcttcgtgaacctgctgaacatcgagaccgactacaccaagaacttccacttccactccaagcgcgtcacggcccacggcgacaccccgcagctcgacctgaaggcgcggcccacctacggggccggcgagatcaccgtgctggtggaggtcgccgacatggagctccacacgaagaagatcgagatcagcggcctgaagttcgcctccctgacctgcaccgggtgctacgcctgcagctccggcatcagctgcaaggtgcgcatccacgtggacgagcccgacgagctcaccgtccacgtgaagtccgacgaccccgacgtggtcgcggccagctccagcctgatggcccggaagctggagttcgggacggacagcaccttcaaggccttctccgccatgccgaagaccagcctctgcttctacatcgtggagaaggagtactgcaagtcctgcagcgaggaggacaccaagaagtgcgtgaacacgaagctggagcagccccagtccatcctgatcgagcacaagggcaccatcatcgggaagcagaactccacgtgcaccgcgaaggtcagctgctggctcgagagcgccaagtccttcttctacggcctgaaggacatgctgagcggcatcttcgggaacgtgttcatcggcatcttcctgttcctcgcccccttcatcctgctgatcctcttcttcatgttcgggtggcgcatcctgctgtgcttcaagtgctgccgccggacccgcggcctcttcaagtaccggcacctgaaggacgacgaggagaccggctaccgccggatcatcgagcgcctgaacaacaagaaggggaagaacaagctcctggacggcgagcggctggccgaccgccggatcgccgagctgttctccaccaagacccacatcgggtga

SEQ ID NO: 11991 - RNA, 5055 nt, synthetic construct
  misc_feature 1..5055: note = derived and/or modified CDS sequence (opt1) from CCHFV(Sudan AB1-2009)__HQ378187.1__GP
  source 1..5055: mol_type = other RNA
atgcacatcagcctcatctacgccatcctctgcctgcagctgtgcggcctcggggagacccacggctcccacaacgagacccgccacaacaagacggacaccatcaccacccccggggacaacctgagctccgagccgagcgtgtccacggccctgagcatcacccccgacccctccaccgtcacccccacgaccccggcgagcggcctcgaggggtccggcgaggtgtacaccagcccgcccatcaccacgggctccctgcccctgcccgggaccacccccgagctccccgccaccacgggcaccgacaccagctccgccagcgacgtggactccagcacccagacggccgggggcaccttcaccctgaccgtccggacgtccctgccccgcagcccgtccacccccagcacgccccaggacacccaccaccccgtgcggaacctcctgagcgtgacctccccggggcccgacgagaccagcaccccctccggcaccggcaaggagagccccgccacgtccagcccgcaccccgtctccaaccgcccgcccaccccgcccgcgaccgcccaggggcccaccgagaacgacagccacaacgccacggagcaccccgagtccctgacccagagcgccaccaccggccccatgacctcccccacgcagatcgtgcacccccagagcgcgaccccgatcaccgtgcaggacacccacccctcccccacgaaccggagcaagcgcaacctcgagatggagatcatcctgaccctgtcccaggggctcaagaagtactacggcaagatcctgcggctgctccacctgaccctggaggaggacaccgagggcctcctggagtggtgcaagcgcaacctggggctcgactgcgacgacacgttcttccagaagcggatcgaggagttcttcatcaccggcgaggggcacttcaacgaggtcctgcagttccgcacccccggcaccctgagcacgaccgagtccaccccggccgggctccccaccgccgagcccttcaagagctacttcgccaagggcttcctgtccatcgacagcggctactacagcgccaagtgctactccgggacgagcaactccggcctgcagctcatcaacatcacccggcacagcacccgcatcgtggacacccccgggccgaagatcacgaacctgaagaccatcaactgcatcaacctgaaggcgtccatcttcaaggagcaccgggaggtggagatcaacgtcctcctgccccaggtggccgtgaacctgagcaactgccacgtcgtgatcaagtcccacgtgtgcgactacagcctcgacatcgacggcgccgtccgcctgccccacatctaccacgagggggtgttcatccccggcacctacaagatcgtgatcgacaagaagaacaagctgaacgaccggtgcaccctcttcacgaactgcgtcatcaagggccgcgaggtgcggaaggggcagtccgtgctgcgccagtacaagaccgaggtccggatcggcaaggccagcaccgggtcccgccggctgctcagcgaggagccgtccgacgactgcatcagccgcacccagctgctgcgcacggagaccgccgagatccacggcgacaactacgggggccccggcgacaagatcaccatctgcaacgggtccaccatcgtggaccagcggctcggcagcgagctggggtgctacacgatcaaccgcgtcaagtccttcaagctgtgcgagaacagcgcgaccggcaagaactgcgagatcgacagcgtgcccgtgaagtgccggcagggctactgcctgcgcatcacccaggaggggcggggccacgtcaagctctcccgcgggagcgaggtggtgctggacgcctgcgacacctcctgcgagatcatgatccccaagggcacgggggacatcctggtcgactgcagcggcggccagcagcacttcctcaaggacaacctgatcgacctggggtgcccgaagatccccctcctgggcaagatggccatctacatctgccggatgtccaaccaccccaagaccaccatggccttcctgttctggttcagcttcgggtacctcatcacgtgcatcctgtgcaaggccatcttctacctgctcatcatcatcggcaccctggggaagcgcctgaagcagtaccgggagctcaagccccagacctgcaccatctgcgagaccaccccggtgaacgcgatcgacgccgagatgcacgacctgaactgctcctacaacatctgcccctactgcgccagccgcctgacgtccgacggcctcgcccggcacgtgatccagtgccccaagcgcaaggagaaggtcgaggagaccgagctgtacctgaacctcgagcggatcccctgggtggtgcgcaagctgctgcaggtcagcgagtccaccggcgtggccctcaagcggagctcctggctgatcgtgctgctcgtcctgttcaccgtgagcctgtccccggtgcagagcgcgcccatcgggcagggcaagacgatcgaggcctaccgcgcccgggaggggtacacctccatctgcctcttcgtcctgggcagcatcctgttcatcgtgtcctgcctcatgaaggggctggtggacagcgtcggcaacagcttcttccccggcctgtccatctgcaagacctgcagcatctccagcatcaacgggttcgagatcgagtcccacaagtgctactgcagcctcttctgctgcccgtactgccgccactgctccaccgacaaggagatccacaagctgcacctgagcatctgcaagaagcggaagacgggctccaacgtgatgctcgccgtgtgcaagcgcatgtgcttccgcgcgaccatggaggtcagcaaccgggccctgttcatccgctccatcatcaacaccaccttcgtgctgtgcatcctcatcctggccgtgtgcgtcgtgagcacgtccgccgtggagatggagaacctgcccgccgggacctgggagcgggaggaggacctcaccaacttctgccaccaggagtgccaggtcaccgagacggagtgcctgtgcccctacgaggcgctggtgctccgcaagcccctgttcctggacagcatcgccaagggcatgaagaacctcctgaactccaccagcctggagacctccctcagcatcgaggccccgtggggcgccatcaacgtgcagtccacctacaagcccacggtcagcaccgccaacatcgcgctgagctggtccagcgtggagcaccgggggaacaagatcctggtgtccggccgcagcgagtccatcatgaagctcgaggagcggaccgggatcagctgggacctgggcgtcgaggacgcctccgagagcaagctgctcaccgtgtccgtgatggacctgagccagatgtactcccccgtcttcgagtacctgagcggggaccgccaggtggaggagtggcccaaggccacgtgcaccggcgactgcccggagcggtgcggctgcacctccagcacgtgcctccacaaggagtggccccactcccgcaactggcggtgcaaccccacctggtgctggggcgtggggaccgggtgcacgtgctgcggcctggacgtcaaggacctgttcaccgactacatgttcgtgaagtggaaggtggagtacatcaagaccgaggccatcgtctgcgtggagctcaccagccaggagcgccagtgctccctgatcgaggccgggacccggttcaacctgggccccgtgaccatcaccctcagcgagccgcgcaacatccagcagaagctgccgcccgagatcatcacgctgcacccccggatcgaggagggcttcttcgacctcatgcacgtccagaaggtgctgtccgcgagcaccgtgtgcaagctgcagagctgcacccacggggtccccggcgacctccaggtgtaccacatcgggaacctgctgaagggcgacaaggtcaacgggcacctcatccacaagatcgagccccacttcaacacctcctggatgagctgggacggctgcgacctggactactactgcaacatgggcgactggccctcctgcacgtacaccggggtgacccagcacaaccacgccagcttcgtgaacctgctcaacatcgagaccgactacacgaagaacttccacttccactccaagcgcgtcaccgcccacggcgacacgccccagctggacctgaaggcccggccgacctacggggcgggcgagatcaccgtgctcgtggaggtcgccgacatggagctgcacaccaagaagatcgagatcagcgggctgaagttcgcctccctgacctgcaccggctgctacgcctgcagctccggcatcagctgcaaggtgcgcatccacgtggacgagcccgacgagctcacggtccacgtgaagtccgacgaccccgacgtggtcgccgcgagctccagcctgatggcccggaagctcgagttcgggaccgactccaccttcaaggccttcagcgccatgcccaagacctccctgtgcttctacatcgtggagcgcgagcactgcaagagctgcaacgaggaggacacgaagaagtgcgtgaacaccaagctggagcagccgcagtccatcctcatcgagcacaagggcaccatcatcgggaagcagaacagcacgtgcaccgcccgggcgagctgctggctggagtccgtcaagagcttcttctacggcctgaagaacatgctgtccggcatcttcgggaacgtgttcatgggcatcttcctcttcctggcccccttcatcctgctcatcctgttcttcatgttcgggtggcgcatcctgttctgcttcaagtgctgccgccggacccgcggcctcttcaagtaccggcacctgaaggacgacgaggagaccgggtaccgccggatcatcgagcgcctgaacaacaagaagggcaagaacaagctcctggacggcgagcggctggccgaccgccggatcgccgagctgttcagcaccaagacgcacatcgggtga

SEQ ID NO: 11992 - RNA, 5055 nt, synthetic construct
  misc_feature 1..5055: note = derived and/or modified CDS sequence (opt1) from CCHFV(Sudan Al-Fulah 9-2008)__HQ378185.1__GP
  source 1..5055: mol_type = other RNA
atgcacatcagcctgatgtacgccgtgctctgcctgcagctgtgcggcctcggggagacccaccgctcccacaacgagaccgtccacaacaagacggacatcgtgaccacccccagcgacgacctgtccagcgagcagctggtgtccaccgccctcagcatcacgccggacccctccaccgtcacccccaccacgagcgcgtccggcctggaggggagcggcgaggtgtacacctccagccccatcaccaccgagtccctgagccagccggagacgacccccaagctccccgccaccaccgggatcgacacgtccagcgcctccgacgtggacagctccacccaggccgccggcgacaccagcaccctgacggtccggaccagccccccgaactcccccagcaccccctccaccccccaggacacgcaccacccgatgcgcaacctgctcagcgtgacctcccccggccccgaggagaccagcaccccctccgggagcggcaaggagtccagcgcgacgtccagcccgcaccccgtgtccaaccggccccagacccccccggccaccgcccaggggcccaccgaggacaacagccacaacgccacggagcaccccgagcacctgacccagtccgcgaccagcggccccatgacctccccgacgcagatcgtccacccccagagcgccaccaccatcaccgtgcaggacacctacccctcccccacgaaccgcagcaagcggaacctggagatggagatcatcctcaccctgagccaggggctgaagaagtactacggcaagatcctccgcctgctgcggctcaccctggaggaggacaccgagggcctgctcgagtggtgcaagcgcaacctggggctggactgcgacgacacgttcttccagaagcggatcgaggagttcttcatcaccggcgaggggcacttcaacgacgtgctccagttcaagaccccgggcaccctgtccacgaccgagagcacccccgccaagcccccgaccgccgagcccttcaagtcctacttcgccaagggcttcctgacgatcgacagcgggtactactccgcgaagtgctacagcggcacctccaacagcgggctccagctgatcaacatcacccgccactccacccggatcgtcgacacgcccggccccaagatcaccaacctgaagaccatcaactgcatcaacctcaaggccagcatcttcaaggagcaccgcgaggtggagatcaacgtgctgctgccgcaggtcgccgtgaacctctccaactgccacgtggtcatcaagagccacgtgtgcgactaccccctggacatcgacgggaccgtgcggctgccccacatctaccacgagggcgtcttcatccccggcacgtacaagatcgtgatcgacaagaagaacaagctcaacgaccgctgcaccctgttcaccgactgcgtgatcaaggggcgggaggtccgcaagggccagtccgtgctgcggcagtacaagaccgagatccgcatcgggaaggccagcacgggctcccggcgcctcctgagcgaggagccgtccgacgactgcatcagccggacccagctgctccgcaccgagaccgccgagatccacggggacaactacggcggccccggggacaagatcacgatctgcaacggcagcaccatcgtcgaccagcgcctggggtccgagctgggctgctacaccatcaaccgggtgaagagcttcaagctctgcgagaactccgcgaccgggaagagctgcgtgatcgactccgtccccgtgaagtgccgccagggctactgcctgcggatcacgcaggagggccgcgggcacgtgaagctgagccggggctccgaggtcgtgctggacgcctgcgacaccagctgcgagatcatgatccccaaggggaccggcgacatcctcgtggactgctccggcgggcagcagcacttcctgaaggacaacctggtcgacctcggctgcccgaagatccccctgctggggaagatggccatctacatctgccgcatgagcaaccaccccaagaccacgatggccttcctcttctggttctccttcggctacgtgatcacctgcatcctgtgcaaggccatcttctacctgctcatcatcatcgggaccctgggcaagcggttccgccagtaccgggagctgaagccccagacctgcaccatctgcgagacgaccccggtgaacgcgatcgacgccgagatgcacgacctcaactgcagctacaacatctgcccctactgcgcctcccgcctgaccagcgacggcctggcccggcacgtcacccagtgccccaagcgcaaggagaaggtggaggagacggagctctacctgaacctggagcggatcccctgggtggtccgcaagctcctgcaggtgtccgagagcaccggggtggccctgaagcggtccagctggctcatcgtcctgctggtgctcttcaccgtgtccctgagcccggtccagagcgcgcccatcggccacgggaagaccatcgaggcctaccgcgcccgggagggctacacgtccatctgcctgttcgtgctcgggagcatcctgttcatcgtgtcctgcctgatgaagggcctcgtcgacagcgtgggcaactccttcttccccgggctgagcatctgcaagacctgctccatcagctccatcaacggcttcgagatcgagagccacaagtgctactgctccctgttctgctgcccctactgccgccactgcagcgccgacaaggagatccacaagctccacctgtccatctgcaagaagcggaagaccgggagcaacgtgatgctggcggtctgcaagcgcatgtgcttccgcgccaccatggaggtgtccaaccgggccctcttcatccgcagcatcatcaacacgaccttcgtgctgtgcatcctgatcctcgccgtctgcgtggtgtccaccagcgccgtcgagatggagaacctgccggcgggcacctgggagcgggaggaggacctgacgaacttctgccaccaggagtgccaggtgaccgagaccgagtgcctctgcccctacgaggccctggtgctgcgccggcccctcttcctggactccatcgtcaaggggatgaagaacctgctcaacagcaccagcctggagacgtccctgagcatcgaggccccgtggggcgccatcaacgtgcagtccacctacaagcccaccgtgagcaccgccaacatcgcgctctcctggagctccgtcgagcaccgcggcaacaagatcctggtgagcgggcggtccgagagcatcatgaagctggaggagcgcacgggcatctcctgggacctcggggtggaggacgccagcgagtccaagctgctgaccgtcagcgtgatggacctctcccagatgtacagccccgtgttcgagtacctgtccggcgaccggcaggtcgaggagtggcccaaggccacctgcaccggggactgcccggagcgctgcggctgcacgagctccacctgcctgcacaaggagtggccccacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaccagccaggagcggcagtgctccctcatcgaggccggcacgcgcttcaacctgggccccgtgaccatcaccctgagcgagccgcggaacatccagcagaagctcccccccgagatcatcaccctgcacccccgcatcgaggaggggttcttcgacctgatgcacgtccagaaggtgctctccgcgagcaccgtgtgcaagctgcagtcctgcacgcacggcgtcccgggggacctgcaggtgtaccacatcggcaacctcctgaagggggacaaggtgaacggccacctgatccacaagatcgagccccacttcaacaccagctggatgtcctgggacggctgcgacctcgactactactgcaacatgggggactggcccagctgcacctacaccggcgtcacgcagcacaaccacgcctccttcgtgaacctgctgaacatcgagaccgactacaccaagaacttccacttccacagcaagcgggtgaccgcccacggggacacgccccagctcgacctgaaggcccgcccgacctacggcgcgggggagatcaccgtcctggtggaggtggccgacatggagctccacaccaagaagatcgagatctccggcctgaagttcgccagcctgacgtgcaccggctgctacgcctgctccagcgggatctcctgcaaggtccggatccacgtggacgagcccgacgagctcaccgtgcacgtcaagagcgacgaccccgacgtggtggccgcgtccagctccctgatggcccgcaagctggagttcggcaccgacagcacgttcaaggccttcagcgccatgcccaagacctccctctgcttctacatcgtcgagaaggagtactgcaagagctgctccgaggaggacaccaagaagtgcgtgaacaccaagctggagcagccgcagagcatcctgatcgagcacaaggggacgatcatcggcaagcagaactccacctgcaccgccaaggtgagctgctggctcgagtccgcgaagagcttcttctacgggctgaaggacatgctgtccggcatcttcggcaacgtcttcatcgggatcttcctcttcctggcccccttcgtgctgctggtgctcttcttcatgttcggctggcggatcctgctgtgcttccgctgctgccgccggacccgcgggctcttcaagtaccggcacctgaaggacgacgaggagacgggctaccgccggatcatcgagcgcctgaacaacaagaagggcaagaacaagctcctggacggggagcggctggccgaccgcaagatcgccgagctcttcagcaccaagacccacatcggctga

SEQ ID NO: 11993 - RNA, 5055 nt, synthetic construct
  misc_feature 1..5055: note = derived and/or modified CDS sequence (opt1) from CCHFV(SPU4/81)__DQ157175.1__GP
  source 1..5055: mol_type = other RNA
atgcacatcagcctgatgtacgccgtgctctgcctgcagctgtgcggcctcggggagacccacggctcctacaacgagaccgggcacaacaagacggacgtcatgaccacccccggcgacaacctgagctccgagcagccggtgagcaccgccctgtccatcacgcccgaccccagcaccgtgacccccaccacgccggcgaacgggctcgagggctccggcgaggtctacaccagctcccccatcaccaccgagagcctgtccctgcccgagacgacccccgagctcccggccaccgccgggatcgacaccagctccgccagcgacgtggactccagcacgcaggccgcgggcgggacctccgcccccaccgtgcgcaccagcctgcccaactcccccagcacgccgagcacgccccaggagacccaccaccccgtccggaacctgctctccgtgaccagcctgggccccgaggagacctccaccccgagcgggcccggcaaggagtccagcgccacctccagcccccaccccgtgtccaacaagccgcccaccccgcccgcccgcgcgcagggccccacggagaacaacagccacaacgccaccgagcaccccgagcccctgacccagtccgccacccccgggctcatgacgagcccgacccaggtcgtgcacccccagtccgccaccagcatcaccgtgcaggacacgtacccctccccgaccaaccggagcaagcgcaacctggagaccgagatcatcctgaccctctcccagggcctgaagaagtactacgggaagatcctgcggctcctgcgcctgaccctcgaggaggacacggagggcctgctggagtggtgcaagcggaacctcggcctggactgcgacgacaccttcttccagaagcgcatcgaggagttcttcatcaccggggagggccacttcaacgaggtcctgcagttcaagacccccgggacgctcagcaccaccgagtccacccccgccgagctgcccacggcggagccgttcaagagctacttcgccaagggcttcctgagcatcgactccgggtactacagcgccaagtgctactccggcaccagcaactccggcctccagctgatcaacatcacccggcacagcacccgcatcgtggacacgcccgggcccaagatcaccaacctgaagaccatcaactgcatcaacctcaaggcctccatcttcaaggagcaccgggaggtggagatcaacgtcctgctgccccaggccgcggtgaacctcagcaactgccacgtggtcatcaagtcccacgtgtgcgactacagcctggacatcgacggcaccgtgcgcctgccgcacatctaccacgagggggtcttcatccccggcacgtacaagatcgtgatcgacaagaaggacaagctcaacgaccggtgcaccctgttcaccgactgcgtgatcaaggggcgcgaggtccggaagggccagtccgtgctgcgccagtacaagaccgagatccggatcggcaaggccagcatcgggtcccgccggctcctgagcgaggagccctccgacgactgcatcagccgcacgcagctgctccggaccgagaccgccgagatccacggcgacaactacgggggccccggggacaagatcaccatctgcaacggctccacgatcgtcgaccagcgcctgggcagcgagctggggtgctacaccatcaaccgcgtcaagagcttcaagctgtgcgagaactccgccaccggcaagagctgcgagatcgagtccgtgccggtgaagtgccggcaggggtactgcctccgcatcacccaggagggccggggccacgtgaagctgagccgcgggtccgaggtggtcctggacgcctgcgacacgagctgcgagatcatgatccccaagggcaccggggacatcctcgtggactgctccggcgggcagcagcacttcctgaaggacaacctgatcgacctcggctgccccaagatccccctgctgggcaagatggcgatctacatctgccggatgagcaaccacccgaagaccaccatggccttcctcttctggttctccttcgggtacgtgatcacgtgcatcctgtgcaaggccatcttctacctgctcatcatcatcggcaccctggggaagcgcttcaagcagtaccgggagctgaagccccagacctgcaccatctgcgagacgacccccgtcaacgccatcgacgccgagatgcacgacctcaactgcagctacaacatctgcccctactgcgcgtcccgcctgaccagcgacggcctggcccggcacgtgacccagtgcccgaagcgcaaggagaaggtggaggagaccgagctctacctgaacctggagcggatcccctgggtcgtgcgcaagctcctccaggtgtccgagagcacgggggtcgccctgaagcggtccagctggctcatcgtgctgctggtcctcttcaccgtgtccctgagccccgtgcagtccgcccccatcggccacggcaagaccatcgaggcgtaccgcgcccgggaggggtacaccagcatctgcctgttcgtgctcggcagcatcctgttcatcgtctcctgcctgatgaaggggctcgtggacagcgtgggcaactccttcttcccggggctgagcatctgcaagacgtgctccatcagctccatcaacggcttcgagatcgagagccacaagtgctactgctccctgttctgctgcccctactgccgccactgcagcgccgacaaggagatccacaagctccacctgtccatctgcaagaagcggaagaccggcagcaacgtcatgctggccgtgtgcaagcgcatgtgcttccgggccaccatggaggtgtccaaccgcgccctcttcatccgcagcatcatcaacaccacgttcgtcctgtgcatcctgatcctcgcggtgtgcgtggtctccaccagcgccgtggagatggagaacctgcccgccgggacctgggagcgggaggaggacctgaccaacttctgccaccaggagtgccaggtgacggagaccgagtgcctctgcccgtacgaggccctggtcctgcgcaagcccctcttcctggactccatcgtgaagggcatgaagaacctgctcaacagcacctccctggagaccagcctgagcatcgaggcgccctggggcgccatcaacgtgcagtccacgtacaagcccaccgtcagcaccgccaacatcgccctctcctggagctccgtggagcaccgggggaacaagatcctggtgagcgggcgctccgagagcatcatgaagctggaggagcggaccggcatctcctgggacctcggcgtcgaggacgccagcgagtccaagctgctgacggtgagcgtgatggacctctcccagatgtacagcccggtcttcgagtacctgtccggggaccgccaggtggaggagtggcccaaggcgacctgcaccggcgactgccccgagcggtgcgggtgcaccagctccacgtgcctgcacaaggagtggccccacagccgcaactggcggtgcaacccgacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgacctcccaggagcgccagtgcagcctcatcgaggccgggacccggttcaacctgggccccgtgacgatcaccctgagcgagccccgcaacatccagcagaagctgcccccggagatcatcaccctgcacccccggatcgaggaggggttcttcgacctgatgcacgtccagaaggtgctctccgccagcaccgtctgcaagctgcagtcctgcacgcacggcgtgcccggcgacctccaggtgtaccacatcgggaacctcctgaagggcgacaaggtcaacgggcacctgatccacaagatcgagccccacttcaacaccagctggatgtcctgggacggctgcgacctcgactactactgcaacatgggggactggccgagctgcacctacaccggcgtgacccagcacaaccacgcgtccttcgtgaacctgctgaacatcgagacggactacaccaagaacttccacttccacagcaagcgcgtcaccgcccacggcgacacgccccagctcgacctgaaggcccggcccacctacggggccggcgagatcaccgtgctggtggaggtcgccgacatggagctccacaccaagaagatcgagatctccgggctgaagttcgcgagcctgacctgcacgggctgctacgcctgctccagcgggatctcctgcaaggtgcgcatccacgtggacgagcccgacgagctcaccgtccacgtcaagagcgacgacccggacgtggtggccgcctccagctccctgatggcccggaagctggagttcggcaccgacagcaccttcaaggcgttctccgccatgcccaagacgagcctctgcttctacatcgtggagcgcgagcactgcaagagctgctccgaggaggacaccaagaagtgcgtgaacaccaagctggagcagccccagagcatcctgatcgagcacaagggcaccatcatcgggaagcagaactccacgtgcaccgccaaggccagctgctggctcgagtccgtcaagagcttcttctacggcctgaagaacatgctgtccgggatcttcggcaacgtgttcatcggcatcttcctgttcctcgggcccttcatcctgctgatcctcttcttcatgttcggctggcggatcctgttctgcttcaagtgctgccgccggacccgcgggctgctcaagtaccgccacctgaaggaggacgaggagaccggctaccggcgcatcatcgagcggctgaacaacaagaaggggaagaacaagctcctggacggcgagcgcctggccgaccggcgcatcgcggagctgttcagcacgaagacccacatcggctga

SEQ ID NO: 11994 - RNA, 5055 nt, synthetic construct
  misc_feature 1..5055: note = derived and/or modified CDS sequence (opt1) from CCHFV(NIV 11703)__JN572086.1__GP
  source 1..5055: mol_type = other RNA
atgcacaccagcctgatctacgtggtcctctgcctgcagctgtgctccctcggcaagacccacgggagccacaacggcacggagcacaacaagaccgacgtgatgaccacccccggggacaaccagtccccggagcccctggtgagcacggccctgcccgtcacccccgacccgtccaccgtgacccccacggcccccgcgagcggcctcgaggggtccggcgaggtgtacaccagctccagcatcaccaccaagggcctgtccctgcccaaggccacgagcgagctcctggccaccaccgggatggtcacctccagcgcctccgacatcgacccgagcacgcaggccgcgggcgacacccccacccccaccgtgcgcacgtccctgcccaacagcccgtccacccccagcaccagccaggacacccaccaccccgtgcggaacctcctgtccgtcacgagccccaagccggaggagacccccaccccctccaagagcgacaaggactccagcgccaccaacagcccccacccggccgccagccgcctgtccacgccgcccaccaccgaccaggggcccaccgagaacaacaaccacaacagcacggagcagctcgagtccctgacccggagcgcgacctccagctccatggtgagcctgacccagacggtgctcccccagtccgccaccagcatcgccacccaggacacccacccctcccccaccaaccgcagcaagcggaacctggagatggagatcatcctgacgctcccccagggcctgaagaagtactacgggaagatcctgaagctcctgcacctgaccctcgaggaggacaccgagggcctgctggagtggtgcaagcgcaacctcggcctggactgcgacgacaccttcttccagaagcggatcgaggagttcttcatcacgggggagggccacttcaacgaggtcctgcagttccgcgccccggggaccctcagcaccaccgagcccacgcacgccggctcccccaccgcggagccgttcaagagctacttcgccaagggcttcctgtccatcgacagcgggtacttctccgccaagtgctacagccggacctccaacagcggcctgcagctcatcaacgtgacccgccactccacgcggatcgccgacacccccgggcccaagatcaccaacctgaagaccatcaactgcatcaacctgaaggccagcgtgttcaaggagcaccgcgaggtcgagatcaacgtgctcctgccccaggtggcggtcaacctgtccaactgccacgtggccatcaagagccacgtgtgcgactactccctcgacacggacggcgccatccggctgccgcacatccactacgaggggaccttcatccccggcacctacaagatcgtcatcgacaagaagaacaagctgaacgaccgctgcaccctcttcacgaactgcgtgatcaagggccgggaggtgcgcaaggggcagagcgtcctgcggcagtacaagaccgagatccgcatcggccgggcctccaccgggagccgccggctgctctccgaggagagcggcgacgactgcatcagccgcacccagctgctgcgcacggagaccgccgaggtgcacggggacaactacggcggccccggggacaagatcaccatctgcaacggctccaccgtcgtggaccagcggctggggagcgagctcggctgctacacgatcaaccgcgtgaagtccttcaagctgtgcgagaacagcgcgaccgggaagtcctgcgagatcgacagcatccccgtcaagtgccggcagggctactgcctgaagatcacccaggagggccgcgggcacgtgaagctctcccggggcagcgaggtggtcctggacgcctgcgactccagctgcgaggtgatgatcccgaaggggaccggcgacatcctggtggactgctccggcgggcagcagcacttcctcaaggacaacctgatcgacctgggctgccccaagatccccctcctggggaagatggccatctacatctgccgcatgagcaaccaccccaagacgaccatggccttcctgttctggttctccttcggctacgtcatcacgtgcatcctctgcaaggtgatcttctacctgctgatcatcttcgggaccctcggcaagcggttcaagcagtaccgcgagctgaagccgcagacctgcaccatctgcgagaccacccccgtgaacgccatcgacgcggagatgcacgacctgaactgcagctacaacatctgcccctactgcgcctcccggctcaccagcgacggcctggcccgccacgtcacgcagtgccccaagcggaaggagaaggtggaggagaccgagctgtacctcaacctggagcgcatcccgtgggtggtccggaagctgctccaggtgtccgagagcaccgggatcgccctgaagcgctccagctggctgatcgtgctcctggtcctgttcaccgtgagcatcacgcccgtgcagtccgcgcccatcggccacgggaagaccatcgaggcctaccgggcccgcgaggagtacaccagcatctgcctcttcgtcctgggctccgtgctgttcgtggtcagctgcctcatgaaggggctggtggactccgtgggcaacatcttcttccccggcctgttcatctgcaagacctgcagcatcgggtccatcaacggcttcgagatcgagagccacaagtgctactgctccctcttctgctgcccgtactgccggcactgcagcgccgaccgcgagatccaccagctgcacctgtccatctgcaagaagcggaagacggggagcaacgtcatgctcgccgtgtgcaagcgcatgtgcttccgcaccaccatggaggtgtccaacaaggcgctgttcgtccggagcatcatcaacaccacgttcgtggtgtgcatcctgatcctcgccgtctgcgtggtgtccaccagcgccgtcgagatggagtccctgcccgccggcacctgggagcgcgaggaggacctgaccaacttctgccaccaggagtgccaggtgacggagaccgagtgcctctgcccctacgaggccctggtgctgcggcgccccctcttcctggacagcatcgtcaaggggatgaagaacctgctcaactccaccagcctggagaccagcctgtccatcgaggcgccgtggggcgccatcaacgtgcagagcacgtacaagcccaccgtgtccgccgccaacatcgccctcagctggtccagcgtcgagcaccggggcaacaagatcctggtgtccgggcgcagcgagtccatcatgaagctggaggagcggaccggcatcagctgggacctcggggtggaggacgcgtccgagagcaagctgctgaccgtctccgtgatggacctcagccagatgtactcccccgtgttcgagtacctgagcggcgaccgccaggtcgaggagtggccgaaggccacgtgcaccggggactgccccgagcggtgcggctgcacctccagcacgtgcctgcacaaggagtggccccactcccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtctgcgtggagctgaccagccaggagcgccagtgcagcctcatcgaggccggcacccggttcaacctgggctccgtgaccatcacgctgagcgagccgcgcaacatccagcagaagctcccgcccgagatcatcaccctgcacccccggatcgaggaggggttcttcgacctgatgcacgtccagaaggtgctctccgcgagcaccgtgtgcaagctgcagtcctgcacccacggcgtccccggggacctccaggtgtaccacatcggcaacctcctgaagggggaccgcgtgaacggccacctgatccacaagatcgagcagcacctcaacaccagctggatgtcctgggacggctgcgacctggactactactgcaacatgggggactggcccagctgcacgtacaccggcgtcacccagcacaaccacgcctccttcgtgaacctgctcaacatcgagaccgactacacgaagaccttccacttccacagcaagcgggtgaccgcccacggggacacgccccagctggacctgaaggcccgccccacctacggcgccggggagatcaccgtcctcgtggaggtggcggacatggagctgcacaccaagaagatcgagatctccggcctgaagttcgccagcctctcctgcaccggctgctacgcctgcagctccgggatcagctgcaaggtccggatccacgtggacgagccggacgagctgacggtgcacgtcaagtccgacgaccccgacgtggtggccgccagctccagcctgatggcgcgcaagctcgagagcggcaccgactccaccttcaaggccttcagcgccatgcccaagacctccctgtgcttctacatcgtcgagcgggagtactgcaaggggtgcagcaaggaggacacgcagaagtgcgtgaacaccaagctggagcagccccagtccatcctcatcgagcacaagggcaccatcatcgggaagcagaacaacacgtgcaccgccaaggccagctgctggctggagtccgtgaagtccttcttctacggcctgaagaacatgctgtccggcatcttcgggaacgtcttcctcggcatcttcagcttcctggcgccgttcgtgctgctcatcctgttcttcatgttcgggtggcgcatcctgttctgcttcaagtgctgccgccggacccgcggcctcttcaagtaccggcacctgaaggacgacgaggagaccggctaccgcaagatcatcgagcggctgaacaacaagaaggggaagaacaagctcctggacggcgagcgcctggccgaccggaagatcgccgagctgttctccaccaagacgcacatcgggtga

SEQ ID NO: 11995 - RNA, 5055 nt, synthetic construct
  misc_feature 1..5055: note = derived and/or modified CDS sequence (opt1) from CCHFV(NIV 112143)__JN572085.1__GP
  source 1..5055: mol_type = other RNA
atgcacaccagcctgatctacgtggtcctctgcctgcagctgtgctccctcggcaagacccacgggagccacaacggcacggagcacaacaagaccgacgtgatgaccacccccggggacaaccagtccccggagcccctggtgagcacggccctgcccgtcacccccgacccgtccaccatcacccccacggcccccgcgagcggcctcgaggggtccggcgaggtgtacaccagctccagcatcaccaccaagggcctgtccctgcccaaggccacgagcgagctcctggccaccaccgggatggtgacctccagcgcctccgacatcgacccgagcacgcaggccgcgggcgacacccccacccccaccgtccgcacgtccctgcccaacagcccgtccacccccagcaccagccaggacacccaccaccccgtgcggaacctcctgtccgtgacgagccccaagccggaggagacccccaccccctccaagagcgacaaggactccagcgccaccaacagcccccacccggccgcctcccgcctgtccacgccgcccaccaccgaccaggggcccaccgagaacaacaaccacaacagcacggagcagctcgagtccctgacccggagcgcgacctccagctccatggtcagcctgacccagacggtgctcccccagtccgccaccagcatcgccacccaggacacccacccctcccccaccaaccgcagcaagcggaacctggagatggagatcatcctgacgctcccccagggcctgaagaagtactacgggaagatcctgaagctcctgcacctgaccctcgaggaggacaccgagggcctgctggagtggtgcaagcgcaacctcggcctggactgcgacgacaccttcttccagaagcggatcgaggagttcttcatcacgggggagggccacttcaacgaggtgctgcagttccgcgccccggggaccctcagcaccaccgagcccacgcacgccggctcccccaccgcggagccgttcaagagctacttcgccaagggcttcctgtccatcgacagcgggtacttctccgccaagtgctacagccggacctccaacagcggcctgcagctcatcaacgtcacccgccactccacgcggatcgccgacacccccgggcccaagatcaccaacctgaagaccatcaactgcatcaacctgaaggccagcgtgttcaaggagcaccgcgaggtggagatcaacgtcctcctgccccaggtggcggtgaacctgtccaactgccacgtcgccatcaagagccacgtgtgcgactactccctcgacacggacggcgccatccggctgccgcacatccactacgaggggaccttcatccccggcacctacaagatcgtgatcgacaagaagaacaagctgaacgaccgctgcaccctcttcacgaactgcgtcatcaagggccgggaggtgcgcaaggggcagagcgtgctgcggcagtacaagaccgagatccgcatcggccgggcctccaccgggagccgccggctgctctccgaggagagcggcgacgactgcatcagccgcacccagctgctgcgcacggagaccgccgaggtccacggggacaactacggcggccccggggacaagatcaccatctgcaacggctccaccgtggtcgaccagcggctggggagcgagctcggctgctacacgatcaaccgcgtgaagtccttcaagctgtgcgagaacagcgcgaccgggaagtcctgcgagatcgacagcatccccgtgaagtgccggcagggctactgcctgaagatcacccaggagggccgcgggcacgtcaagctctcccggggcagcgaggtggtgctggacgcctgcgactccagctgcgaggtcatgatcccgaaggggaccggcgacatcctggtggactgctccggcgggcagcagcacttcctcaaggacaacctgatcgacctgggctgccccaagatccccctcctggggaagatggccatctacatctgccgcatgagcaaccaccccaagacgaccatggccttcctgttctggttctccttcggctacgtgatcacgtgcatcctctgcaaggtcatcttctacctgctgatcatcttcgggaccctcggcaagcggttcaagcagtaccgcgagctgaagccgcagacctgcaccatctgcgagaccacccccgtgaacgccatcgacgcggagatgcacgacctgaactgcagctacaacatctgcccctactgcgcctcccggctcaccagcgacggcctggcccgccacgtgacgcagtgccccaagcggaaggagaaggtcgaggagaccgagctgtacctcaacctggagcgcatcccgtgggtggtgcggaagctgctccaggtctccgagagcaccgggatcgccctgaagcgctccagctggctgatcgtgctcctggtgctgttcaccgtcagcatcacgcccgtgcagtccgcgcccatcggccacgggaagaccatcgaggcctaccgggcccgcgaggagtacaccagcatctgcctcttcgtgctgggctccgtcctgttcgtggtgagctgcctcatgaaggggctggtcgactccgtgggcaacatcttcttccccggcctgttcatctgcaagacctgcagcatcgggtccatcaacggcttcgagatcgagagccacaagtgctactgctccctcttctgctgcccgtactgccggcactgcagcgccgaccgcgagatccaccagctgcacctgtccatctgcaagaagcggaagacggggagcaacgtgatgctcgccgtctgcaagcgcatgtgcttccgcgcgaccatggaggtgtccaacaaggccctgttcgtgcggagcatcatcaacaccaccttcgtcgtgtgcatcctgatcctcgccatctgcgtggtctccacgagcgccgtggagatggagtccctgcccgccggcacctgggagcgcgaggaggacctgaccaacttctgccaccaggagtgccaggtgaccgagacggagtgcctctgcccctacgaggcgctggtcctgcggcgccccctcttcctggacagcatcgtgaaggggatgaagaacctgctcaactccaccagcctggagaccagcctgtccatcgaggccccgtggggcgccatcaacgtgcagagcacctacaagcccacggtctccgccgccaacatcgcgctcagctggtccagcgtggagcaccggggcaacaagatcctggtgtccgggcgcagcgagtccatcatgaagctggaggagcggaccggcatcagctgggacctcggggtcgaggacgcctccgagagcaagctgctgaccgtgtccgtgatggacctcagccagatgtactcccccgtcttcgagtacctgagcggcgaccgccaggtggaggagtggccgaaggcgacctgcacgggggactgccccgagcggtgcggctgcacctccagcacgtgcctgcacaaggagtggccccactcccgcaactggcggtgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgaccagccaggagcgccagtgcagcctcatcgaggccggcacccggttcaacctgggctccgtcaccatcaccctgagcgagccgcgcaacatccagcagaagctcccgcccgagatcatcacgctgcacccccggatcgaggaggggttcttcgacctgatgcacgtgcagaaggtgctctccgccagcaccgtctgcaagctgcagtcctgcacccacggcgtgcccggggacctccaggtgtaccacatcggcaacctcctgaagggggaccgcgtcaacggccacctgatccacaagatcgagcagcacctcaacaccagctggatgtcctgggacggctgcgacctggactactactgcaacatgggggactggcccagctgcacctacacgggcgtgacccagcacaaccacgcctccttcgtgaacctgctcaacatcgagaccgactacaccaagacgttccacttccacagcaagcgggtcaccgcccacggggacacgccccagctggacctgaaggcccgccccacctacggcgcgggggagatcaccgtgctcgtggaggtcgccgacatggagctgcacaccaagaagatcgagatctccggcctgaagttcgccagcctctcctgcaccggctgctacgcctgcagctccgggatcagctgcaaggtgcggatccacgtggacgagccggacgagctgaccgtccacgtgaagtccgacgaccccgacgtggtcgccgcgagctccagcctgatggcccgcaagctcgagttcggcacggacagcaccttcaaggccttctccgccatgcccaagaccagcctgtgcttctacatcgtggagcgggagtactgcaaggggtgctccaaggaggacacccagaagtgcgtgaacacgaagctggagcagccccagagcatcctcatcgagcacaagggcaccatcatcgggaagcagaacaacacgtgcaccgccaaggcgtcctgctggctggagagcgtcaagtccttcttctacggcctgaagaacatgctgagcggcatcttcgggaacgtgttcctcggcatcttctccttcctggccccgttcgtgctgctcatcctgttcttcatgttcgggtggcgcatcctgttctgcttcaagtgctgccgccggacccgcggcctcttcaagtaccggcacctgaaggacgacgaggagaccggctaccgcaagatcatcgagcggctgaacaacaagaaggggaagaacaagctcctggacggcgagcgcctggccgaccggaagatcgccgagctgttcagcaccaagacccacatcgggtga

SEQ ID NO: 11996 - RNA, 5055 nt, synthetic construct
  misc_feature 1..5055: note = derived and/or modified CDS sequence (opt1) from CCHFV(NIVA 118594)__JN572084.1__GP
  source 1..5055: mol_type = other RNA
atgcacaccagcctcatctacgtggtcctctgcctgcagctgtgctccctcggcaagacccacgggagccacaacggcacggagcacaacaagaccgacgtgatgaccacccccggggacaaccagtccccggagcccctggtgagcacggccctgcccgtcacccccgacccgtccaccgtgacccccacggcccccgcgagcggcctcgaggggtccggcgaggtgtacaccagctccagcatcaccaccaagggcctgtccctgcccaaggccacgagcgagctcctggccaccaccgggatggtcacctccagcgcctccgacatcgacccgagcacgcaggccgcgggcgacacccccacccccaccgtgcgcacgtccctgcccaacagcccgtccacccccagcaccagccaggacacccaccaccccgtgcggaacctcctgtccgtcacgagccccaagccggaggagacccccaccccctccaagagcgacaaggactccagcgccaccaacagcccccacccggccgccagccgcctgtccacgccgcccaccaccgaccaggggcccaccgagaacaacaaccacaacagcacggagcagctcgagtccctgacccggagcgcgacctccagctccatggtgagcctgacccagacggtgctcccccagtccgccaccagcatcgccacccaggacacccacccctcccccaccaaccgcagcaagcggaacctggagatggagatcatcctgacgctcccccagggcctgaagaagtactacgggaagatcctgaagctcctgcacctgaccctcgaggaggacaccgagggcctgctggagtggtgcaagcgcaacctcggcctggactgcgacgacaccttcttccagaagcggatcgaggagttcttcatcacgggggagggccacttcaacgaggtcctgcagttccgcgccccggggaccctcagcaccaccgagcccacgcacgccggctcccccaccgcggagccgttcaagagctacttcgccaagggcttcctgtccatcgacagcgggtacttctccgccaagtgctacagccggacctccaacagcggcctgcagctcatcaacgtgacccgccactccacgcggatcgccgacacccccgggcccaagatcaccaacctgaagaccatcaactgcatcaacctgaaggccagcgtgttcaaggagcaccgcgagttcgagatcaacgtcctcctgccccaggtggcggtgaacctgtccaactgccacgtcgccatcaagagccacgtgtgcgactactccctcgacacggacggcgccatccggctgccgcacatccactacgaggggaccttcatccccggcacctacaagatcgtgatcgacaagaagaacaagctgaacgaccgctgcaccctcttcacgaactgcgtcatcaagggccgggaggtgcgcaaggggcagagcgtgctgcggcagtacaagaccgagatccgcatcggccgggcctccaccgggagccgccggctgctctccgaggagagcggcgacgactgcatcagccgcacccagctgctgcgcacggagaccgccgaggtccacggggacaactacggcggccccggggacaagatcaccatctgcaacggctccaccgtggtcgaccagcggctggggagcgagctcggctgctacacgatcaaccgcgtgaagtccttcaagctgtgcgagaacagcgcgaccgggaagtcctgcgagatcgacagcatccccgtgaagtgccggcagggctactgcctgaagatcacccaggagggccgcgggcacgtcaagctctcccggggcagcgaggtggtgctggacgcctgcgactccagctgcgaggtcatgatcccgaaggggaccggcgacatcctggtggactgctccggcgggcagcagcacttcctcaaggacaacctgatcgacctgggctgccccaagatccccctcctggggaagatggccatctacatctgccgcatgagcaaccaccccaagacgaccatggccttcctgttctggttctccttcggctacgtgatcacgtgcatcctctgcaaggtcatcttctacctgctgatcatcttcgggaccctcggcaagcggttcaagcagtaccgcgagctgaagccgcagacctgcaccatctgcgagaccacccccgtgaacgccatcgacgcggagatgcacgacctgaactgcagctacaacatctgcccctactgcgcctcccggctcaccagcgacggcctggcccgccacgtgacgcagtgccccaagcggaaggagaaggtcgaggagaccgagctgtacctcaacctggagcgcatcccgtgggtggtgcggaagctgctccaggtctccgagagcaccgggatcgccctgaagcgctccagctggctgatcgtgctcctggtgctgttcaccgtcagcatcacgcccgtgcagtccgcgcccatcggccacgggaagaccatcgaggcctaccgggcccgcgaggagtacaccagcatctgcctcttcgtgctgggctccgtcctgttcgtggtgagctgcctcatgaaggggctggtcgactccgtgggcaacatcttcttccccggcctgttcatctgcaagacctgcagcatcgggtccatcaacggcttcgagatcgagagccacaagtgctactgctccctcttctgctgcccgtactgccggcactgcagcgccgaccgcgagatccaccagctgcacctgtccatctgcaagaagcggaagacggggagcaacgtgatgctcgccgtctgcaagcgcatgtgcttccgcaccaccatggaggtgtccaacaaggcgctgttcgtgcggagcatcatcaacaccacgttcgtcgtgtgcatcctgatcctcgccgtgtgcgtcgtgtccaccagcgccgtggagatggagtccctgcccgccggcacctgggagcgcgaggaggacctgaccaacttctgccaccaggagtgccaggtcacggagaccgagtgcctctgcccctacgaggccctggtgctgcggcgccccctcttcctggacagcatcgtgaaggggatgaagaacctgctcaactccaccagcctggagaccagcctgtccatcgaggcgccgtggggcgccatcaacgtccagagcacgtacaagcccaccgtgtccgccgccaacatcgccctcagctggtccagcgtggagcaccggggcaacaagatcctggtctccgggcgcagcgagtccatcatgaagctggaggagcggaccggcatcagctgggacctcggggtggaggacgcgtccgagagcaagctgctgaccgtgtccgtcatggacctcagccagatgtactcccccgtgttcgagtacctgagcggcgaccgccaggtggaggagtggccgaaggccacgtgcaccggggactgccccgagcggtgcggctgcacctccagcacgtgcctgcacaaggagtggccccactcccgcaactggcggtgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtcgagctgaccagccaggagcgccagtgcagcctcatcgaggccggcacccggttcaacctgggctccgtgaccatcacgctgagcgagccgcgcaacatccagcagaagctcccgcccgagatcatcaccctgcacccccggatcgaggaggggttcttcgacctgatgcacgtgcagaaggtcctctccgcgagcaccgtgtgcaagctgcagtcctgcacccacggcgtgcccggggacctgcaggtctaccacatcggcaacctcctgaagggggaccgcgtgaacggccacctgatccacaagatcgagcagcacctcaacaccagctggatgtcctgggacggctgcgacctggactactactgcaacatgggggactggcccagctgcacgtacaccggcgtgacccagcacaaccacgcctccttcgtcaacctgctcaacatcgagaccgactacacgaagaccttccacttccacagcaagcgggtgaccgcccacggggacacgccccagctggacctgaaggcccgccccacctacggcgccggggagatcaccgtgctcgtcgaggtggcggacatggagctgcacaccaagaagatcgagatctccggcctgaagttcgccagcctctcctgcaccggctgctacgcctgcagctccgggatcagctgcaaggtgcggatccacgtcgacgagccggacgagctgacggtgcacgtgaagtccgacgaccccgacgtcgtggccgccagctccagcctgatggcgcgcaagctcgagagcggcaccgactccaccttcaaggccttcagcgccatgcccaagacctccctgtgcttctacatcgtggagcgggagtactgcaaggggtgcagcaaggaggacacgcagaagtgcgtcaacaccaagctggagcagccccagtccatcctcatcgagcacaagggcaccatcatcgggaagcagaacaacacgtgcaccgccaaggccagctgctggctggagtccgtgaagtccttcttctacggcctgaagaacatgctgtccggcatcttcgggaacgtgttcctcggcatcttcagcttcctggcgccgttcgtcctgctcatcctgttcttcatgttcgggtggcgcatcctgttctgcttcaagtgctgccgccggacccgcggcctcttcaagtaccggcacctgaaggacgacgaggagaccggctaccgcaagatcatcgagcggctgaacaacaagaaggggaagaacaagctcctggacggcgagcgcctggccgaccggaagatcgccgagctgttctccaccaagacgcacatcgggtga

SEQ ID NO: 11997 - RNA, 5055 nt, synthetic construct
  misc_feature 1..5055: note = derived and/or modified CDS sequence (opt1) from CCHFV(UCCR4448)__KY484042.1__GP
  source 1..5055: mol_type = other RNA
atgcacatcagcctgatgtacgccgtgctctgcctgcagctgtgcggcctcggggagacccacggctcccacaacgagaccgggcacaacaagacggacgtcatgaccacccccggcgacaacctgagctccgagcagccggtgagcaccgccctgtccatcacgcccgaccccagcaccgtgacccccaccacgccggcgtccgggctcgagggcagcggcgaggtctacacctccccccccatcatcaccgagagcctgtccctgcccgagaccacgccggagctcagcgccaccgccgggatcgacacctccagcgcctccgacgtggacagctccacccaggccgcgcgcggcacgagcgccctgaccgtgcggacctccctgcccaacagccccagcaccccctccacgccgcaggagacccaccaccccgtccgcaacctcctgagcgtgacctccccccggcccgaggagaccagcacgccgtccgggagcggcaaggagtccagcgccacctccgggccccaccccgtgagcaacaagcccccgaccccccccgccaagacccagggccccacggagaacaactcccacaacgcgaccgagcacccggagcccctgacccagagcgccaccctcggcctgatgacgtcccccacccagatcgtccacccccagagcgccacctccatcaccgtgcaggacacgtacccgagccccaccaaccgctccaagcggaacctggagatggagatcatcctcaccctgagccaggggctgaagaagtactacggcaagatcctccgcctgctgcggctcaccctggaggaggacaccgaggggctgctcgagtggtgcaagcgcaacctgggcctggactgcgacgacacgttcttccagaagcggatcgaggagttcttcatcaccggcgaggggcacttcaacgaggtgctccagttcaagacccccggcaccctgtccacgaccgagagcaccccggccgagctgcccaccgccgagcccttcaagagctacttcgcgaaggggttcctctccatcgacagcggctactactccgccaagtgctacagcgggacgtccaacagcggcctgcagctgatcaacatcacccgccactccgcccggatcgtcgacacccccggcccgaaggtgaccaacctcaagacgatcaactgcatcaacctgaaggccagcatcttcaaggagcaccgcgaggtggagatcaacgtcctgctcccccaggtggccgtgaacctgtccaactgccacgtcatcatcaagagccacgtgtgcgactactccctggacatcgacgggaccgtgcggctcccccacatctaccacgagggcgtcttcatccccgggacctacaagatcgtgatcgacaagaaggacaagctgaacgaccgctgcaccctgttcacggactgcgtgatcaagggccgggaggtccgcaaggggcagagcgtgctccggcagtacaagaccgagatccgcatcggcaaggcgtccaccggcagccggcgcctgctgtccgaggagaccagcgacgactgcatctcccggacgcagctcctgcgcaccgagaccgccgagatccacggggacaactacggcgggccgggcgacaagatcaccatctgcaacgggagcacgatcgtcgaccagcgcctgggcagcgagctgggctgctacaccatcaaccgggtgaagtccttcaagctctgcgagaacagcgccaccgggaagtcctgcgagatcgacagcgtgcccgtcaagtgccgccagggctactgcctgcggatcacccaggaggggcgcggccacgtgaagctgtcccggggcagcgaggtggtcctcgacgcctgcgacacgtcctgcgagatcatgatccccaaggggaccggcgacatcctggtggactgcagcgggggccagcagcacttcctgaaggacaacctcatcgacctggggtgccccaagatcccgctgctcggcaagatggccatctacatctgccgcatgtccaaccaccccaagaccaccatggcgttcctgttctggttcagcttcggctacgtgatcacgtgcatcctgtgcaaggccatcttctacctcctgatcatcatcgggaccctgggcaagcggttcaagcagtaccgcgagctcaagccccagacctgcaccatctgcgagacgacccccgtcaacgccatcgacgccgagatgcacgacctgaactgctcctacaacatctgcccgtactgcgccagccggctgacctccgacgggctcgcgcgccacgtgacccagtgccccaagcggaaggagaaggtggaggagaccgagctgtacctgaacctcgagcgcatcccctgggtcgtgcggaagctgctgcaggtgagcgagtccacgggcgtcgccctcaagcgcagctcctggctgatcgtgctgctcgtgctgttcaccatcagcctgtcccccgtccagagcgccccgatcagccacgggaagaccatcgaggcctaccgggcgcgcgagggctacacctccatctgcctcttcgtgctgggcagcatcctgttcatcgtgtcctacctcatgaaggggctggtcgacagcgtgggcaactccttcttccccgggctgagcatctgcaagacgtgctccaccagctccatcaacggcttcgagatcgagagccacaagtgctactgctccctcttctgctgcccctactgccggcactgcagcgccgacaaggagatccacaagctgcacctgtccatctgcaagaagcgcaagaccgggagcaacgtgatgctcgccgtctgcaagcggatgtgcttccgcgccaccatggaggtgtccaaccgcgccctgttcatccggagcatcatcaacacgaccttcgtgctgtgcatcctcatcctggcggtctgcgtggtgtccaccagcgccgtcgagatggagaacctgcccgccggcacctgggagcgcgaggaggacctcacgaacttctgccaccaggagtgccaggtgaccgagaccgagtgcctgtgcccgtacgaggccctggtgctccggaagcccctgttcctggactccatcgtcaagggcatgaagaacctcctgaacagcaccagcctggagacgtccctcagcatcgaggccccctggggggcgatcaacgtgcagtccacctacaagccgaccgtgagcaccgccaacatcgccctgtcctggagctccgtcgagcaccgcggcaacaagatcctggtgagcgggcggtccgagagcatcatgaagctcgaggagaagacgggcatctcctgggacctgggggtggaggacgccagcgagtccaagctgctcaccgtcagcgtgatggacctgtcccagatgtacagccccgtgttcgagtacctgtccggcgaccgccaggtcgaggagtggcccaaggccacctgcaccggcgactgccccgagcggtgcgggtgcacgagctccacctgcctccacaaggagtggccgcacagccgcaactggcggtgcaaccccacctggtgctggggcgtggggaccggctgcacgtgctgcggcctggacgtgaaggacctgttcaccgactacatgttcgtcaagtggaaggtggagtacatcaagaccgaggcgatcgtgtgcgtcgagctcaccagccaggagcgccagtgctccctgatcgaggccgggacgcggttcaacctgggccccgtgaccatcaccctcagcgagccccgcaacatccagcagaagctgccgcccgagatcatcaccctgcacccccggatcgaggaggggttcttcgacctcatgcacgtgcagaaggtcctgtccgccagcacggtgtgcaagctgcagtcctgcacccacggcgtccccggggacctccaggtgtaccacatcggcaacctgctgaagggcgacaaggtgaacgggcacctcatccacaagatcgagccgcacttcaacaccagctggatgtcctgggacggctgcgacctggactactactgcaacatgggggactggcccagctgcacctacaccggcgtcacgcagcacaaccacgcctccttcgtgaacctgctcaacatcgagaccgactacaccaagaacttccacttccacagcaagcgcgtgaccgcgcacggggacacgccccagctggacctgaaggcccggcccacctacggcgccggcgagatcaccgtcctcgtggaggtggccgacatggagctgcacaccaagaagatcgagatctccgggctgaagttcgccagcctcacgtgcaccggctgctacgcgtgctccagcgggatctcctgcaaggtccgcatccacgtggacgagccggacgagctgaccgtgcacgtcaagagcgacgaccccgacgtggtggccgcctccagctccctgatggcccggaagctcgagttcggcaccgacagcacgttcaaggccttcagcgcgatgcccaagacctccctgtgcttctacatcgtcgagcgcgagcactgcaagagctgctccgaggaggacaccaagaagtgcgtgaacaccaagctggagcagccccagagcatcctcatcgagcacaaggggacgatcatcggcaagcagaactccacctgcaccgccaaggccagctgctggctggagtccgtgaagagcttcttctacggcctgaagaacatgctgtccgggatcttcggcaacgtcttcatcgggatcttcctcttcctggccccgttcatcctgctcatcctgttcttcatgttcggctggaagatcctgttctgcttcaagtgctgccggcgcacccggggcctcttcaagtaccgccacctgaaggacgacgaggagacggggtaccgccggatcatcgagcgcctgaacaacaagaagggcaagaacaagctcctggacggggagatcctggccgaccggcgcatcgcggagctcttcagcaccaagacccacatcggctga

SEQ ID NO: 11998 - RNA, 5055 nt, synthetic construct
  misc_feature 1..5055: note = derived and/or modified CDS sequence (opt1) from CCHFV(UCCR4401)__KY484035.1__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccccggggacaacccgagctccgagccgcccgtgagcacggccctgtccatcaccctggaccccagcaccgtcacccccacgacccccgcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccgtccggcaccggcaaggagagctccgccaccagcagcccccaccccgtgtccaaccggcccccgacgccgcccgcgaccgcccaggggcccaccgagaacgactcccacaacagcaccgagcaccccgagtccctgacgcagagcgccacccccggcctcatgacctcccccacccagatcgtgcacccgcagagcgccacccccatcacggtccaggacacccacccctcccccaccaaccgcagcaagcggaacctgaagatggagatcatcctgaccctctcccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctcagcaccaccgagtccacgcccgcggggctgcccaccgccgagcccttcaagagctacttcgccaagggcttcctgtccatcgacagcggctactacagcgccaagtgctactccgggaccagcaactccggcctccagctgatcaacatcacccgccacagcacgcggatcgtggacaccccggggcccaagatcaccaacctgaagaccatcaactgcatcaacctcaaggcctccatcttcaaggagcaccgcgaggtcgagatcaacgtgctgctgccccaggtggcggtcaacctcagcaactgccacgtggtgatcaagtcccacgtctgcgactacagcctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagtccgtcctgcggcagtacaagaccgagatccgcatcggcaaggccagcacggggtcccggcgcctcctgagcgaggagccctccgacgactgcatcagccggacccagctgctccgcaccgagaccgccgagatccacggcgacaactacgggggccccggcgacaagatcacgatctgcaacgggtccaccatcgtggaccagcgcctgggcagcgagctggggtgctacaccatcaaccgggtccgctccttcaagctgtgcgagaacagcgccaccggcaagaactgcgagatcgacagcgtgcccgtgaagtgccggcagggctactgcctccgcatcacgcaggaggggcggggccacgtcaagctgtcccgcgggagcgaggtggtgctggacgcgtgcgacacctcctgcgagatcatgatcccgaagggcaccggggacatcctcgtcgactgcagcggcggccagcagcacttcctgaaggacaacctgatcgacctcgggtgccccaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtgggcaccctggggaagcgcctgaagcagtaccgggagctcaagccgcagacctgcaccatctgcgagaccacccccgtcaacgccatcgacgcggagatgcacgacctgaactgctcctacaacatctgcccctactgcgccagccgcctgacctccgacggcctcgcccggcacgtgatccagtgccccaagcgcaaggagaaggtggaggagaccgagctgtacctgaacctcgagcggatcccgtgggtcgtgcgcaagctgctccaggtgagcgagtccacgggcgtcgccctgaagcggagctcctggctgatcgtgctgctcgtgctgttcaccgtcagcctgtcccccgtgcagagcgcccccatcgggcagggcaagaccatcgaggcgtaccgcgcccgggaggggtacacctccatctgcctcttcgtgctgggcagcatcctgttcatcgtctcctgcctcatgaaggggctggtggacagcgtgggcaacagcttcttcccgggcctgtccatctgcaagacgtgcagcatctccagcatcaacgggttcgagatcgagtcccacaagtgctactgcagcctcttctgctgcccctactgccgccactgctccaccgacaaggagatccacaagctgcacctgagcatctgcaagaagcggaagaccggctccaacgtcatgctcgccgtgtgcaagctgatgtgcttccgcgccaccatggaggtgagcaaccgcgcgctgttcatccggtccatcatcaacacgaccttcgtcctctgcatcctgatcctggccgtgtgcgtggtcagcacctccgccgtggagatggagaacctccccgccgggacctgggagcgcgaggaggacctgacgaacttctgccaccaggagtgccaggtgaccgagaccgagtgcctgtgcccctacgaggccctcgtcctgcggaagccgctgttcctcgacagcaccgcgaagggcatgaagaacctgctgaactccacgagcctcgagacctccctgagcatcgaggccccctggggcgccatcaacgtgcagtccacctacaagcccaccgtgagcacggccaacatcgccctgagctggtccagcgtcgagcaccgcgggaacaagatcctcgtgtccggccggagcgagtccatcatgaagctggaggagcgcaccgggatcagctgggacctgggcgtggaggacgcgtccgagagcaagctcctgaccgtctccgtgatggacctgagccagatgtactcccccgtgttcgagtacctcagcggggaccggcaggtcgaggagtggccgaaggcgacctgcacgggcgactgccccgagcgctgcggctgcacctccagcacgtgcctgcacaaggagtggccccactcccggaactggcgctgcaaccccacctggtgctggggcgtggggaccgggtgcacgtgctgcggcctggacgtgaaggacctcttcaccgactacatgttcgtcaagtggaaggtggagtacatcaagaccgaggccatcgtgtgcgtcgagctgaccagccaggagcggcagtgctccctgatcgaggccgggacccgcttcaacctcggcccggtgaccatcaccctgagcgagccccggaacatccagcagaagctgccgcccgagatcatcaccctccacccccgcatcgaggagggcttcttcgacctgatgcacgtgcagaaggtcctgtccgccagcacggtgtgcaagctccagagctgcacccacggggtccccggcgacctccaggtgtaccacatcgggaacctgctgaagggcgacaaggtgaacgggcacctgatccacaagatcgagccccacttcaacacctcctggatgagctgggacggctgcgacctggactactactgcaacatgggcgactggccctcctgcacctacacgggggtcacccagcacaaccacgccagcttcgtgaacctcctgaacatcgagaccgactacaccaagaacttccacttccactccaagcgggtgacggcccacggcgacaccccgcagctggacctcaaggcccgccccacctacggggccggcgagatcaccgtcctggtggaggtggcggacatggagctgcacacgaagaagatcgagatcagcgggctcaagttcgcctccctggcctgcaccggctgctacgcctgcagctccggcatcagctgcaaggtccggatccacgtggacgagcccgacgagctgaccgtgcacgtcaagtccgacgaccccgacgtggtggccgcgagctccagcctcatggcccgcaagctggagttcgggaccgactccacgttcaaggccttcagcgccatgccgaagacctccctgtgcttctacatcgtcgagcgggagcactgcaagagctgctccgaggaggacaccaagaagtgcgtgaacaccaagctcgagcagccccagagcatcctgatcgagcacaagggcacgatcatcgggaagcagaacagcacgtgcaccgccaaggcgtcctgctggctggagagcgtgaagtccttcttctacggcctgaagaacatgctcagcggcatcttcgggaacgtcttcatgggcatcttcctgttcctggcccccttcatcctcctgatcctgttcttcatgttcgggtggcgcatcctcttctgcttcaagtgctgccggcgcacccgcggcctgttcaagtaccggcacctgaaggacgacgaggagaccgggtaccgccggatcatcgagaagctcaacaacaagaagggcaagaacaagctgctggacggcgagcgcctcgccgaccggcgcatcgccgagctgttctccaccaagacccacatcgggtga

SEQ ID NO: 11999 - RNA, 5055 nt, synthetic construct
  misc_feature 1..5055: note = derived and/or modified CDS sequence (opt1) from CCHFV(IbAn7620)__KX013451.1__GP
  source 1..5055: mol_type = other RNA
atgcacatcagcctgatctacgccatcctctgcctgcagctgtgcggcctcggggagacctacggctcccacaacgagacccgccacaacaagacggacaccatgaccacccccggggacaacctgagctccgagccgcccgtgagcacggccctgttcatcacccccgacccctccaccgtcaccccgacgacccccgcgagcggcctcgaggggtccggcgaggtgtacaccagcccccccatcaccacgggctccctgccgctgcccgagaccacccccgagctccccgccaccacggggaccgacaccagctccgccagcgacgtggacttctccacccagacggccggcgggaccagcgccctgaccgtccggaccggcctgccggactcccccagcacgccctccaccccccaggacacccaccacccgatgcgcaacctcctgagcgtgacctcccccgggcccgacgagacgagcacccccagcggcaccggccgggagtccagcgcgacctccagcccgcaccccgtgtccaaccgcccccccacgccgcccgccaccgcccaggggcccaccgagaacgacagccacaacgccaccgagcaccccgagtccctgacgcagagcgcgaccccgggcctcatgacctcccccacccagaccatccacccccagagcgccacgccgatcaccgtccaggacaagcagccctcccccaccaaccggagcaagcgcaacctggagatggagatcatcctgaccctctcccaggggctgaagaagtactacggcaagatcctgcggctcctgcacctgacgctcgaggaggacaccgagggcctgctggagtggtgcaagcgcaacctcgggctggactgcgacgacaacttcttccagaagcggatcgaggagttcttcatcaccggcgaggggcacttcaacgaggtgctgcagttccgcacccccggcacgctcagcaccaccgagtccaccccggccgggctgcccacggccgagcccttcaagagctacttcgccaagggcttcctgtccatcgacagcggctactactccgcgaagtgctacagcgggaccagcaactccggcctccagctgatcaacatcacccggcacagcacccgcatcgtggacacgcccgggccgaagatcaccaacctgaagaccatcaactgcatcaacctcaaggcctccatcttcaaggagcaccgggaggtcgagatcaacgtgctgctgccccaggtggccgtcaacctcagcaactgccacgtggtgatcaagtcccacgtctgcgactacagcctggacatcgacggcgccgtgcgcctgccccacatctaccacgagggggtgttcatccccggcacctacaagatcgtcatcgacaagaagaacaagctcaacgaccggtgcacgctgttcaccgactgcgtgatcaagggccgcgaggtgcggaaggggcagtccgtcctgcgccagtacaagaccgagatccggatcggcaaggccagcaccgggtcccgccggctcctgagcgaggagccgtccgacgactgcatcagccgcacgcagctgctccgcaccgagaccgcggagatccacggcgacaactacgggggccccggcgacaagatcaccatctgcaacgggtccacgatcgtggaccagcggctgggcagcgagctggggtgctacaccatcaaccgcgtgaagtccttcaagctgtgcgagaacagcgccaccggcaagaactgcgagatcgactccgtccccgtgaagtgccggcagggctactgcctccgcatcacccaggaggggcggggccacgtcaagctgagccgcgggagcgagatcgtgctggacgcctgcgacacgtcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccaccatggccttcctcttctggttcagcttcgggtacgtcatcacgtgcatcctgtgcaaggcgatcttctacctgctcatcatcatcggcaccctggggaagcgcctgaagcagtaccgggagctcaagccccagacctgcaccatctgcgagaccacgccggtgaacgccatcgacgccgagatgcacgacctgaactgctcctacaacatctgcccctactgcgccagccgcctgacctccgacggcctcgcccggcacgtgatccagtgccccaagcgcaaggagaaggtcgaggagaccgagctgtacctgaacctcgagcggatcccctgggtggtgcgcaagctgctgcaggtcagcgagtccaccggcgtggcgctcaagcggagctcctggctgatcgtgctgctcgtcctgttcacggtgagcctgtccccggtgcagagcgcccccatcgggcagggcaagaccaccgaggcctaccgcgcccgggaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccgccactgctccaccgacaaggagatccacaagctgcacctgagcatctgcaagaagcggaagaccggctccaacgtgatgctcgcggtgtgcaagcgcatgtgcttccgcgccaccatggaggtcagcaaccgggccctgttcatccgctccatcatcaacacgaccttcgtgctgtgcatcctcatcctggccgtgtgcgtcgtgagcacctccgccgtggagatggagaacctgcccgcggggacctgggagcgggaggaggacctcacgaacttctgccaccaggagtgccaggtcaccgagaccgagtgcctgtgcccctacgaggccctggtgctccgcaagcccctgttcctggacagcatcgccaagggcatgaagaacccgctcaactccaccagcctggagacgtccctgagcatcgaggccccctggggggccatcgacgtgcagtccacctacaagcccaccgtcagcaccgcgaacatcgccctctcctggagcagcgtggagcaccggggcaacaagatcctggtgtccggccgcagcgagtccatcatgaagctggaggagcggacggggatcagctgggacctcggcgtcgaggacgcctccgagagcaagctgctgaccgtgtccgtgatggacctcagccagatgtactcccccgtcttcgagtacctgagcggggaccgccaggtggaggagtggccgaaggccacctgcaccggcgactgccccgagcggtgcggctgcacgtccagcacctgcctgcacaaggagtggccccactcccgcaactggcggtgcaaccccacctggtgctggggggtgggcaccgggtgcacgtgctgcggcctcgacgtcaaggacctgttcaccgactacatgttcgtgaagtggaaggtggagtacatcaagaccgaggccatcgtctgcgtggagctgaccagccaggagcgccagtgctccctcatcgaggcggggacgcggttcaacctgggcccggtgaccatcaccctgagcgagccccgcaacatccagcagaagctcccccccgagatcatcaccctgcacccgcggatcgaggagggcttcttcgacctgatgcacgtccagaaggtgctctccgccagcaccgtgtgcaagctgcagtcctgcacgcacggggtccccggcgacctgcaggtgtaccacatcgggaacctcctgaagggcgacaaggtgaacgggcacctgatccacaagatcgagccccacttcaacaccagctggatgagctgggacggctgcgacctcgactactactgcaacatgggcgactggccctcctgcacctacaccggggtcacgcagcacaaccacgccagcttcgtgaacctgctgaacatcgagaccgactacaccaagaacttccacttccactccaagcgcgtcaccgcccacggcgacacgccgcagctcgacctgaaggcgcggcccacctacggggccggcgagatcaccgtgctggtggaggtcgccaacatggagctccacaccaagaagatcgagatcagcgggctgaagttcgcctccctgacgtgcaccggctgctacgcctgcagctccggcatcagctgcaaggtgcgcatccacgtggacgagcccgacgagctcaccgtccacgtgaagtccgacgaccccgacgtggtcgcggccagctccagcctgatggcccggaagctggagttcgggaccgactccacgttcaaggccttcagcgccatgccgaagacctccctctgcttctacatcgtggagcgcgagcactgcaagagctgctccgaggaggacaccaagaagtgcgtgaacaccaagctggagcagccccagagcatcctgatcgagcacaagggcacgatcatcgggaagcagaactccacctgcaccgcgaaggccagctgctggctcgagagcgtcaagtccttcttctacggcctgaagaacatgctgagcggcatcttcgggaacgtgttcatgggcatcttcctgttcctcgcccccttcatcctgctgatcctcttcttcatgttcgggtggcggatcctgttctgcttcaagtgctgccgccgcacccggggcctgttcaagtaccgccacctcaaggacgacgaggagacggggtaccggcgcatcatcgagcggctgaacaacaagaagggcaagaacaagctgctcgacggcgagcgcctggccgaccggcgcatcgccgagctgttctccaccaagacccacatcgggtga

SEQ ID NO: 12000 - RNA, 5055 nt, synthetic construct
  misc_feature 1..5055: note = derived and/or modified CDS sequence (opt1) from CCHFV(Zahedan 2007)__KC867273.1__GP
  source 1..5055: mol_type = other RNA
atgcacatcagcctgatgtacgccgtgttctgcctccagctgtgcggcctggggaagaccaacggcccccacaacgggaccgagcacaacaacacgcacgtcatgaccaccccggacgactcccagagccccgagccgcccgtgtccaccgccctccccgtgacgcccgaccccagcaccgtcaccccctccaccccggcgagcggcctggaggggtccggcgaggtgcacacgagctcccccatcaccaccaagggcctgagcctccccgaggccacctccgagcccccgagcacgacctccgtggtcaccagctccgccagcgacaccgactccagcacgcaggccgccggggacacccccacccccaccgtgcgcacgtccctgcccagcagcccgtccacccccagcacctcccagggcacccactaccccgtgcggagcctgctctccgtcacggggcccaagccggaggagacccccacccccagcaagtccggcaaggacaacctggcgaccaacagcccccacccggccacgtcccgccccaccacccccagcaccatcgcccagaagcccacggagaacaactcccacaacaccaccgagcagctggagagcctcacccacctggccacgctggggtccaagatcagcccgacccagaccgtgctcccccagtccgtgaccagcatcgcgatccaggacatccacacctcccccacgaaccggagcaagcgcaacctggacatggagatcatcctgaccctctcccagggcctgaagaagtactacggcaagatcctgaagctcctgcggctgaccctcgaggaggacaccgaggggctgctggagtggtgcaagcgcaacctcggcctggactgcgacgacacgttcttccagaagcggatcgaggagttcttcatcaccggggagggccacttcaacgaggtcctgcagttccgcaccctcggcaccctgagcacgaccgagagcacccacgccgggtccccgaccgtggagcccttcaagagctacttcgccaagggcttcctgtccatcgacagcgggtacttctccgccaagtgctacagccggacgtccaacagcggcctccagctgatcaacgtgacccgccactccacccggatcgccgacacccccgggcccaagatcacgaacctgaagaccatcaactgcatcaacctcaaggcgagcgtcttcaaggagcaccgcgaggtggagatcaacgtgctgctgccgcaggtcgccgtgaacctctccaactgccacgtggccatcaagagccacatctgcgactactccctggacaccgacggcgccatccggctgccccagatccaccacgagggcaccttcatccccgggacgtacaagatcgtcatcgacaagaagtccaagctcaacgaccgctgcaccctgttcaccaactgcgtgatcaagggccgggaggtgcgcaaggggcagagcgtcctgcggcagtacaagaccgagatccgcatcggccgggccagcacggggtcccgccggctcctgagcgaggagagcggcgacgactgcatctcccgcacccagctgctccgcaccgagaccgcggaggtgcacggcgacaactacgggggccccggggacaagatcacgatctgcaacggcagcaccgtcgtggaccagcggctggggtccgagctgggctgctacaccatcaaccgcgtgcggagcttcaagctgtgcgagaactccgccaccggcaagagctgcgagatcgactccatcccggtcaagtgcaagcaggggttctgcctcaagatcacgcaggagggccgcgggcacgtgaagctgagccggggctccgaggtggtcctggacgtgtgcgacagctcctgcgaggtgatgatccccaagggcaccggggacatcctcgtcgactgcagcggcgggcagcagcacttcctgaaggacaacctggtggacctcggctgccccaagatccccctgctggggaagatggccatctacatctgccgcatgtccaaccacccgaagaccaccatggccttcctcttctggttcagcttcggctacgtgatcacgtgcatcctgtgcaaggccatcttcttcctgctcatcatcttcggcaccctggggaagcggttcaagcagtaccgcgagctgaagccccagacctgcaccatctgcgagaccacgcccgtcaacgcgatcgacgccgagatgcacgacctcaactgctcctacaacatctgcccctactgcgccagccggctgacctccgacggcctggcccgccacgtgacccagtgcccgcggcgcaaggagaaggtggaggagaccgagctctacctgaacctggagcggatcccctgggtcgtgcgcaagctcctccaggtgagcgagtccacggggaccgtcctgaagcggagcagctggctcatcgtgctgctggtgctgttcaccgtctccctgagccccgtgcagtccgcccccatcggccacgggaagaccatcgagacgtaccgcgtgcgggaggagtacaccagcatctgcctgttcgtcctcggctccatcctgttcatcgtgagcttcctgatgaagggcctcgtggacggggtcggcaacatcttcttcccggggctgtccgtgtgcaagacctgcagcatcggctccatcaacgggttcgagatcgagagccaccgctgctactgctccctgttctgctgcccctactgccggcactgcagcgcggacggcgagatccaccagctccacctgtccatctgcaagaagcgcaagaccggcagcaacgtgatgctggccgtctgcaagcgcatgtgcttccgggccacgatggaggtgtccaacaaggtgctgttcatccgcagcatcatcaacaccaccttcgtcgtgtgcatcctgatcctggccgtgtgcgtcgtgtccaccagcgcggtggagatggagtccctccccgccgggacgtgggagcgggaggaggacctgaccaacttctgccaccaggagtgccaggtcaccgagaccgagtgcctgtgcccctacgaggccctcgtgctgcgccggccgctgttcctcgacagcatcgtgaaggacatgaagaacctgctgaacagcacgtccctcgagaccagcctgtccatcgaggccccctggggcgccatcaacgtccagagcacctacaagcccaccgtgtccacggcgaacatcgccctgagctggtccagcgtggagcaccgcgggaacaaggtcctcgtgtccggccggagcgagtccatcatgaagctggaggagcgcaccgggatcagctgggacctgggcgtggaggacgcctccgagagcaagctcctgaccgtctccgtgatggacctgagccagatgtactccccggtgttcgagtacctcagcggcgaccggcaggtcgaggagtggcccaaggcgacctgcacgggggactgccccgagcgctgcggctgcacctccagcacgtgcctgcacaaggagtggccccacagccggaactggcgctgcaacccgacctggtgctggggcgtggggaccggctgcacgtgctgcgggctggacgtcaaggacctcttcaccgactacatgttcgtgaagtggaaggtggagtacatcaagaccgaggccatcgtctgcgtggagctgacctcccaggagcggcagtgcagcctgatcgaggccggcacccgcttcaacctcgggtccgtgaccatcaccctgagcgagccccggaacatccagcagaagctgccgcccgagatcatcaccctccaccccaagatcgaggagggcttcttcgacctgatgcacgtccagaaggtgctgtccgccagcacggtgtgcaagctccagtcctgcacccacggggtccccggcgacctccaggtgtaccacatcggcaacctgctcaagggggaccgcgtgaacggccacctgatccacaagatcgagcagcacttcaacaccagctggatgtcctgggacgggtgcgacctggactactactgcaacatgggcgactggcccagctgcacctacacgggggtcacccagcacaaccacgcctccttcgtgaacctcctgaacatcgagaccgactacaccaagacgttccacttccacagcaagcgggtgaccgcccacggcgacacgccccagctggacctcaaggcccgcccgacctacggcgcgggggagatcaccgtcctggtggaggtggccgacatggagctgcacaccaagaagatcgagatctccggcctcaagttcgccgggctgacctgcaccggctgctacgcctgcagctccgggatcagctgcaaggtccggatccacgtggacgagcccgacgagctgacggtgcacgtcaagtccgacgaccccgacgtggtggcggccagctccagcctcatggcccgcaagctggagttcggcaccgacagcaccttcaaggccttctccgccatgcccaagaccagcctgtgcttctacatcgtcgagcgggagtactgcaagtcctgcagcaaggaggacacgcagaagtgcgtgaacaccaagctcgagcagccgcagtccatcctgatcgagcacaagggcaccatcatcgggaagcagaacaacacgtgcaccgcgaaggccagctgctggctggagtccgtcaagagcttcttctacggcctcaagaacatgctcgggggcatcttcggcaacgtgttcatcgggatcttcaccttcctgacccccttcatcctgctgatcttcttcttcatgttcggctggcgcatcctgttctgcttcaagtgctgccgccggacccgcgggctgttcaagtaccggcacctcaaggacgacgaggagacgggctaccgcaagatcatcgagcggctgaacaacaagaaggggaagaaccgcctgctcgacggcgagcggctggccgaccgcaagatcgccgagctgttctccaccaagacccacatcggctga

SEQ ID NO: 12001 - RNA, 5055 nt, synthetic construct
  misc_feature 1..5055: note = derived and/or modified CDS sequence (opt1) from CCHFV(Afg09-2990)__HM452306.1__GP
  source 1..5055: mol_type = other RNA
atgcacatcagcctgatgtacgccgtgttctgcctccagctgtgcggcctggggaagaccaacggcccccacaacgggaccgagcacaacaacacgcacgtcatgaccaccccggacgactcccagagccccgagccccccgtgtccaccgccctcccggtgacgcccgaccccagcaccgtcaccccctccaccccggcgagcggcctggaggggtccggcgaggtgtacacgagctcccccatcaccaccaagggcctgagcctccccgaggccacctccgagcccccggccacgaccagcgtggtcacctccagcgcctccgacaccgacagctccacgcaggccgcgggggacacccccacccccaccgtgcgcacgagcctgccctccagcccgagcaccccctccaccagccagggcacccactaccccgtgcggtccctgctcagcgtcacgtcccccaagccggaggagacccccacccccagcaagtccgggaaggacaacctggccaccaacagcccccacccggccacgtcccgccccaccaccccccccaccacggcccagaagccgaccgagaacaacagccacaacaccaccgagcagctggagtccctcacgcacctggcgaccctgggcagcatgatctcccccacccagaccgtgctcccccagagcgtgacctccatcgccatccaggacatccacaacagcccgacgaaccggtccaagcgcaacctggacatggagatcatcctgaccctcagccaggggctgaagaagtactacggcaagatcctgaagctcctgcacctgaccctcgaggaggacaccgagggcctgctggagtggtgcaagcggaacctcgggctggactgcgacgacacgttcttccagaagcgcatcgaggagttcttcatcaccggcgaggggcacttcaacgaggtcctgcagttccggaccctcggcaccctgtccacgaccgagagcacccacgccggcagccccaccgtggagcccttcaagtcctacttcgccaaggggttcctgagcatcgactccggctacttcagcgccaagtgctactcccgcacgagcaactccgggctccagctgatcaacgtgacccggcacagcacccgcatcgcggacacccccggcccgaagatcacgaacctgaagaccatcaactgcatgaacctcaaggcctccgtcttcaaggagcaccgggaggtggagatcaacgtgctgctgccccaggtcgccgtgaacctcagcaactgccacgtggccatcaagtcccacatctgcgactacagcctggacaccgacggggccatccgcctgccccagatccaccacgagggcaccttcatccccggcacgtacaagatcgtcatcgacaagaagtccaagctcaacgaccggtgcaccctgttcaccaactgcgtgatcaaggggcgcgaggtgcggaagggccagagcgtcctgcgccagtacaagaccgagatccggatcgggcgcgcgtccgccggcagccggcgcctcctgtccgaggagagcggggacgactgcatcagccggacgcagctgctccgcaccgagaccgccgaggtgcacggcgacaactacggcgggccgggcgacaagatcaccatctgcaacgggtccacggtcgtggaccagcgcctgggcagcgagctggggtgctacaccatcaaccgggtgcgctccttcaagctgtgcgagaacagcgccaccggcaagtcctgcgagatcgacagcatccccgtcaagtgcaagcagggctactgcctcaagatcacccaggaggggcggggccacgtgaagctgtcccgcgggagcgaggtggtcctggacgtgtgcgactccagctgcgaggtgatgatccccaagggcacgggcgacatcctcgtcgactgctccgggggccagcagcactacctgaaggacaacctggtggacctcgggtgccccaagatcccgctgctgggcaagatggccatctacatctgccggatgagcaaccaccccaagaccaccatggcgttcctcttctggttctccttcgggtacgtgatcacctgcatcctgtgcaaggccatcttcttcctgctcatcatcttcggcacgctgggcaagcgcttcaagcagtaccgggagctgaagccccagacctgcaccatctgcgagaccacccccgtcaacgccatcgacgccgagatgcacgacctcaactgcagctacaacatctgcccgtactgcgcctcccgcctgacgagcgacgggctggcgcggcacgtgacccagtgcccccgccggaaggagaaggtggaggagaccgagctctacctgaacctggagcgcatcccctgggtcgtgcggaagctcctgcaggtgtccgagagcaccggcacggtcctgaagcgctccagctggctcatcgtgctgctggtgctcttcaccgtcagcctgtcccccgtgcagagcgccccgatcgggcacggcaagaccatcgagacctaccgggtgcgcgaggagtacacgtccatctgcctgttcgtcctcgggagcatcctgttcatcgtgtccttcctgatgaagggcctcgtggacggcgtcgggaacatcttcttccccggcctgagcgtgtgcaagacctgctccatcgggagcatcaacggcttcgagatcgagtcccacaagtgctactgcagcctgttctgctgcccctactgccggcactgctccgccgacggggagatccaccagctccacctgagcatctgcaagaagcgcaagaccggctccaacgtgatgctggccgtctgcaagcggatgtgcttccgcgcgaccatggaggtgagcaacaaggccctcttcatccgctccatcatcaacacgaccttcgtggtctgcatcctgatcctggccgtgtgcgtggtcagcacctccgccgtggagatggagagcctccccgccggcacctgggagcgggaggaggacctgacgaacttctgccaccaggagtgccaggtgaccgagaccgagtgcctgtgcccgtacgaggcgctcgtcctgcgccggcccctgttcctcgactccatcgtgaaggggatgaagaacctgctgaacagcaccagcctcgagacgtccctgagcatcgaggccccctggggcgccatcaacgtgcagtccacctacaagccgaccgtcagcaccgccaacatcgccctgtcctggagctccgtggagcaccgcgggaacaaggtgctcgtcagcggccggtccgagagcatcatgaagctggaggagcgcacggggatctcctgggacctgggcgtggaggacgcgagcgagtccaagctcctgaccgtgagcgtcatggacctgtcccagatgtacagccccgtgttcgagtacctctccggcgaccggcaggtggaggagtggcccaaggccacctgcaccggggactgccccgagcgctgcggctgcacgagctccacctgcctgcacaaggagtggccgcacagccggaactggcgctgcaaccccacctggtgctggggggtcggcaccggctgcacgtgctgcgggctggacgtgaaggacctcttcaccgactacatgttcgtcaagtggaaggtggagtacatcaagaccgaggccatcgtgtgcgtcgagctgaccagccaggagcggcagtgctccctgatcgaggccggcacgcgcttcaacctcgggagcgtgaccatcaccctgtccgagccccggaacatccagcagaagctgcccccggagatcatcaccctccaccccaagatcgaggagggcttcttcgacctgatgcacgtgcagaaggtcctgagcgcctccaccgtgtgcaagctccagagctgcacgcacggggtgcccggcgacctgcaggtctaccacatcggcaacctgctcaagggggaccgcgtgaacggccacctgatccacaagatcgagcagcacttcaacacctcctggatgagctgggacgggtgcgacctggactactactgcaacatgggcgactggccctcctgcacctacaccggggtgacgcagcacaaccacgcgagcttcgtcaacctcctgaacatcgagaccgactacaccaagaccttccacttccactccaagcgggtgacggcccacggcgacaccccgcagctggacctcaaggcccgccccacctacggcgccggggagatcaccgtgctggtcgaggtggcggacatggagctgcacacgaagaagatcgagatcagcggcctcaagttcgccgggctgacctgcaccggctgctacgcctgctccagcgggatctcctgcaaggtgcggatccacgtcgacgagcccgacgagctgaccgtgcacgtgaagagcgacgaccccgacgtcgtggccgcctccagctccctcatggcgcgcaagctggagttcggcacggacagcaccttcaaggccttcagcgccatgccgaagacctccctgtgcttctacatcgtggagcgggagtactgcaagagctgctccaaggaggacacccagaagtgcgtcaacacgaagctcgagcagccccagagcatcctgatcgagcacaagggcaccatcatcgggaagcagaacaacacctgcaccgccaaggcctcctgctggctggagagcgtgaagtccttcttctacggcctcaagaacatgctggggggcatcttcggcaacgtgttcatcgggatcttcacgttcctgacccccttcatcctgctcatcctgttcttcatgttcggctggcgcatcctgttctgcttcaagtgctgccggcgcacccgcgggctcttcaagtaccggcacctgaaggacgacgaggagaccggctaccgcaagatcatcgagcggctgaacaacaagaaggggaagaaccgcctcctggacggcgagcggctggcggaccgcaagatcgccgagctcttcagcacgaagacccacatcggctga

SEQ ID NO: 12002 - RNA, 5055 nt, synthetic construct
  misc_feature 1..5055: note = derived and/or modified CDS sequence (opt1) from CCHFV(SPU41/84)__AY900142.1__GP
  source 1..5055: mol_type = other RNA
atgcacatcagcctgatgtacgcggtgctctgcctgcagctgtgcggcctcggggagacccacggcagccacaacgggacccgctacaacaacaccgacgccaccaccacccccggcgacagccagagccccgagccgcccgtgagcaccgcgtccagcatcacccacaacccctccaccgtgaccagcaccacccccacctccgggagcgagggctccggcgaggtgtacaccagctcccccatcacgaccgaggggctgtccccgcccggcaccacccccgagctgcccgccacgaccgggatcgacacctccggcgccagcgacgccaacccctccacccaggccgcgcgggggacgagcgccctcaccgtgcacacctccctgcccagcagcccgtccaccccgcccatcagccaggacacgcaccaccccgtgcgcaacctgctctccgtgaccagccccatgcccgaggagaccaccgccccctccggcagcggcaaggagtccagcgccacgtccagcccccaccccgcgtccgaccggccgcccacgccgcccgccaccgcccaggggctgaccgagagcaactcccacaacgccacggagcacctggagagcctcacccagtccgccacccccggcctggtcaccagccccgcgcagacggtgcacccccactccgccaccagcatcgccgcccccgacacccaccccaaccccaccaaccgctccaagcggaacctggagatggagatcatcctcaccctgagccaggggctgaagaagtactacggcaagatcctccgcctgctgcacctcacgctggaggaggacaccgagggcctgctcgagtggtgcaagcggaacctggggctggactgcgacgacaccttcttccagaagcgcatcgaggagttcttcatcaccggcgaggggcacttcaacgaggtgctccagttccggacgccgggcaccgtcagcaccaccgagtccacgcacgccgggccgcccaccgcggagcccttcaagagctacttcgccaagggctccctgagcatcgactccggctactacagcgccaagtgctactccgggaccagcaactccggcctgcagctcatcaacatcacccgccacagcacgaagatcgccgacaccccggggcccaagatcaccaacctgaagaccatcaactgcatcaacctgaaggccctcacgttcaaggagcaccgggaggtggagatcaacgtgctgctgccccaggtcgcggtgaacctctccaactgccacgtggtcatcaagagccacgtgtgcgactactccctggacatcgacggcaccgtgcgcctgccccacatccaccacgaggggatcttcatcccgggcacctacaagatcgtcatcgacaagaagaacaagatgaacgaccggtgcaccctcttcacgaactgcgtgatcaagggccgcgaggtgcggaaggggcagagcgtcctgaagcagtacaagaccgagatccgcatcggcaaggcctccaccgggagccggcgcctgctctccgaggagagcagcgacgactgcatctcccggacccagctgctgcgcacggagaccgccgagatccacggcgacaactacgggggccccggcgacaagatcaccatctgcaacgggagcaccgtggtggaccagcggctcggctccgagctggggtgctacacgatcaaccgcgtcaagaccttcaagctgtgcgagaacagcgccaccggcaagtcctgcgagatcgacagcgtgcccgtcaagtgccgccagggctactgcctcaagatcacccaggaggggcggggccacgtgaagctgtcccgcgggagcgaggtggtcctggacgcctgcgacacgtcctgcgaggtgatgatccccaagggcaccggggacatcctggtggactgcagcggcggccagcagcacttcctcaaggacaacctgatcgacctggggtgcccgaagatccccctcctgggcaagatggcgatctacatctgccggatgtccaaccaccccaagaccaccatggccttcctgttctggttcagcttcgggtacgtcatcacgtgcatcatctgcaaggtgatcttctacctcctgatcatcgtgggcaccctggggaagcgcttcaagcagtaccgggagctcaagccccagacctgcaccatctgcgagaccacgccggtcaacgccatcgacgccgagatgcacgacctgaactgctcctacaacatctgcccctactgcgcgagccgcctgacctccgacggcctcgcccggcacgtgacccagtgccccaagcgcaaggagaaggtggaggagaccgagctgtacctgaacctcgagcggatcccctgggtcgtgcgcaagctgctccaggtgagcgagtccacgggcgtcgccctcaagcggagctcctggctggtggtgctgctcgtcctgctgaccgtgagcctcagcccggtgcagtccgcccccatcagccacgggaagaccgtcgaggcctaccgcgcgcgggagggctacacctccatgtgcctgttcgtgctggggagcgtcctgttcctggtctcctgcctgatgaagggcctcgtggacagcgtggggaacacgttcttccccggcctgtccatctgcaagacctgcagcatctccagcatcaacggcttcgagatcgagtcccaccgctgctactgcagcctgttctgctgcccctactgccggcactgctccgccaacaaggagatccaccagctccacctgagcatctgcaagaagcgcaaggccgggtccaacgtcatgctggccgtgtgcaagcggatgtgcttccgcgccaccatggaggtgagcaaccgggccctcttcatccgctccatcatcaacaccacgttcgtcctgtgcatcctgatcctcgccgcctgcgtggtgagcacctccgccgtcgagatggagagcctgccggccggcacctgggagcgcgaggaggacctgaccaacttctgccaccaggagtgccaggtggcggacacggagtgcctctgcccctacgaggccctggtgctgcggcgccccctcttcctggacagcatcgtcaaggggatgaagaacctgctcaactccaccagcctggagacctccctgagcatcgaggccccgtggggcgccatcaacgtgcagtccacctacaagcccacggtgagcaccgcgaacatcgccctctcctggagctccgtcgagcaccgggggaacaagatcctggtgagcggccgctccgagagcatcatgaagctggaggagcggaccggcatctcctgggacctcggggtggaggacgccagcgagtccaagctgctgaccgtcagcgtgatggacctctcccagatgtacagccccgtgttcgagtacctgtccggcgaccgccaggtcgaggagtggcccaaggccacgtgcaccggggactgcccggagcggtgcggctgcaccagctccacgtgcctgcacaaggagtggccccactcccgcaactggcggtgcaaccccacctggtgctggggcgtggggaccggctgcacgtgctgcgggctcgacgtgaaggacctgttcaccgactacatgttcgtcaagtggaaggtggagtacatcaagacggaggccatcgtgtgcgtcgagctgaccagccaggagcgccagtgctccctcatcgaggcgggcacccggttcaacctggggcccgtgaccatcacgctgagcgagccgcgcaacatccagcagaagctgccgcccgagatcatcaccctgcacccccggatcgaggagggcttcttcgacctgatgcacgtccagaaggtgctctccgccagcaccgtgtgcaagctgcagtcctgcacccacggcgtcccgggggacctccaggtgtaccacatcggcaacctcctgaagggggacaaggtgaacggccacctggtccacaagatcgagccccacttcaacaccagctggatgtcctgggacgggtgcgacctcgactactactgcaacatgggcgactggcccagctgcacgtacaccggcgtgacccagcacaaccacgcctccttcgtgaacatgctgaacatcgagaccgactacacgaagaacttccacttccacagcaagcgcgtcaccgcccacggggacacgccccagctggacctcaaggcccggccgacctacggcgcgggggagatcacggtgctggtggaggtcgccgacatggagctgcacaccaagaagatcgagatctccggcctcaagttcaccagcctgacctgcacggggtgctacgcctgctccagcggcatctcctgcaaggtgcgcatccacgtggacgagcccgacgagctgaccgtccacgtcaagagcgaggaccccgacgtggtcgccgcctccagcagcctcatggcgcggaagctggagttcggcaccgactccaccttcaaggccttcagcgccatgcccaagacgtccctgtgcttctacatcgtggagcgcgagtactgcaagagctgctccgaggaggacacccagaagtgcgtgaacaccaagctcgagcagccgcagagcatcctgatcgagcggaaggggaccatcatcggcaagcagaacaacacgtgcaaggccaaggcggggtgctggctggagtccgtcaagagcttcttctacggcctcaagaacatgctgtccggcatcttcgggaacgtgttcatcggcatcttcctgttcctcgcccccttcatcctgctgatcctgttcttcatgttcgggtggcgcatcctcttctgcttcaagtgctgccggcgcacccgcggcctgttcaagtaccggcacctgaaggacgacgaggagaccgggtaccgcaagatcatcgagcggctcaacaacaagaagggcaagaacaagctgctggacggcgagcgcctcgccgaccggcgcatcgccgagctgttcagcaccaagacgcacatcgggtga

SEQ ID NO: 12003 - RNA, 5055 nt, synthetic construct
  misc_feature 1..5055: note = derived and/or modified CDS sequence (opt1) from CCHFV(SPU103/87)__DQ211634.1__GP
  source 1..5055: mol_type = other RNA
atgcacatcagcctcatgtacgccgtgctctgcctgcagctgtgcggcctcgggggcgcccacgggtcccacaacggcacccgctacaacaacaccggggcgctgacgaccctgggcgacggccagagctccgagcccccggtcagcaccgccccctccaccacgcacaaccccagcaccgtgacctccaccacgcccgccagcgggtccgagggcagcggggaggtgtacaccgcctccccggtcaccaccgagggcctcagcccgcccgggacgacccccgagctgcccgccaccaccggcatcgacacgtccggcgcgagcgacgccgacccctccacccaggccgccggggacaccagcgcgctgaccgtgcggacgtccctccccagctcccccagcaccctgccgaccagccaggacacccaccaccccgtgcgcaacctgctctccgtcacgagcccccggcccgaggagaccaccgccccgtccggcagcgggatcgagtccagcgccacctccagcccccaccccgcctccgaccggcccccgacgccgcccgccgcggcccagggccccaccgagagcaactcccacaacgccaccgagcacctggagagcctgacccagtccgccacgcccgacctcgtgaccagccccgcccagaccgtgcacccccagtccgcgaccagcatcgccgcccccgacacgcacccgtcccccaccaaccgcagcaagcgcaacctggaggtcgagatcatcctgaccctctcccagggcctgaagaagtactacgggaagatcctgcggctcctgcacctgaccctcgaggaggacaccgagggcctgctggagtggtgcaagcgcaacctcgggctggactgcgacgacacgttcttccagaagcggatcgaggagttcttcatcaccggcgaggggcacttcaacgaggtgctgcagttccgcacccccggcaccgtgagcacgaccgagagcacccacgccggcccgcccaccgccgagcccttcaagtcctacttcgcgaaggggttcctcagcatcgactccggctactacagcgccaagtgctactccgggacgagcaactccggcctgcagctgatcaacatcacccggcacagcacccgcatcgccgacacccccgggccgaagatcacgaacctcaagaccatcaactgcatcaacctgaaggccctgaccttcaaggagcaccgggaggtcgagatcaacgtgctcctgccccaggtggccgtcaacctgtccaactgccacgtggtgatcaagagccacgtctgcgactactccctcgacatcgacggcaccgtgcgcctgccccacatccaccacgagggcatcttcatccccgggacgtacaagatcgtgatcgacaagaagaacaagctgaacgaccggtgcaccctcttcaccgactgcgtcatcaagggccgcgaggtgcggaaggggcagagcgtgctgaagcagtacaagaccgagatccgcatcggcaaggcgtccacggggagccggcgcctgctctccgaggagagctccgacgactgcatcagccggacccagctgctgcgcaccgagaccgccgagatccacggcgacaactacggcgggccgggcgacaagatcacgatctgcaacgggagcaccatcgtcgaccagcgcctcggctccgagctgggctgctacaccatcaaccgggtgaagaccttcaagctgtgcgagaacagcgccacggggaagtcctgcgagatcgacagcgtccccgtgaagtgccgccagggctactgcctgaagatcacccaggaggggcggggccacgtgaagctctcccgcgggagcgaggtcgtgctggacgcctgcgacacctcctgcgaggtgatgatccccaagggcaccggcgacatcctggtcgactgcagcgggggccagcagcacttcctcaaggacaacctgatcgacctggggtgccccaagatcccgctcctgggcaagatggcgatctacatctgccggatgtccaaccaccccaagacgaccatggccttcctgttctggttcagcttcgggtacgtgatcacgtgcgtgctctgcaaggccatcttctacctgctgatcatcgtcggcaccctcggcaagcgcctgaagcagtaccgggagctgaagccccagacctgcaccatctgcgagaccacccccgtgaacgccatcgacgccgagatgcacgacctcaactgctcctacaacatctgcccgtactgcgcgagccgcctgacctccgacgggctggcccggcacgtgacgcagtgccccaagcgcaaggagaaggtcgaggagaccgagctctacctgaacctggagcggatcccctgggtggtgcgccggctcctgcaggtcagcgagtccaccggcgtggccctgaagcgcagctcctggctcatcgtgctgctggtcctcttcaccgtgagcctgtcccccgtgcagagcgccccgatcagccacgggaagacggtcgaggcctaccaggcgcgggagggctacaccgggatgtgcctgttcgtgctcggctccatcctgttcctggtgagctgcctcatgaagggcctggtcgactccgtggggaacaccttcttccccggcctgagcatctgcaagacctgctccatcagctccatcaacgggttcgagatcgagagccaccgctgctactgctccctcttctgctgcccctactgccggcactgcagcgccaacaaggagatccaccagctgcacctgtccatctgcaagaagcgcaagacgggcagcaacgtgatgctcgccgtctgcaagcggatgtgcttccgcgccaccatggaggtgtccaaccgcgccctgttcatccggagcatcatcaacaccaccttcgtgctgtgcatcctcatcctggcggtctgcgtggtgtccacgagcgccgtcgagatggagtccctgcccgccgggacctgggagcgcgaggaggacctcaccaacttctgccaccaggagtgccaggtgaccgacacggagtgcctgtgcccgtacgaggccctggtgctccggcgccccctgttcctggacaacatcgtcaagggcatgaagaacctcctgaacagcacctccctggagaccagcctcagcatcgaggcgccctggggcgccatcaacgtgcagtccacctacaagccgacggtgagcaccgccaacatcgccctgtcctggagctccgtcgagcaccgggggaacaagatcctggtgagcggccgctccgagagcatcatgaagctcgaggagcggaccgggatctcctgggacctgggcgtggaggacgccagcgagtccaagctgctcaccgtcagcgtgatggacctgtcccagatgtacagccccgtgttcgagtacctgtccggcgaccgccaggtcgaggagtggcccaaggcgacgtgcaccggggactgccccgagcggtgcggctgcaccagctccacgtgcctccacaaggagtggccgcacagccgcaactggcggtgcaaccccacctggtgctggggcgtggggaccgggtgcacgtgctgcggcctggacgtgaaggacctgttcaccgactacatgttcgtcaagtggaagatcgagtacatcaagaccgaggccatcgtgtgcgtggagctcacctcccaggagcgccagtgcagcctgatcgaggccggcacccggttcaacctggggcccgtcaccatcacgctcagcgagccccgcaacatccagcagaagctgccgtccgagatcatcaccctgcacccccggatcgaggagggcttcttcgacctcatgcacgtgcagaaggtcctgagcgcctccaccgtgtgcaagctgcagagctgcacccacggggtgcccggcgacctccaggtctaccacatcgggaacctgctgaagggcgacaaggtgaacggccacctcgtgcacaagatcgagccccacttcaacacctcctggatgagctgggacgggtgcgacctggactactactgcaacatgggcgactggccgtcctgcacgtacaccggggtcacccagcacaaccacgccagcttcgtgaacctgctcaacatcgagaccgactacacgaagaacttccacttccactccaagcgcgtgaccgcgcacggcgacacgccccagctggacctgaaggcccggcccacctacggggccggcgagatcaccgtcctcgtggaggtggccgacatggagctgcacaccaagaagatcgagatcagcggcctgaagttcacctccctgacctgcacggggtgctacgcctgcagctccggcatcagctgcaaggtccgcatccacgtggacgagcccgacgagctcaccgtgcacgtcaagtccgacgacccggacgtggtggcggccagctccagcctgatggcccggaagctcgagttcgggaccgactccaccttcaaggccttcagcgcgatgcccaagacgagcctgtgcttctacatcgtcgagcgcgagtactgcaagtcctgcagcgaggaggacacccagaagtgcgtgaacaccaagctggagcagccccagtccatcctcatcgagcacaagggcaccatcatcggcaagcagaacaacacgtgcaaggcccgggccgggtgctggctggagagcgtgaagtccttcttctacggcctgaagaacatgctgagcgggatcttcggcaacgtcttcatcgggatcttcctcttcctggcccccttcatcctgctcatcctgttcttcatgttcggctggcgcatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggggagcgcctggccgaccggcgcatcgcggagctgttctccaccaagacgcacatcggctga

SEQ ID NO: 12004 - RNA, 5055 nt, synthetic construct
  misc_feature 1..5055: note = derived and/or modified CDS sequence (opt1) from CCHFV(Iran-53)__DQ446216.1__GP
  source 1..5055: mol_type = other RNA
atgcacatcagcctgatgtacgccgtgttctgcctccagctgtgcggcctggggaagaccaacggcccccacaacgggaccgagcacaacaacacgcacgtcatgaccaccccggacgactcccagagccccgagccgcccgtgtccaccgccctccccgtgacgcccgaccccagcaccgtcaccccctccaccccggcgagcggcctggaggggtccggcgaggtgtacacgagctcccccatcaccaccaagggcctgagcctccccgaggccacctccgagcccccggccacgaccagcgtggtcacctccagcgcctccgacaccgacagctccacgcaggccgccgggggcacccccacccccaccgtgcgcacgagcctgccctccagcccgagcaccccctccaccagccaggggacccactaccccgtgcggtccctgctcagcgtcacgtcccccaagccggaggagacccccacccccagcaagtccggcaaggacaacctggccaccaacagcccccacccggccacgtcccgccccaccgccccgcccaccaccgcgcagaagcccacggagaacaacagccacaacaccaccgagcagctggagtccctcacccacctggccacgctggggagcatgatctcccccacccagaccgtgctcccccagagcgtgacctccatcgccatccaggacatccacaccagcccgacgaaccggtccaagcgcaacctggacgtcgagatcatcctgaccctcagccagggcctgaagaagtactacggcaagatcctgaagctcctgcacctgaccctcgaggaggacaccgaggggctgctggagtggtgcaagcggaacctcggcctggactgcgacgacacgttcttccagaagcgcatcgaggagttcttcatcaccggggagggccacttcaacgaggtgctgcagttccggaccctcggcaccctgtccacgaccgagagcacccacgccgggagccccaccgtggagcccttcaagtcctacttcgccaagggcttcctgagcatcgactccgggtacttcagcgcgaagtgctactcccgcacgagcaactccggcctccagctgatcaacgtcacccggcacagcacccgcatcgccgacacccccgggccgaagatcacgaacctgaagaccatcaactgcatcaacctcaaggcctccgtgttcaaggagcaccgggaggtggagatcaacgtcctgctgccccaggtggccgtgaacctcagcaactgccacgtcgccatcaagtcccacatctgcgactacagcctggacaccgacggcgcgatccgcctgccccagatccaccacgagggcaccttcatccccgggacgtacaagatcgtgatcgacaagaagtccaagctcaacgaccggtgcaccctgttcaccaactgcgtgatcaagggccgcgaggtccggaaggggcagagcgtgctgcgccagtacaagaccgagatccggatcggccgcgcctccacggggagccggcgcctcctgtccgaggagagcggcgacgactgcatcagccggacccagctgctccgcaccgagaccgccgaggtccacggcgacaactacgggggcccgggggacaagatcacgatctgcaacggctccaccgtggtggaccagcgcctggggagcgagctgggctgctacaccatcaaccgggtccgctccttcaagctgtgcgagaacagcgccaccggcaagtcctgcgagatcgacagcatccccgtgaagtgcaagcaggggtactgcctcaagatcacgcaggagggccgggggcacgtgaagctgtcccgcggcagcgaggtcgtgctggacgtgtgcgactccagctgcgaggtcatgatccccaagggcaccggggacatcctcgtggactgctccggcgggcagcagcacttcctgaaggacaacctggtggacctcggctgccccaagatcccgctgctggggaagatggccatctacatctgccggatgagcaaccaccccaagaccaccatggcgttcctcttctggttctccttcggctacgtcatcacgtgcatcctgtgcaaggccatcttcttcctgctcatcatcttcggcaccctggggaagcgcttcaagcagtaccgggagctgaagccccagacctgcaccatctgcgagaccacgcccgtgaacgccatcgacgccgagatgcacgacctcaactgcagctacaacatctgcccgtactgcgcctcccgcctgaccagcgacggcctggcgcggcacgtgacccagtgcccccgccggaaggagaaggtcgaggagaccgagctctacctgaacctggagcgcatcccctgggtggtgcggaagctcctgcaggtctccgagagcacggggaccgtgctgaagcgctccagctggctcatcgtgctgctggtcctcttcaccgtgagcctgtcccccgtgcagagcgccccgatcggccacgggaagaccatcgagacgtaccgggtccgcgaggagtacacctccatctgcctgttcgtgctcggcagcatcctgttcatcgtgtccttcctgatgaagggcctcgtcgacggggtgggcaacatcttcttccccgggctgagcgtgtgcaagacctgctccatcggcagcatcaacgggttcgagatcgagtcccacaagtgctactgcagcctgttctgctgcccctactgccggcactgctccgccgacggcgagatccaccagctccacctgagcatctgcaagaagcgcaagaccggctccaacgtcatgctggccgtgtgcaagcggatgtgcttccgcgcgacgatggaggtgagcaacaaggccctcttcatccgctccatcatcaacaccaccttcgtcgtgtgcatcctgatcctggccgtgtgcgtcgtgagcacctccgccgtggagatggagagcctccccgccgggacgtgggagcgggaggaggacctgaccaacttctgccaccaggagtgccaggtcaccgagaccgagtgcctgtgcccgtacgaggcgctcgtgctgcgccggcccctgttcctcgactccatcgtgaagggcatgaagaacctgctgaacagcacgagcctcgagacctccctgagcatcgaggccccctggggcgccatcaacgtccagtccacctacaagccgaccgtgagcacggccaacatcgccctgtcctggagctccgtggagcaccgcgggaacaaggtcctcgtgagcgggcggtccgagagcatcatgaagctggaggagcgcaccggcatctcctgggacctgggcgtggaggacgcgagcgagtccaagctcctgaccgtcagcgtgatggacctgtcccagatgtacagccccgtgttcgagtacctctccggggaccggcaggtcgaggagtggcccaaggcgacctgcacgggcgactgccccgagcgctgcgggtgcaccagctccacgtgcctgcacaaggagtggccgcacagccggaactggcgctgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgaccagccaggagcggcagtgctccctgatcgaggccgggacccgcttcaacctcggcagcgtgaccatcaccctgtccgagccccggaacatccagcagaagctgcccccggagatcatcaccctccaccccaagatcgaggaggggttcttcgacctgatgcacgtccagaaggtgctgagcgcctccacggtgtgcaagctccagagctgcacccacggcgtccccggcgacctccaggtgtaccacatcgggaacctgctcaagggcgaccgcgtgaacgggcacctgatccacaagatcgagcagcacttcaacacctcctggatgagctgggacggctgcgacctggactactactgcaacatgggggactggccctcctgcacctacacgggcgtcacccagcacaaccacgcgagcttcgtgaacctcctgaacatcgagaccgactacaccaagacgttccacttccactccaagcgggtgaccgcccacggcgacaccccgcagctggacctcaaggcccgccccacctacggggccggcgaggtcacggtgctggtggaggtcgcggacatggagctgcacaccaagaagatcgagatcagcgggctcaagttcgccggcctgacctgcaccgggtgctacgcctgctccagcggcatctcctgcaaggtgcggatccacgtggacgagcccgacgagctgacggtccacgtcaagagcgacgaccccgacgtggtggccgcctccagctccctcatggcgcgcaagctggagttcggcaccgacagcaccttcaaggccttcagcgccatgccgaagacctccctgtgcttctacatcgtggagcgggagtactgcaagagctgctccaaggaggacacgcagaagtgcgtgaacaccaagctcgagcagccccagagcatcctgatcgagcacaaggggaccatcatcggcaagcagaacaacacgtgcaccgccaaggcctcctgctggctggagagcgtcaagtccttcttctacgggctcaagaacatgctgggcggcatcttcgggaacgtgttcatcggcatcttcaccttcctgacccccttcatcctgctcatcctgttcttcatgttcgggtggcgcatcctgttctgcttcaagtgctgccggcgcacccgcggcctcttcaagtaccggcacctgaaggacgacgaggagacggggtaccgcaagatcatcgagcggctgaacaacaagaagggcaagaaccgcctcctggacggcgagcggctggcggaccgcaagatcgccgagctgttcagcaccaagacccacatcgggtga

SEQ ID NO: 12005 - RNA, 5055 nt, synthetic construct
  misc_feature 1..5055: note = derived and/or modified CDS sequence (opt1) from CCHFV(Iran-52)__DQ446215.1__GP
  source 1..5055: mol_type = other RNA
atgcacatcagcctgatgtacgccgtgttctgcctccagctgtgcggcctggggaagaccaacggcccccacaacgggaccgagcacaacaacacgcacgtgatgaccaccccggacgactcccagagccccgagccgcccgtgtccaccgccctccccgtgacgcccgaccccagcaccgtcaccccctccaccccggcgagcggcctggaggggtccggcgaggtgtacacgagctcccccatcaccaccaagggcctgagcctccccgaggccacctccgagcccccggccacgaccagcgtggtcacctccagcgcctccgacaccgacagctccacgcaggccgcgggggacacccccacccccaccgtgcgcacgagcctgccctccagcccgagcaccccctccaccagccagggcacccactaccccgtgcggtccctgctcagcgtcacgtcccccaagccggaggagacccccacccccagcaagtccgggaaggacgacctggccaccaacagcccccacccggccacgtcccgccccaccaccccgcccaccacggcccagaagcccaccgagaacaacagccacaacaccaccgagcagctggagtccctcacgcacctggcgaccctgggcctcatgatcagccccacccagaccgtgctgccccagtccgtgaccagcatcgccatccaggacatccacaactccccgacgaaccggagcaagcgcaacctggacatggagatcatcctcaccctgtcccaggggctgaagaagtactacggcaagatcctcaagctgctgcacctcaccctggaggaggacaccgagggcctgctcgagtggtgcaagcggaacctggggctggactgcgacgacacgttcttccagaagcgcatcgaggagttcttcatcaccggcgaggggcacttcaacgaggtcctccagttccggaccctgggcaccctgagcacgaccgagtccacccacgccggcagccccaccgtggagcccttcaagagctacttcgccaaggggttcctctccatcgacagcggctacttctccgccaagtgctacagccgcacgtccaacagcgggctgcagctgatcaacgtgacccggcactccacccgcatcgcggacacccccggcccgaagatcacgaacctcaagaccatcaactgcatgaacctgaaggccagcgtcttcaaggagcaccgggaggtggagatcaacgtgctgctcccccaggtcgccgtgaacctgtccaactgccacgtggccatcaagagccacatctgcgactactccctggacaccgacggggccatccgcctcccccagatccaccacgagggcaccttcatccccggcacgtacaagatcgtcatcgacaagaagtccaagctgaacgaccggtgcaccctgttcaccaactgcgtgatcaaggggcgcgaggtgcggaagggccagagcgtcctccgccagtacaagaccgagatccggatcgggcgcgcgagcacgggctcccggcgcctgctgagcgaggagtccggggacgactgcatcagccggacccagctcctgcgcaccgagaccgccgaggtgcacggcgacaactacggcgggccgggcgacaagatcacgatctgcaacgggagcaccgtcgtggaccagcgcctgggctccgagctggggtgctacaccatcaaccgggtgcgcagcttcaagctctgcgagaactccgccaccggcaagagctgcgagatcgactccatccccgtcaagtgcaagcagggctactgcctgaagatcacgcaggaggggcggggccacgtgaagctgagccgcgggtccgaggtggtcctcgacgtgtgcgacagctcctgcgaggtgatgatccccaagggcaccggcgacatcctggtcgactgcagcgggggccagcagcacttcctgaaggacaacctcgtggacctggggtgccccaagatcccgctgctcggcaagatggccatctacatctgccggatgtccaaccaccccaagaccaccatggccttcctgttctggttcagcttcgggtacgtgatcacgtgcatcctgtgcaaggcgatcttcttcctcctgatcatcttcggcaccctgggcaagcgcttcaagcagtaccgggagctcaagccccagacctgcaccatctgcgagaccacgcccgtcaacgccatcgacgccgagatgcacgacctgaactgctcctacaacatctgcccgtactgcgccagccgcctgacctccgacgggctcgcccggcacgtgacccagtgcccccgccggaaggagaaggtggaggagaccgagctgtacctgaacctcgagcgcatcccctgggtcgtgcggaagctgctccaggtgagcgagtccacgggcaccgtcctcaagcgcagctcctggctgatcgtgctgctcgtgctgttcaccgtcagcctgagccccgtgcagtccgcgccgatcgggcacggcaagaccatcgagacgtaccgggtgcgcgaggagtacaccagcatctgcctcttcgtcctggggtccatcctgttcatcgtgagcttcctcatgaagggcctggtggacggcgtcgggaacatcttcttccccggcctgtccgtgtgcaagacctgcagcatcgggtccatcaacggcttcgagatcgagagccacaagtgctactgctccctcttctgctgcccctactgccggcactgcagcgccgacggggagatccaccagctgcacctgtccatctgcaagaagcgcaagaccggcagcaacgtgatgctcgccgtctgcaagcggatgtgcttccgcgccacgatggaggtgtccaacaaggcgctgttcatccgcagcatcatcaacaccaccttcgtggtctgcatcctgatcctcgccgtgtgcgtggtctccaccagcgccgtggagatggagtccctgcccgccggcacgtgggagcgggaggaggacctgaccaacttctgccaccaggagtgccaggtgaccgagaccgagtgcctctgcccgtacgaggccctggtcctgcgccggcccctcttcctggacagcatcgtgaaggggatgaagaacctgctcaactccacgagcctggagaccagcctgtccatcgaggcgccctggggcgccatcaacgtgcagagcacctacaagccgaccgtctccacggccaacatcgccctcagctggtccagcgtggagcaccgcgggaacaaggtgctggtctccggccggagcgagtccatcatgaagctggaggagcgcaccgggatcagctgggacctcggcgtggaggacgcctccgagagcaagctgctgaccgtgtccgtcatggacctcagccagatgtactcccccgtgttcgagtacctgagcggcgaccgccaggtggaggagtggcccaaggcgacctgcacgggggactgccccgagcggtgcggctgcacctccagcacgtgcctgcacaaggagtggccgcactcccggaactggcgctgcaaccccacctggtgctggggcgtcgggaccggctgcacgtgctgcgggctcgacgtgaaggacctgttcaccgactacatgttcgtcaagtggaaggtggagtacatcaagaccgaggccatcgtgtgcgtcgagctgaccagccaggagcggcagtgcagcctcatcgaggccggcacccgcttcaacctggggtccgtgaccatcaccctgagcgagccccggaacatccagcagaagctgcccccggagatcatcaccctgcaccccaagatcgaggagggcttcttcgacctgatgcacgtgcagaaggtcctctccgccagcacggtgtgcaagctgcagtcctgcacccacggggtgcccggcgacctgcaggtctaccacatcggcaacctcctgaagggggaccgcgtgaacggccacctgatccacaagatcgagcagcacttcaacaccagctggatgtcctgggacgggtgcgacctcgactactactgcaacatgggcgactggcccagctgcacctacacgggggtgacccagcacaaccacgcctccttcgtcaacctgctgaacatcgagaccgactacaccaagacgttccacttccacagcaagcgggtgaccgcgcacggcgacaccccgcagctcgacctgaaggcccgccccacctacggcgccggggagatcacggtgctggtcgaggtggccgacatggagctccacaccaagaagatcgagatctccggcctgaagttcgcggggctgacctgcaccggctgctacgcctgcagctccgggatcagctgcaaggtgcggatccacgtcgaggagcccgacgagctcacggtgcacgtgaagtccgacgaccccgacgtcgtggccgccagctccagcctgatggcccgcaagctggagttcggcaccgactccaccttcaaggcgttcagcgccatgccgaagaccagcctctgcttctacatcgtggagcgggagtactgcaagtcctgcagcaaggaggacacgcagaagtgcgtcaacaccaagctggagcagccccagtccatcctgatcgagcacaagggcaccatcatcgggaagcagaacaacacgtgcaccgccaaggccagctgctggctcgagtccgtcaagagcttcttctacggcctgaagaacatgctcgggggcatcttcggcaacgtgttcatcgggatcttcaccttcctgacccccttcatcctgctgatcctgttcttcatgttcggctggcgcatcctcttctgcttcaagtgctgccggcgcacccgcgggctgttcaagtaccggcacctgaaggacgacgaggagacgggctaccgcaagatcatcgagcggctcaacaacaagaaggggaagaaccgcctgctggacggcgagcggctcgccgaccgcaagatcgcggagctgttctccaccaagacccacatcggctga

SEQ ID NO: 12006 - RNA, 5055 nt, synthetic construct
  misc_feature 1..5055: note = derived and/or modified CDS sequence (opt1) from CCHFV(75024)__AB069671.1__GP
  source 1..5055: mol_type = other RNA
atgcacatcagcctgatgtgcgccgtgctctgcctgcagctgtacgggctcggggagacccacgggtccagcaacgagaccgagcacaacaagaccaacgtggtgaccacccccggggactcccagagcccggagcccctggtgtccaccaccctgcccgtcaccctcgacagctccaccgtgacccccaccaccccggccagcggccccgaggggtccggcgaggtgtacacctccccgcccatcaccaccgagggcctgtccccgagcgaggccacctccgagctgcccgccaccaccgggatcggcatcagctccgccagcgacgtcgactccagcacccaggccgccggggacacctccacccccaccgtgcgcacctccccgcccaacagctccagcacgccgcccacctcccaggacacccaccaccccatgcggaacctcctgagcgtgacgtccctgaagcccgaggagaccagcgcgccctccaagagcggcaaggagtcccccgccgccagcagcccccacccggtcgccagccggccgcccacgccgcccaccacggcgcaggggcccatcgagaacaactcccacaacaccaccggccagctcgagagcgtgacccagtccgccacgctgggccccatggccagccccacccagaccgtgctgtcccagaacgtcaccagcatcgccatccaggacacgcacccctcccccaccaaccggagcaagcgcaacctcgagatggagatcatcctgaccctgccccaggggctcaagaagtactacggcaaggtgctgcggctgctccagctgaccctggaggaggacaccgaggggctcctggagtggtgcaagcgcaacctgggcctcgactgcgacgacacgttcttccagaagcggatcgaggagttcttcatcaccggcgaggggcacttcaacgaggtgctgcagttccgcaccccgggcaccctgagcacgaccgagtccacccacgccgagagccccaccgcggagcccttcaagtcctacttcgccaaggggttcctcagcatcgactccggctacttcagcgccaagtgctactcccggacgagcaactccgggctgcagctgatcaacgtcacccgccacagcacccggatcgccgacacccccggcccgaagatcacgaacctcaagaccatctcctgcatcaacctgaaggccagcgtgttcaaggagcaccgcgaggtggagatcaacgtcctgctcccccaggtggcggtgaacctgtccaactgccacgtcaccatcaagagccacgtgtgcgactactccctggacatcgacggcaccgtgcggctcccccacatccaccacgaggggacgttcatccccggcacctacaagatcgtcatcgacaagaagaacaagctgaacgaccgctgcaccctgttcaccaactgcgtgatcaaggggcgggaggtccgcaagggccagagcgtgctccggcagtacaagacggagatccgcatcgggaaggcctccaccggcagccggcgcctgctgagcgaggagtccggcgacgactgcatcagccggacccagctcctgcgcaccgagacggccgagatccacggggacaactacggcgggccgggcgacaagatcaccatctgcaacgggtccaccatcgtggaccagcgcctgggcagcgagatgggctgctacaccatcaaccgggtcaagtccttcaagctctgcgagaacagcgccacggggaagtcctgcgagatcgacagcatccccgtgaagtgccgccagggctactgcctgaagatcacccaggaggggcggggccacgtgaagctgtcccgcggcagcgaggtcgtgctggacgcctgcgactccagctgcgaggtgatgatccccaaggggaccggcgacatcctcgtcgactgctccgggggccagcagcacttcctgaaggacaacctgatcgacctcgggtgccccagcatcccgctgctgggcaagatggcgatctacatctgccggatgtccaaccaccccaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcacgatctgcgagaccacccccgccaacgccatcgacgcggagatgcacgacctcaactgctcctacaacatctgcccgtactgcgccagccgcctgacctccgacgggctggcccggcacgtcacccagtgccccaagcgcaaggagaaggtggaggagacggagctctacctgaacctggagcggatcccctgggtggtccgcaagctcctccaggtgagcgagagcaccggcgtggccctgaagcggtccagctggctcatcgtcctgctggtcctcttcgcgatctccctgagccccgtgcagtccgccccgatcgggcacggcaagaccatcgagacctaccaggcccgcgaggagtacacgagcatctgcctgttcgtcctcggctccatcctgttcatcgtgagctgcctgatgaaggggctcgtggactccatcggcaacatcttcttccccgggctgagcatctgcaagacctgctccatcggcagcatcaacgggttcgagatcgagtcccacaagtgctactgcagcctgctctgctgcccctactgccggcactgctccgccgaccgcgagatccaccagctgcacctgagcatctgcaagaagcggaagaccggctccaacgtcatgctcgccgtgtgcaagcgcatgtgcttccgggcgaccatggaggtgagcaacaaggccctgctgatccgctccatcatcaacacgaccttcgtcgtgtgcatcctcatcctggccgtgtgcgtcgtgagcaccagcgccgtggagatggagtccctgcccgccggcacctgggagcgcgaggaggacctcacgaacttctgccaccaggagtgccaggtcaccgagaccgagtgcctgtgcccgtacgaggcgctggtgctccggcgccccctgttcctggacagcatcgtgcgggggatgaagaaccagctcaactccaccagcctggagacgtccctgagcatcgaggccccctggggcgccatcaacgtccagtccacctacaagccgaccgtgagcaccgccaacatcgccctctcctggagctccgtggagcaccgcgggaacaagatcctggtcagcggccggtccgagagcatcatgaagctggaggagcgcacggggatctcctgggacctcggcgtggaggacgcgagcgagtccaagctgctgaccgtgagcgtcatggacctctcccagatgtacagccccgtgttcgagtacctgagcggcgaccgccaggtggaggagtggcccaaggcgacctgcaccggggactgccccgagcgctgcggctgcacgaccagcacgtgcctgcacaaggagtggccgcacagccggaactggcgctgcaaccccacctggtgctggggcgtgggcaccggctgcacgtgctgcgggctcgacgtgaaggacctgttcaccgactacatgatcgtgaagtggaaggtcgagtacatcaagaccgaggccatcgtgtgcgtggagctgacgtcccaggagcggcagtgcagcctcatcgaggccggcacccgcttcaacctggggtccgtcaccatcaccctgagcgagccccggaacatccagcagaagctcccgcccgagatcatcacgctgcacccccgcatcgaggagggcttcttcgacctgatgcacgtgcagaaggtcctctccgcgagcaccgtgtgcaagctgcagtcctgcacccacggggtgcccggcgacctgcaggtctaccacgtgggcaacctcctgaagggggacaaggtgaacggccacctgatccacaagatcgagccccacctcaacaccagctggatgtcctgggacgggtgcgacctggactactactgcaacatgggcgactggcccagctgcacctacacgggggtcacccagcacaaccacgcctccttcgtgaacctgctcaacatcgagaccgactacaccaagagcttccacttccactccaagcgggtgacggcccacggcgacacgccccagctggacctgaaggcccgccccacctacggcgccggggagatcaccgtcctcgtggaggtggcggacatggagttcacgcccaagaagatcgagatcagcggcctgaagttcgcctccctgacctgcaccgggtgctacgcctgcagctccggcatcagctgcaaggtccggatccacgtggacgagccggacgagctcaccgtgcacgtcaagagcgacgaccccgacgtggtggccgcctccagctccctgatggcgcgcaagctggagttcgggacggacagcaccttcaaggccttctccgccatgcccaagaccagcctctgcttctacatcgtcgagcgggagtactgcaagtcctgcagcaaggaggacacccagaagtgcgtgaacacgaagctggagcagccccagtccatcctgatcgagcacaagggcaccatcatcggcaagcagaacaacacgtgcaccgccaaggccagctgctggctcgagtccgtcaagagcttcttctacgggctgaagaacatgctgtccggcatcttcgggaacctcttcatgggcatcttcctgttcctggcgccgttcatcctgctcatcctgttcttcatgttcggctggcgcatcctgttctgcttcaagtgctgccggcgcacgcgcggcctcttcaagtaccggcacctgaaggacgacgaggagaccggctaccgccggatcatcgagcgcctgaacaacaagaaggggaagaacaagctcctggacggcgagcggctggccgaccgccggatcgccgagctgttcagcaccaagacccacatcgggtga

SEQ ID NO: 12007 - RNA, 5055 nt, synthetic construct
  misc_feature 1..5055: note = derived and/or modified CDS sequence (opt1) from CCHFV(7803)__AB069672.1__GP
  source 1..5055: mol_type = other RNA
atgcacatcagcctgatgtgcgccgtgctctgcctgcagctgtacgggctcggggagacccacggcagcagcaacgagaccgagcacaacaagaccaacgtggtgaccacccccggggactcccagagcccggagcccctggtgtccaccaccctgcccgtcaccctcgacagctccaccgtgacccccaccaccccggccagcgagcccgagggctccggggaggtgtacacctccccgcccatcaccaccgagggcctgtccccgagcgaggccacctccgagctgcccgtcaccaccggcatcgggatcagctccgccagcgacgtggactccagcacccaggccgccggcgacacctccacccccaccgtgcgcacgagcccgcccaacagcccctccacgccgcccaccagccaggacacccaccaccccatgcggaacctcctgtccgtcacgagcctgaagtccgaggagaccagcgccccctccaagagcgggaaggagtcccccgcggccagcagcccccacccggtggccagccggccgcccacccaccccatcaccgcccagggcccgacggagaacaactcccacaacaccaccgggcagctcgagagcgtgacccagtccgcgacgctgggccccatggccagccccacccagaccgtcctgtcccagaacgtgaccagcatcgccatccaggacacgcacccctccccgaccaaccggagcaagcgcaacctcgagatggagatcatcctgaccctgccccagggcctcaagaagtactacgggaaggtgctgcggctgctccagctgaccctggaggaggacaccgagggcctcctggagtggtgcaagcgcaacctggggctcgactgcgacgacacgttcttccagaagcggatcgaggagttcttcatcaccggcgagggccacttcaacgaggtcctgcagttccgcacccccgggaccctgagcacgaccgagtccacccacgccgagagcccgaccgccgagcccttcaagtcctacttcgcgaagggcttcctcagcatcgactccgggtacttcagcgccaagtgctactcccggacgagcgactccggcctgcagctgatcaacgtgacccgccacagcacccggatcgccgacacccccgggcccaagatcacgaacctcaagaccatctcctgcatcaacctgaaggccagcgtgttcaaggagcaccgcgaggtcgagatcaacgtgctgctcccccaggtggccgtcaacctgtccaactgccacgtgaccatcaagagccacgtgtgcgactactccctggacatcgacggcaccgtccggctcccccacatccaccacgagggcacgttcatccccgggacctacaagatcgtgatcgacaagaagaacaagctgaacgaccgctgcaccctgttcaccaactgcgtcatcaagggccgggaggtgcgcaaggggcagagcgtgctccggcagtacaagacggagatccgcatcggcaaggcgtccaccgggagccggcgcctgctgagcgaggagtccggcgacgactgcatcagccggacccagctcctgcgcaccgagacggccgagatccacggcgacaactacgggggccccggggacaagatcaccatctgcaacggctccaccatcgtcgaccagcgcctggggagcgagatgggctgctacaccatcaaccgggtgaagtccttcaagctctgcgagaacagcgccacgggcaagtcctgcgagatcgacagcatcccggtgaagtgccgccaggggtactgcctgaagatcacccaggagggccgggggcacgtcaagctgtcccgcggcagcgaggtgatcctggacgcctgcgactccagctgcgaggtgatgatccccaagggcaccggggacatcctcgtcgactgctccggcgggcagcagcacttcctgaaggacaacctgatcgacctcggctgccccagcatccccctgctggggaagatggccatctacatctgccggatgtccaaccacccgaagaccacgatggcgttcctcttctggttcagcttcggctacgtgatcacgtgcatcctgtgcaaggccatcttctacctgctcatcatcgtgggcaccctggggaagcgcttcaagcagtaccgggagctgaagccccagacctgcacgatctgcgagaccacccccgccaacgccatcgacgccgagatgcacgacctcaactgctcctacaacatctgcccctactgcgcgagccgcctgacctccgacggcctggcccggcacgtcacccagtgcccgaagcgcaaggagaaggtggaggagacggagctctacctgaacctggagcggatcccctgggtggtccgcaagctcctccaggtgagcgagagcaccggggtggccctgaagcggtccagctggctcatcgtcctgctggtcctgttcgccatctccctgagccccgtgcagtccgcgcccatcagccacggcaagaccatcgagacctaccaggcccgcgaggagtacacgtccatctgcctgttcgtcctcgggagcatcctgttcatcgtgtcctgcctgatgaagggcctcgtggacagcatcggcaacatcttcttcccggggctgtccatctgcaagacctgcagcatcggctccatcaacgggttcgagatcgagagccacaagtgctactgctccctgctctgctgcccctactgccggcactgcagcgccgaccgcgagatccaccagctgcacctgtccatctgcaagaagcggaagaccggcagcaacgtcatgctcgccgcctgcaagcgcatgtgcttccgggcgaccatggaggtgtccaacaaggccctgctgatccgcagcatcatcaacacgaccttcgtggtctacatcctcatcctggccgtgtgcgtggtcagcacctccgccgtggagatggagagcctgcccgccgggacctgggagcgcgaggaggacctcacgaacttctgccaccaggagtgccaggtgaccgagaccgagtgcctgtgcccctacgaggcgctggtcctccggcgcccgctgttcctggactccatcgtgcggggcatgaagaaccccctcaacagcacctccctggagacgagcctgtccatcgaggccccctggggcgccatcaacgtgcagagcacctacaagccgaccgtctccaccgccaacatcgccctcagctggtccagcgtggagcaccgcgggaacaagatcctggtgtccggccggagcgagtccatcatgaagctggaggagcgcacggggatcagctgggacctcggcgtcgaggacgcgtccgagagcaagctgctgaccgtgtccgtgatggacctcagccagatgtacagccccgtcttcgagtacctgtccggggaccgccaggtggaggagtggcccaaggcgacctgcaccggcgactgccccgagcgctgcggctgcacgacctccacgtgcctgcacaaggagtggccgcactcccggaactggcgctgcaaccccacctggtgctggggcgtgggcaccgggtgcacgtgctgcggcctcgacgtcaaggacctgttcaccgactacatgatcgtgaagtggaaggtggagtacatcaagacccggggcatcgtctgcgtggagctgacgagccaggagcgccagtgctccctcatcgaggccgggacccggttcaacctgggcagcgtgaccatcaccctgtccgagccccgcaacatccagcagaagctgccgcccgagatcatcacgctgcacccccggatcgaggaggggttcttcgacctgatgcacgtccagaaggtgctcagcgcctccaccgtctgcaagctgcagagctgcacccacggcgtgcccggggacctccaggtgtaccacgtcggcaacctcctgaagggcgacaaggtgaacgggcacctgatccacaagatcgagccccacctcaacacctcctggatgagctgggacggctgcgacctggactactactgcaacatgggggactggccctcctgcacctacacgggcgtgacccagcacaaccacgcgagcttcgtcaacctgctcaacatcgagaccgactacaccaagtccttccacttccacagcaagcgcgtgacggcccacggggacacgccccagctggacctgaaggcccggcccacctacggcgccggcgagatcaccgtgctcgtcgaggtggccgacatggagttcacgcccaagaagatcgagatctccgggctgaagttcgcgagcctgacctgcaccggctgctacgcctgctccagcgggatcagctgcaaggtgcgcatccacgtcgacgagccggacgagctcaccgtgcacgtgaagtccgacgaccccgacgtcgtggccgccagctccagcctgatggcccggaagctggagttcggcacggactccaccttcaaggcgttcagcgccatgcccaagacctccctctgcttctacatcgtggagcgcgagtactgcaagagctgctccaaggaggacacccagaagtgcgtcaacacgaagctggagcagccccagagcatcctgatcgagcacaaggggaccatcatcggcaagcagaacaacacgtgcaccgccaaggcctcctgctggctcgagagcgtgaagtccttcttctacggcctgaagaacatgctgagcgggatcttcggcaacttcttcatggggatcttcctcttcctggccccgttcatcctgctgatcctcttcttcatgttcggctggcggatcctgttctgcttcaagtgctgccgccgcacgcggggcctgttcaagtaccgccacctcaaggacgacgaggagaccgggtaccggcgcatcatcgagcggctgaacaacaagaagggcaagaacaagctgctcgacggggagcgcctggcggaccggcgcatcgccgagctgttctccaccaagacccacatcggctga

SEQ ID NO: 12008 - RNA, 5055 nt, synthetic construct
  misc_feature 1..5055: note = derived and/or modified CDS sequence (opt1) from CCHFV(Hodzha)__AY223476.1__GP
  source 1..5055: mol_type = other RNA
atgcacatcctgctcatgtgcgccgtgctgtgcctgcagcagtacggcctcggggagacccaccgccccaacaacggcaccgagcacaacaagaccaacgtcctgaccacccccggggacaagctgtcccccgagctccccgtgtccaccgccctgtccgtgacccccgactccagcaccgtcacccccaccacccccgtgtccggcctggaggggagcggcgacgtgtacaccagcccgcccgtcaccaccaagggcctcagcccgtccaaggccaccagcgagctgcccgcctccagcgggatcgacacctccagcgcctccgacgtggacagctccacccaggccgcccgggacaccagcacgctgaccgtgcgcaccagcccgcccagcagcccgtccacgccgcccacgagccaggacacctaccacctcgtccggaacctgctgtccgtgaccagcccctggccggaggagaccacggcgccctccaagagcggcaaggagtcccccgtggccaacagcccccacccggtcacctcccgccccagcagcccgcccatcaccgtgcaggggccgaccgagaacagctcccacaacacgaccggccagctcgagagcatggcccagtccaccaccctggtgcccatggccagccccacgcagaccgtcctgtcccagagcgtgacctccctcgcggtgcaggacgcccaccccagcccgaccaaccggagcaagcgcaacctggagatggtcatcatcctgacgctcccccaggggctgaagaagtactacggcaaggtgctgcggctcctgcagctgaccctcgaggaggacaccgagggcctgctggagtggtgcaagcgcaacctcgggctggactgcgacgacaccttcttccagaagcggatcgaggagttcttcatcaccggcgaggggcacttcaacgaggtgctgcagttcaagacgccctccaccctcagcaccaccgagtccacgcacgccgtcagcccgaccgccgagcccttcaagtcctacttcgccaagggcttcctgagcatcgactccggctacttcagcgcgaagtgctactccaagaccagcaactccgggctgcagctcatcaacgtgacccgccacagcacgcggatcgccgacacccccggccccaagatcaccaacctgaagaccatctcctgcatcaacctgaaggccagcgtgttcaaggagcaccgcgaggtcgagatcaacgtgctcctgccgcaggtcgccgtgaacctgtccaactgccacgtgacgatcaagagccacgtctgcgactactccctcgacgtggacgggaccgtgcggctgccccacatccaccacggcgggaccttcatccccggcacctacaagatcgtcatcgacaagaagaacaagctgaacgaccgctgcacgctctacaccaactgcgtgatcaagggccgggaggtgcgcaaggggcagagcatcctgcggcagtacaagaccgagatccgcatcggcaaggccagcaccgggtcccggcgcctgctcagcgaggagtccggcgacgactgcatcagccggacgcagctgctgcgcaccgagaccgcggagatccacggggacgactacggcggccccggggacaagatcaccatctgcaacggctccacgatcgtcgaccagcgcctggggagcgagctcggctgctacaccatcaaccgggtgaagtccttcaagctgtgcaagaacagcgccaccgggaagtcctgcgagatcgacagcaccccggtgaagtgccgccagggctactgcctgaagatcacgcaggagggccgggggcacgtcaagctctcccgcggcagcgaggtggtgctggacgcctgcgactccagctgcgaggtcatgatccccaaggggaccggcgacatcctggtggactgctccggcgggcagcagcacttcctcaaggacaacctgatcgacctgggctgcccccggatccccctcctggggaagatggccatctacatctgccgcatgagcaaccacccgaagaccaccatggccttcctgttctggttctccttcggctacgtgatcacgtgcatcctctgcaaggcgatcttctacctgctgatcatcgtcgggaccctcggcaagcggttcaagcagtaccgcgagctgaagccccagacctgcaccatctgcgagacgacccccgccaacgccatcgacgccgagatgcacgacctgaactgcagctacaacatctgcccctactgcgcctcccggctcaccagcgacggcctggcgcgccacgtgacccagtgcccgaagcggaaggagaaggtggaggagaccgagctgtacctcaacctggagcgcatcccctggatcgtccggaagctgctccaggtgagcgagtccacgggggtggccctgaagcgcagctcctggctgatcgtcctcctggtgctgttcgccgtgagcctctcccccgtccagagcgcccccatcggccacgggaagaccatcgagacctaccaggcgcgggaggactacacctccatctgcctgttcgtgctgggcagcatcctcttcatcgtgtcctgcctgatgaaggggctggtcgacagcatcggcaacatcttcttcccgggcctcacgatctgcaagacctgctccatcgggagcatcaacggcttcgagatcgagtcccacaagtgctactgcagcctgctgtgctgcccctactgccgccactgctccgccgaccgggagatccaccagctccacctgagcatctgcaagaagcgcaagaccgggtccaacgtgatgctggccgtgtgcaagcggatgtgcttccgcgccaccatggaggtcagcaacaaggccctcctgatccgctccatcatcaacacgaccttcgtggtgtgcatcctgatcctcgcggtctgcgtggtgagcaccagcgccgtcgagatggagtccctgcccgccggcacctgggagcgggaggaggacctgacgaacttctgccaccaggagtgccaggtgaccgagaccgagtgcctctgcccctacgaggccctggtgctgcgccggcccctgttcctggacagcatcgtcaaggggaccaagaacctgctcaactccacgagcctggagacctccctgagcatcgaggccccctggggcgcgatcaacgtgcagtccacctacaagcccaccgtgagcacggccaacatcgccctctcctggagctccgtcgagcaccgcggcaacaagatcctggtgagcgggcggtccgagagcatcatgaagctggaggagcgcaccggcatctcctgggacctcggggtggaggacgccagcgagtccaagctgctgaccgtcagcgtgatggacctctcccagatgtacagcccggtgttcgagtacctgagcggcgaccggcaggtcgaggagtggcccaaggcgacctgcacgggggactgccccgagcgctgcggctgcacctccagcacgtgcctgcacaaggagtggccccactcccggaactggcgctgcaacccgacctggtgctggggcgtggggaccggctgcacgtgctgcgggctcgacgtcaaggacctgttcaccgactacatgttcgtgaagtggaaggtggactacatcaagaccgaggcgatcgtctgcgtggagctgacgagccaggagcggcagtgctccctcgtggaggccggcacccgcttcaacctgggccccgtcaccatcaccctgagcgagccccggaacatccagcagaagctcccgcccgagatcatcacgctgcacccccgcatcgaggaggggttcttcgacctgatgcacgtgcagaaggtgctctccgccagcaccgtctgcaagctgcagtcctgcacccacggcgtgcccggggacctccaggtgtaccacatcggcaacctcctgaagggggacaaggtcaacggccacctgatccacaagatcgagccccacttcaacaccagctggatgtcctgggacggctgcgacctcgactactactgcaacatgggggactggcccagctgcacctacacgggcgtgacccagcacaaccacgcctccttcgtgaacctgctgaacatcgagaccgactacaccaagagcttccacttccactccaagcgggtcacggcgcacggggacacgccccagctcgacctgaaggcccgccccacctacggcgccggggagatcaccgtgctggtggaggtcgccgacatggagctccacacgaagaagatcgagatcaccggcctgaagttcgccagcctgacctgcaccggctgctacgcgtgctccagcgggatctcctgcaaggtgcggatccacgtggacgagcccgacgagctcacggtccacgtgaagtccgacgacccggacgtggtcgccgccagctccagcctgatggcccgcaagctggagttcggcaccgactccaccttcaaggccttcagcgcgatgcccaagacctccctctgcttctacatcgtggagcgggagtactgcaagagctgctccaaggaggacacgcagaagtgcgtgaacaccaagctggagcagccccagagcatcctgatcgagcgcaaggggaccatcatcggcaagcagaacaacacgtgcacggccaaggcctcctgctggctggagagcgtcaagtccttcttctacgggctcaagaacatgctgagcggcatcttcggcaacgtgttcgtggggatcttcctgttcctcgcccccttcatcctgctgatcctcttcttcatgttcggctggcggatcctgttctgcttcaagtgctgccgccgcacccgggggctgttcaagtacaagcacctcaaggacgacgaggagaccggctaccgccggatcatcgagcgcctgaacaacaagaagggcaagaacaagctgctcgacggggagcggctggccgaccgccggatcgcggagctgttctccaccaagacgcacatcggctga

SEQ ID NO: 12009 - RNA, 5055 nt, synthetic construct
  misc_feature 1..5055: note = derived and/or modified CDS sequence (opt1) from CCHFV(Hodzha)__KX013448.1__GP
  source 1..5055: mol_type = other RNA
atgcacatcctgctcatgtgcgccgtgctgtgcctgcagcagtacggcctcggggagacccaccgccccaacaacggcaccgagcacaacaagacgaacgtcctgaccaccccgagcgacaagctgtcccccgagccgcccgtgagcaccgccctctccgtgacgcccgacagctccaccgtcacccccaccacgcccgtgagcgggctggagggctccggggaggtgtacaccagcccgcccgtcaccaccaagggcctgtcccccagcaaggcgacgtccgagctccccgccaccaccggcatcgacaccagctccgccagcgacgtggactccagcacgcaggccgcccgggacacctccaccctgaccgtgcgcacgagcccgccctccagccccagcaccccgcccacctcccaggacacctaccacctggtccggaacctcctgagcgtgacgagcccccgccccgaggagaccaccgcgccctccaagtccgggaaggagagccccgtggccaactccccgcaccccgtcaccagccggccctccagcccgcccatcacggtgcagggccccaccgagaactccagccacaacaccaccgggcagctggagtccatggcccagagcacgaccctcgtgcccatggcctcccccacccagaccgtcctgagccagtccgtgacgagcctggcggtgcaggacgcccacccgtcccccaccaaccgcagcaagcggaacctcgagatggagatcatcctgaccctgccccagggcctcaagaagtactacgggaaggtcctgcgcctgctccagctgaccctggaggaggacaccgagggcctcctggagtggtgcaagcggaacctgggcctcgactgcgacgacacgttcttccagaagcgcatcgaggagttcttcatcaccggggagggccacttcaacgaggtgctgcagttcaagaccccgagcaccctgtccacgaccgagagcacccacgccgtgtcccccaccgccgagcccttcaagagctacttcgccaaggggttcctctccatcgacagcggctacttctccgcgaagtgctacagcaagacgtccaacagcggcctgcagctgatcaacgtcacccggcactccacccgcatcgccgacacccccgggccgaagatcacgaacctcaagaccatcagctgcatcaacctgaaggcctccgtgttcaaggagcaccgggaggtggagatcaacgtcctgctcccccaggtggccgtcaacctgagcaactgccacgtgaccatcaagtcccacgtgtgcgactacagcctggacgtcgacggcaccgtgcgcctcccccacatccaccacgggggcacgttcatccccgggacctacaagatcgtgatcgacaagaagaacaagctgaacgaccggtgcaccctgtacaccaactgcgtcatcaagggccgcgaggtgcggaagggccagtccatcctccgccagtacaagacggagatccggatcgggaaggccagcaccggcagccgccggctgctgtccgaggagagcggggacgactgcatctcccgcacccagctcctgcgcaccgagacggcggagatccacggcgacgactacgggggcccgggcgacaagatcaccatctgcaacgggagcaccatcgtggaccagcggctgggctccgagctggggtgctacaccatcaaccgcgtcaagagcttcaagctctgcgagaactccgccacgggcaagagctgcgagatcgactccacccccgtgaagtgccggcaggggtactgcctgaagatcacccaggagggccgcggccacgtgaagctgagccgggggtccgaggtcgtgctcgacgcctgcgacagctcctgcgaggtgatgatccccaagggcaccggggacatcctggtcgactgcagcggcggccagcagcacttcctgaaggacaacctcatcgacctggggtgcccccgcatcccgctgctcggcaagatggccatctacatctgccggatgtccaaccaccccgagacgaccatggccttcctgttctggttcagcttcgggtacgtgatcacgtgcatcctgtgcaaggcgatcttctacctcctgatcatcgtgggcaccctggggaagcgcttcaagcagtaccgggagctcaagccccagacctgcaccatctgcgagaccacccccgccaacgccatcgacgccgagatgcacgacctgaactgctcctacaacatctgcccgtactgcgccagccgcctgacctccgacggcctcgcgcggcacgtcacgcagtgccccaagcgcaaggagaaggtggaggagaccgagctgtacctgaacctcgagcggatcccctggatcgtgcgcaagctgctgcaggtcagcgagagcaccggcgtggccctcaagcggtccagctggctgatcgtgctgctcgtcctgttcgccgtgtccctgagccccgtgcagtccgccccgatcgggcacggcaagaccatcgagacgtaccaggcgcgcgaggagtacaccagcatctgcctcttcgtcctggggtccatcctgttcatcgtgagctgcctcatgaagggcctggtggactccatcgggaacatcttcttccccggcctgaccatctgcaagacctgcagcatcggctccatcaacgggttcgagatcgagagccacaagtgctactgctccctcctgtgctgcccctactgccggcactgccccgccgaccgcgagatccaccagctgcacctcagcatctgcaagaagcggaagacgggctccaacgtcatgctggccgtgtgcaagcgcatgtgcttccgcgccaccatggaggtgagcaacaaggccctgctcatccggtccatcatcaacaccaccttcgtcgtgtgcatcctgatcctggcggtgtgcgtcgtgagcacgtccgccgtggagatggagagcctcccggccgggacctgggagcgcgaggaggacctgaccaacttctgccaccaggagtgccaggtcaccgagacggagtgcctgtgcccctacgaggccctcgtgctgcggcgccccctgttcctcgacagcatcgtgaagggcaagaagaacctgctgaactccaccagcctcgagacctccctgagcatcgaggccccgtggggcgcgatcaacgtccagtccacctacaagcccacggtgagcaccgccaacatcgccctgtcctggagctccgtggagcaccgggggaacaagatcctcgtcagcggccgctccgagagcatcatgaagctggaggagcggaccgggatctcctgggacctgggcgtggaggacgccagcgagtccaagctcctgaccgtgagcgtcatggacctgtcccagatgtacagccccgtgttcgagtacctctccggggaccgccaggtggaggagtggcccaaggccacgtgcaccggcgactgcagcgagcggtgcgggtgcaccagctccacgtgcctgcacaaggagtggccgcacagccgcaactggcggtgcaaccccacctggtgctggggcgtcggcaccgggtgcacgtgctgcggcctggacgtgaaggacctcttcaccgactacatgttcgtcaagtggaaggtggactacatcaagaccgaggcgatcgtgtgcgtcgagctgacctcccaggagcgccagtgcagcctggtggaggccgggacccggttcaacctcggccccgtgaccatcacgctgtccgagccccgcaacatccagcagaagctgccgcccgagatcatcaccctccacccccggatcgaggagggcttcttcgacctgatgcacgtccagaaggtgctgagcgcctccaccgtgtgcaagctccagagctgcacccacggggtccccggcgacctccaggtgtaccacatcgggaacctgctgaagggcgacaaggtgaacgggcacctgatccacaagatcgagccgcacttcaacacctcctggatgagctgggacggctgcgacctggactactactgcaacatgggcgactggccctcctgcacgtacaccggggtcacccagcacaaccacgccagcttcgtgaacctcctgaacatcgagaccgactacacgaagtccttccacttccacagcaagcgcgtgaccgcgcacggcgacacgccccagctggacctcaaggcccggcccacctacggggccggcgagatcaccgtcctggtggaggtggccgacatggagctgcacaccaagaagatcgagatcaccgggctcaagttcgcctccctgacctgcacgggctgctacgcgtgcagctccggcatcagctgcaaggtccgcatccacgtggacgagccggacgagctgaccgtgcacgtcaagtccgacgaccccgacgtggtggccgccagcagctccctcatggcccggaagctggagttcgggaccgacagcaccttcaaggccttctccgcgatgcccaagacgagcctgtgcttctacatcgtcgagcgcgagtactgcaagtcctgcagcaaggaggacacccagaagtgcgtgaacaccaagctcgagcagccccagtccatcctgatcgagcagaagggcaccatcatcgggaagcagaacaacacgtgcaccgccaaggccagctgctggctggagtccgtcaagagcttcttctacggcctgaagaacatgctctccgggatcttcggcaacgtgttcgtgggcatcttcctgttcctggccccgttcatcctcctgatcctgttcttcatgttcgggtggcggatcctcttctgcttcaagtgctgccgccgcacccggggcctgttcaagtacaagcacctgaaggacgacgaggagaccgggtaccgccggatcatcgagcgcctcaacaacaagaagggcaagaacaagctgctggacggcgagcggctcgccgaccgccggatcgcggagctgttcagcacgaagacccacatcgggtga

SEQ ID NO: 12010 - RNA, 5055 nt, synthetic construct
  misc_feature 1..5055: note = derived and/or modified CDS sequence (opt1) from CCHFV(Baghdad 12)__AJ538197.2__GP
  source 1..5055: mol_type = other RNA
atgcacatcagcctgatctacgccgtgctctgcctgcagctgtacggcctcggggagacccacggctccagctccgggaccgagcacaaccgcacgaacgtcgtggccacccccggcgggagccagtccccggagcccctggtgagcaccaccctgcccgtcacgctcgactccagcaccgtgacccccgcgacccaggcctccggcccggagggcagcggggaggtgtacacgtccccccccaccaccaccgagggcctgagcccctccgacgccacgagcgagctgccgaccaccaccgggatcggcatctccagctccagcgacgtcaactccagcacgcaggccgccggggacaccagcacccccaccgcgcggacgtccctccccgacagcccctccaccccgcccaccagccaggacacccaccaccccatgcgcaacctgctgtccgtgacgagcctcaagcccgaggagaccccggccccctccaagagcggcaaggagtcccccgccgccagctccccccacccggtggcgagccggccccccaccccctccaccacggcccagggcccgaccgagaacaacagccgcaacaccaccgtccagctgaagtccgtgacgcagagcgccaccctggggcccatggcctcccccacccagaccgtgctcctgcagagcgtcacgtccatcgccatccaggacacccaccccagcccgaccaaccggagccgccggaacctggagatggagatcatcctcaccctgccccagggcctgaagaagtactacgggaaggtgctccgcctgctgcagctcaccctggaggaggacacggagggcctgctcgagtggtgcaagcggaacctgggcctggactgcgacgacaccttcttccagaagcgcatcgaggagttcttcatcaccggggagggccacttcaacgaggtgctccagttccggacccccgggacgctgtccaccaccgagagcacccacgcgggctccccgacggtcgagcccttcaagagctacttcgccaaggggttcctgctcatcgactccggctacttcagcgccaagtgctactcccgcaccagcaactccggcctgcagctgatcaacgtgacccggcacagcaccaagatcgccgacacgcccgggcccaagatcaccaacctcaagaccatctcctgcatcaacctgaaggccagcatcttcaaggagcaccgcgagatcgagatcaacgtgctgctcccgcaggtcgcggtgaacctgtccaactgccacgtgaccatcaagagccacgtctgcgactactccctgaacatcgacggcacggtgaagctcccccacatccaccacgaggggatcttcatccccggcacctacaagatcgtgatcgacaagaagaacaagctgaacgaccggtgcaccctgttcaccaactgcgtcatcaaggggcgcgaggtgcggaagggccagagcgtcctccgccagtacaagacggagatccggatcggcaaggcctccaccgggagccgccggctgctgagcgaggagtccggcgacgactgcatcagccgcacccgcctcctgcggaccgagacggccgagatccacggggactcctacggcgggcccggcgacaagatcaccatctgcaacggcagcaccatcgtggaccagcgcctggggtccgagatgggctgctacaccatcaaccgggtgaagagcttcaagctgtgcgagaactccgccacggggaagagctgcaagatcgactccatcccggtcaagtgccgccagggctactgcctcaagatcacccaggagggccgggggcacgtgaagctgagccgcggctccgaggtggtcctggacgcctgcgacagctcctgcgaggtgatgatccccaaggggaccggcgacatcctcgtggactgcagcgggggccagcagcacttcctgaaggacaacctgatcgacctcggctgccccaacatccccctgctggggaagatggcgatctacatctgccggatgtccaaccacccgaagaccacgatggccttcctcttctggttcagcttcggctacgtcatcacctgcatcctgtgcaaggccatcttctacctgctcatcatcgtggggaccctgggcaagcgcttcaagcagtaccgggagctgaagccccagacctgcacgatctgcgagaccacccccgtgaacgccatcgacgccgagatgcacgacctcaactgctcctacaacatctgcccctactgcgcgagccgcctgacctccgacgggctggcccggcacgtcacccagtgcccgaagcgcaaggagaaggtggaggagacggagctctacctgaacctggagcggatcccctgggtggtccgcaagctcctgcaggtgagcgagagcaccggcgtggccctgaagcggtccagctggctcatcgtcctgctggtgctcctggccgtgtccagctcccccgtccagagcgcgcccatcggctacgggaagaccatcgagacctaccaggcccgcgagggctacacgtccatctgcctgttcgtgctcgggagcatcctgttcatcgtgtcctgcctgaccaagggcctcgtcgacagcatcgggaacatcttcttcccgggcctgtccatctgcaagacctgcagcatcggctccatcaacgggttcgaggtggagagccacaagtgctactgctccctgctctgctgcccctactgccggcactgcagcgccgaccgcgagatccaccagctgcacctgtccatctgcaagaagcggaagaccggcagctccgtgatgctcgccgtctgcaagcgcatgtgcttccgcgccacgatggaggtgagcaacaaggcgctgctgatccggagcatcatcaacaccaccttcgtggtctgcatcctcaccctggccgtgtgcgtggtctccacgagcgccgtggagatggagtccctgcccgccgggacctgggagcgcgaggaggacctcaccaacttctgccaccaggagtgccaggtgaccgagacggagtgcctgtgcccctacgaggccctggtcctccggaagccgctgttcctggacagcatcgtgaagggcaccaagaacctcctgaactccaccagcctggagacctccctcagcatcgaggcgccctggggggccatcaacgtgcagtccacgtacaagcccaccgtcagcaccgccaacatcgccctgtcctggagctccgtggagcaccgcggcaacaagatcctggtgagcggccggtccgagagcatcatgaagctcgaggagcgcaccgggatctcctgggacctgggcgtcgaggacgccagcgagtccaagctgctcacggtgagcgtgatggacctgagccagatgtactccccggtcttcgagtacctgagcggggaccggcaggtggaggagtggcccaaggcgacctgcaccggcgactgccccgagcgctgcggctgcaccacgtccacctgcctccacaaggagtggccccacagccggaactggcgctgcaacccgacctggtgctggggggtgggcaccgggtgcacgtgctgcggcctggacgtcaaggacctgttcaccgactacatgttcgtgaagtggaaggtggagtacatcaagaccgacgccatcgtctgcgtggagctcacctcccaggagcggcagtgcagcctgatcgaggccgggacgcgcttcaacctgggctccgtcaccatcaccctcagcgagccccggaacatccagcagaagctgccccccgagatcatcaccctgcacccgcgcatcgaggagggcttcttcgacctcatgcacgtgcagaaggtgctgtccgccagcaccgtctgcaagctgcagtcctgcacgcacggggtgcccggcgacctccaggtgtaccacatcgggaacctgctgaagggcgacaaggtcaacgggcacctcatccacaagatcgagccccacttcaacaccagctggatgtcctgggacggctgcgacctggactactactgcaacatgggcgactggcccagctgcacctacaccggggtgacgcagcacaaccacgcgtccttcgtgaacctgctcaacatcgagaccgactacaccaagagcttccacttccactccaagcgggtcaccgcccacggcgacacgccgcagctggacctgaaggtgcgccccacctacggggccggcgagatcaccgtgctcgtcgaggtggccgacatggagctgcacaccaagaagatcgagatcagcgggctgaagttcgcctccctcacgtgcaccggctgctacgcgtgcagcagcggcatctcctgcaaggtgcggatccacgtcgacgagcccgacgagctgaccgtgcacgtgaagagcgacgaccccgacgtcgtggccgcctccagctccctgatggcccgcaagctcgagttcgggaccgacagcacgttcaaggccttctccgcgatgccgaagaccagcctgtgcttctacatcgtggagcgggagtactgcaagtcctgcagcaaggaggacacccagaagtgcgtcaacaccaagctggagcagccccagtccatcctcatcgagcacaagggcacgatcatcgggaagcagaacaacacctgcaccgccaagaccagctgctggctggagtccgtgaagagcttcttctacggcctgaagaacatgctgtccggcatcttcgggaacttcttcatgggcatcttcctcttcctggcccccttcatcctgctcatcctgttcttcatgttcgggtggcgcatcctgttctgcttcaagtgctgccggcgcacgcgcggcctcttcaagtaccggcacctgaaggacgacgaggagaccgggtaccgccggatcatcgagcgcctgaacaacaagaagggcaagaacaagctcctggacggcgagcggctggccgaccgccggatcgccgagctcttcagcaccaagacccacatcgggtga

SEQ ID NO: 12011 - RNA, 5055 nt, synthetic construct
  misc_feature 1..5055: note = derived and/or modified CDS sequence (opt1) from CCHFV(TADJ/HU8966 )__AY179962.1__GP
  source 1..5055: mol_type = other RNA
atgcacatgctgctcatgtgcgccgtgctgtgcctgcagctctacggcctcgggggcaccctgcgcagcaacaacgggaccgagcacaacaagacgaacgtcctcaccacccccggcgacaagctgtccccggagccgcccgtgagcaccgccctgcccgtgacgccggactccagcaccgtcacccccaccacgcccgcgtccgggctcgagggcagcggcgaggtgtacaccagcccgcccatcaccaccaaggggctgtccccctccgaggccacgagcgagccgcccgccaccaccggcatggggatctccagcgcctccggcgtggacttcagcacccaggccgcgcgggacacgtccaccctgaccgtcctcaccagcccgcccaactcccccaacacgcccccgaccagccaggacacccaccaccccgtgcgctccctgctgagcgtgaccagcccccggcccgaggagacgaccgccccgtccaagagcgggaaggagtcccccgccgccaacagctcccaccccgtcaccagccgcccctccagcccgctcatcaccgtgcggggccccacggagaactccagccacaacaccaccggccagctggagtccatgacccagagcacgaccctggtgcccatggcgtcccccacccagaccgtcctcagccagtccgtgacgagcatcgccgtgcaggacgcccacccgtccagcaccaaccgctccaagcggaacctggagatggagatcatcctgaccctcccccaggggctgaagaagtactacggcaaggtcctgcgcctcctgcagctgaccctcgaggaggacaccgaggggctgctggagtggtgcaagcggaacctcggcctggactgcgacgacacgttcttccagaagcgcatcgaggagttcttcatcaccggcgaggggcacttcaacgaggtgctgcagttccggacccccggcaccctcagcacgaccgagagcacccacgccgggtccccgaccgccgagcccttcaagagctacttcgcgaagggcttcctgtccatcgacagcgggtacttctccgccaagtgctacagccgcacgtccaacagcggcctgcggctcatcaacgtgacccgccactccacccggatcgccgacacccccggccccaagatcacgaacctgaagaccatcagctgcatcaacctgcgcgcctccatcttcaaggagcaccgggaggtcgagatcaacgtgctcctgccccaggtggccgtcaacctgagcaactgccacgtggcgatcaagtcccacgtgtgcgactacagcctcgacgtcgacgggaccgtgcgcctgccccacatccaccacggcgggaccttcatccccggcacgtacaagatcgtcatcgacaagaagaacaagctgaacgaccggtgcaccctcttcaccaactgcgtgatcaaggggcgcgaggtgcggaagggccagtccatcctgcgccagtacaagaccgagatccgcatcggcaaggccagcacggggtcccggcgcctgctcagcgaggagagcggcgacgactgcatctcccggacccagctgctgcgcaccgagaccgccgagatccacggggacgactacggcgggcccggcgacaagatcacgatctgcaacggcagcaccatcgtcgaccagcggctggggtccgagctcggctgctacaccatcaaccgcgtcaagagcttcaagctgtgcgagaactccgccaccgggaagaactgcgagatcgacagcgtgcccgtgaagtgccggcagggctactgcctgaagatcacgcaggagggccgcgggcacgtgaagctctcccggggcagcgaggtggtcctggacgcctgcgactccagctgcgaggtgatgatccccaaggggaccggcgacatctccgtggactgcagcgggggccagcagcacttcctgaaggacaacctcatcgacctgggctgccccaagatccccctgctcgggaagatggcgatctacatctgccgcatgtccaaccacccgaagaccaccatggccttcctgttctggttcagcttcggctacgtcatcacgcggatcctgtgcaaggccatcttctacctcctgatcatcgtggggaccctgggcaagcgcttcaagcagtaccgggagctcaagccccagacctgcaccatctgcgagacgacccccgccaacgccatcgacgcggagatgcacgacctgaactgctcctacaacatctgcccctactgcgccagccgcctgacctccgacgggctcgcccggcacgtgacccagtgcccgaagcgcaaggagcgggtcgaggagaccgagctgtacctgaacctcgagcgcatcccctggatcgtgcggaagctgctccaggtgagcgagtccacgggcgtcgccctgaagcgcagcagctggctgatcgtgctgctcgtgctgttcaccgtctccctgagccccgtgcagtccgcgcccatcggctacgggaacaccatcgagacctaccaggcccgcgaggagtacacgagcatctgcctcttcgtgctgggctccatcctgttcatcgtcagctgcctcatgaaggggctggtggactccatcggcaacatcttcttcccggggctgaccatctgcaagacctgcagcatcggctccatcaacggcttcgagatcgagagccacaagtgctactgctccctcctgtgctgcccctactgccggcactgcagcgccgaccgcgagatccaccagctgcacctctccatctgcaagaagcggaagaccgggagcaacgtgatgctggccgtctgcaagcgcatgtgcttccgggccacgatggaggtgtccaacaaggcgctgctcatccgcagcatcatcaacaccaccttcgtggtctgcatcctgatcctggccgtgtgcatcgtgtccaccagcgccgtcgagatggagtccctccccgccggcacgtgggagcgggaggaggacctgaccaacttctgccaccaggagtgccaggtgaccgagaccgagtgcctgtgcccctacgaggccctcgtgctgcgccggccgctgttcctcgacagcatcgtcaaggggatgaagaaccccctgaacagcacgtccctggagaccagcctctccatcgaggcgccctggggcgccatcaacgtgcagagcacctacaagccgaccgtgtccacggccaacatcgccctgagctggtccagcatcgagcaccgcgggaacaacatcctggtctccggccggagcgagtccatcatgaagctcgaggagcgcaccggcatcagcggggacctgggcgtggaggacgcctccgagagcaagctgctcaccgtgtccgtcatggacctgagccagatgtactcccccgtgttcgagtacctgagcggggaccgccaggtggaggagtggcccaaggcgacctgcacgggcgactgccccgagcggtgcggctgcacctccagcacgtgcctccacaaggagtggccgcacagccggaactggcgctgcaaccccacctggtgctggggcgtcgggaccgggtgcacgtgctgcggcctggacgtgaaggacctgttcatcgactacatgttcgtgaagtggaaggtcgactacatcaagaccgaggccatcgtgtgcgtggagctcacctcccaggagcggcagtgcagcctggtcgaggccgggacccgcttcaacctgggccccgtgaccatcaccctctccgagccccggaacatccagcagaagctgccgcccgagatcatcaccctgcacccccgcatcgaggagggcttcttcgacctcatgcacgtccagaaggtgctgagcgcctccacggtgtgcaagctgcagagctgcacccacggggtccccggcgacctccaggtgtaccacatcgggaacctgctgaagggcgacaaggagaacgggcacctcatccacaagatcgagccgcacttcaacacctcctggatgagctgggacggctgcgacctggactactactgcaacatgggcgactggccctcctgcacctacaccggggtgacgcagcacaaccacgcgagcttcgtcaacctgctcaacatcgagaccgactacaccaagtccttccacttccacagcaagcgggtgaccgcccacggcgacacgccccagctggacctgaaggcccgccccacctacggggccggcgagatcaccgtgctcgtcgaggtggccgacatggagctgcacaccaagaagatcgagatcacggggctgaagttcgcgtccctgacctgcaccggctgctacgcctgcagctccggcatcagctgcaaggtgcgcatccacgtcgacgagccggacgagctgaccgtgcacgtgaagtccgacgaccccgacgtcgtggccgccagctccagcctgatggcccggaagctcgagttcgggacggacagcaccttcaaggcgttctccgccatgcccaagaccagcctgtgcttctacatcgtggagcgcgagtaccggaagtcctgcagcaaggaggacacccagaagtgcgtcaacacgaagctggagcagccccagtccatcctcatcgagcacaagggcaccatcatcgggaagcagaacaacacgtgcaccgccaaggccagctgctggctggagtccgtcaagagcttcttctacggcctgaagaacatgctgtccggcatcttcgggaacgtgttcgtgggcatcttcctcttcctggccccgttcatcctgctcatcctgttcttcatgttcgggtggcgcatcctgagctgcttcaagtgctgccggcgcacccggggcctcctgaagcaccgccacctgaaggacgacgaggagaccgggtaccggcgcatcatcgagcggctcaacaacaagaagggcaagaacaagctgctggacggcgagcgcctcgcggaccggcgcatcgccgagctgttctccaccaagacccacatcgggtga

SEQ ID NO: 12012 - RNA, 5055 nt, synthetic construct
  misc_feature 1..5055: note = derived and/or modified CDS sequence (opt1) from CCHFV(K168_40)__KX013457.1__GP
  source 1..5055: mol_type = other RNA
atgcacatcagcctgatgtgcgccgtgctctgcctgcagctgtacggcctcgggggcacccacgggctgcacaacggcaccgagcacaacaagacgaacgccgtcaccacctccagcaactcccagagctccgagagccccgcgcgcaccgccccgcccgtgacgcccgactcccccaccgtgaccccgaccacgcccgccagcgcccccgaggggtccggcgaggcccacagctcccccccgaacaacaccgagggccccagcctgcccgagtccaccagcgagcccccggcggccacctccacggggatccccagcgcctccgacgtcaacagctccacccaggccgcgcgggacaccagcacccccacggtgcgcaccagccccccgaactcccccagcaccccccccaccccgcaggagacgcaccaccccgtgcggaacctcctgtccgtcaccagccacaagcccgaggagacctccgcccccagcgagtccggcaaggagagcccggccgccaactccccccaccccgtggccagccgccccccgaccccctccacgaccgcgcaggggcccaccgagaacaacaactacaacaccacgggccagctggagagcctcacccagtccaccaccctggggccgatgacgagcctgacccagaccgacctcccccagtccgtgaccagcatcgccgtccaggacacgcacccctcccccaccaaccggagcaagcgcaacctggagatggagatcatcctgaccctcccgcagggcctgaagaagtactacggcaaggtgctgcggctcctgcagctgaccctcgaggaggacaccgaggggctgctggagtggtgcaagcgcaacctcggcctggactgcgacgacacgttcttccagaagcggatcgaggagttcttcatcaccggggagggccacttcaacgaggtgctgcagttccgcacccccggcaccctctccacgaccgagagcacccacgccgggctgcccaccgccgagcccttcaagagctacttcgccaagggcttcctgtccatcgacagcgggtacttctccgcgaagtgctacagccggacgtccaacagcggcctccagctgatcaacgtcacccgccactccacccggatcgccgacaccccggggcccaagatcacgaacctgaagaccatcagctgcatcaacctcaaggcctccgtgttcaaggagcaccgcgaggtggagatcaacgtcctgctgccccaggtggccgtgaacctcagcaactgccacgtcaccatcaagtcccacgtgtgcgactacagcctggacatcgacggcaccgtgcggctgccccacatccaccacgacggcacgttcatcccggggacctacaagatcgtcatcgaccgcaagaacaagctcaacgaccggtgcaccctgttcaccaactgcgtgatcaagggccgcgaggtgcggaaggggcagtccgtcctgcgccagtacaagacggagatccggatcggcaaggccagcaccgggtcccgccgcctcctgagcgacgagtccggcgacgactgcatcagccggacccagctgctccgcaccgagacggcggagatccacggcgacaactacgggggccccggggacaagatcaccatctgcaacggcagcaccatcgtggaccagcggctggggtccgagctgggctgctacaccatcaaccgcgtcaagagcttcaagctctgcgagaactccgccacgggcaagagctgcgaggtggactccatccccgtgaagtgccggcaggggtactgcctgaagatcacccaggagggccgcgggcacgtcaagctgagccggggctccgaggtggtgctggacgcctgcgacagctcctgcgaggtcatgatccccaagggcaccggggacatcctcgtggactgcagcggcgggcagcagcacttcctgaaggacaacctgatcgacctcggctgcccgaagatccccctgctggggaagatggccatctacatctgccgcatgtccaaccaccccaagaccacgatggccttcctcttctggttcagcttcggctacgtgatcacctgcatcgtctgcaaggcgatcttctacctgctgatcatcgtgggcaccctcgggaagcggttcaagcagtaccgcgagctgaagccccagacctgcacgatctgcgagaccaccccgaccaacgccatcgacgccgagatgcacgacctgaactgctcctacaacatctgcccctactgcgccagccggctcacctccgacggcctggcgcgccacgtgacgcactgccccaagcggaaggagaaggtcgaggagaccgagctgtacctcaacctggagcgcatcccctgggtggtgcggaagctgctccaggtcagcgagtccaccggggtggccctgaagcgcagctcctggctgatcgtgctcctggtcctgttcgccgtgagcctcagcccggtgcagtccgcccccatcggccacgggaagaccatcgagacgtaccaggtccgggaggagtacaccagcatctgcctgttcgtgctgggctccatcctcttcatcgtgagctgcctgatgaagggcctggtcaactccgtggggaacatcttcttccccggcctcagcatctgcaagacctgctccatcgggagcatcaacggcttcgagatcgagtcccacaagtgctactgcagcctgctgtgctgcccgtactgccgccactgctccgccgaccgggagatccaccagctccacctgagcatctgcaagaagcgcaagaccgggtccaacgtgatgctggcggtctgcaagcgcatgtgcttccgggccacggtggaggtgagcaacaaggccctctccatccgcagcatcatcaacaccaccttcgtcgtgtgcatcctgatcctggccgtgtgcgtcgtgtccaccagcgccgtggagatggagtccctccccgcgggcacgtgggagcgggaggaggacctgaccaacttctgccaccaggagtgccaggtcaccgagaccgagtgcctgtgcccctacgaggccctcgtgctgcgccggcccctgttcctcgacggcatcgtgaaggggatgaagaacctgctgaacagcacgagcctcgagacctccctgagcatcgaggccccgtggggcgccatcaacgtccagtccacctacaagcccaccgtgagcgccgcgaacatcgccctgtcctggagctccgtggagcaccgcgggaacaagatcctcgtcagcggccggtccgagagcatcatgaagctggaggagcgcacggggatctcctgggacctgggcgtggaggacgccagcgagtccaagctcctgaccgtgagcgtcatggacctgtcccagatgtacagccccgtgttcgagtacctctccggcgaccggcaggtggaggagtggcccaaggccacctgcaccggggactgcccggagcgctgcggctgcacgagctccacctgcctgcacaaggagtggccccacagccggaactggcgctgcaaccccacctggtgctggggggtcggcaccggctgcacgtgctgcgggctggacgtgaaggacctcttcaccgactacatgttcgtgaagtggaaggtcgagtacatcaagaccgaggcgatcgtgtgcgtcgagctgaccagccaggagcggcagtgctccctgatcgaggccggcacgcgcttcaacctcgggcccgtgaccatcaccctgagcgagccgcggaacatccagcagaagctgccccccgagatcatcaccctccacccccgcatcgaggagggcttcttcgacctgatgcacgtgcagaaggtcctgtccgccagcacggtgtgcaagctccagtcctgcacccacggggtgccgggcgacctgcaggtctaccacatcggcaacctgctcaagggggacaaggtgaacggccacctgatccacaagatcgagccccacttcaacaccagctggatgtcctgggacgggtgcgacctggactactactgcaacatgggcgactggcccagctgcacctacaccggggtgacgcagcacaaccacgcctccttcatcaacctcctgaacatcgagaccgactacaccaagagcttccacttccactccaagcgggtcaccgcccacggcgacacgccccagctggacctcaaggcgcgcccgaactacggcgccggggagatcaccgtgctggtggaggtcgccgacatggagctgcacaccaagaagatcgagatcagcggcctcaagttcgcctccctgacctgcacggggtgctacgcctgcagctccggcatcagctgcaaggtgcggatccacgtggacgagcccgacgagctgaccgtccacgtgaagtccgacgaccccgacgtggtcgcggccagctccagcctcatggcccgcaagctggagttcgggaccgacagcaccttcaaggccttctccgccatgcccaagacgagcctgtgcttctacatcgtggagcgggagtactgcaagtcctgcagcaaggaggacacccagaagtgcgtgaacaccaagctcgagcacccgcagtccatcctgatcgagcacaagggcaccatcatcggcaagcagaacaacacgtgcaccgcgaagaccagctgctggctggagtccgtcaagagcttcttctacgggctcaagaacatgctgtccggcatcttcgggaacgtgttcgtgggcatcttcctgttcctcgcccccttcatcctgctgatcctgttcttcatgttcggctggcgcatcctcttctgcttcaagtgctgccgccggacccgcgggctgttccggtacaagcacctggaggacgacgaggagacgggctaccgccggatcatcgagcgcctcaacaacaagaaggggaagaacaagctgctggacggcgagcggctcgccgaccgccggatcgccgagctgttcagcaccaagacccacatcgggtga

SEQ ID NO: 12013 - RNA, 5055 nt, synthetic construct
  misc_feature 1..5055: note = derived and/or modified CDS sequence (opt1) from CCHFV(K128_76)__KX013454.1__GP
  source 1..5055: mol_type = other RNA
atgcacatcagcctgatgtgcgccgtgctctgcctgcagctgtacggcctcgggggcacccacgggtcccacaacgagaccgagcacaacaagacgaacgccgtcaccaccagctccgacagccagtcccccgagccgcccacccgcacgaccctgcccgtgacccccgacagcccgaccgtgacgcccaccacccccgcgtccgcccccgagggcagcggggaggtccacacctccccgcccaacacgaccgagggccccagcctgcccgagtccaccccggagccccccaccgccacgagcaccggcatcccctccgccagcgacgtgaactccagcacccaggccgcgcgggacacctccacgccgaccgtgcacaccagcccccccaactcccccagcaccccgcccacgctccaggagacccaccaccccatgcgcaacctgctgagcgtcacctcccacaagcccgaggagaccagcgccccgtccgagagcgggaaggagtcccccgccgccaacagcccccaccccgtggcggaccggccgtccacgagctccaccaccgcccagggccccaccgagaacaacagctacaacacgaccgagcagctcgagtccctgacccagagcaccacgctggggcccatgacctccctcacccagaccgtgctgagccagtccgtcaccagcatcgccgtgcaggacacgcacctgtccccgaccaaccgcagcaagcggaacctcgagatggagatcatcctgaccctgccccagggcctcaagaagtactacgggaaggtgctgcgcctgctccagctgaccctggaggaggacacggagggcctcctggagtggtgcaagcggaacctggacctcgactgcgacgacaccttcttccagaagcgcatcgaggagttcttcatcaccggcgaggggtacttcaacgaggtcctgcagttccggacccccggcacgctgtccaccaccgagagcacccacgccgggctccccacggccgagccgttcaagagctacttcgcgaagggcttcctgtccatcgacagcggctacttctccgccaagtgctacagccgcacctccaacagcgggctgcagctcatcaacgtgacccggcactccacccgcatcgccgacacgcccggccccaagatcaccaacctgaagaccatcagctgcatcaacctgaaggcctccgtgttcaaggagcaccgggaggtcgagatcaacgtgctcctgccccaggtggccgtcaacctgagcaactgccacgtgaccatcaagtcccacgtgtgcgactacagcctcgacatcgacgggacggtcaagctgccgcacatccaccacgacggcaccttcatccccgggacctacaagatcgtgatcgaccgcaagaacaagctgaacgaccggtgcaccctcttcacgaactgcgtgatcaagggccgcgaggtccggaagggccagtccgtgctgcgccagtacaagaccgagatccggatcgggaaggcgagcaccggctcccgccggctgctcagcgacgagtccggggacgactgcatcagccgcacccagctgctgcgcacggagaccgccgagatccacggcgacaactacgggggccccggcgacaagatcaccatctgcaacgggagcaccatcgtcgaccagcggctcggctccgagctggggtgctacacgatcaaccgcgtgaagagcttcaagctgtgcgagaactccgccaccggcaagagctgcgagatcgactccatccccgtgaagtgccggcaggggtactgcctgaagatcacccaggagggccgcggccacgtcaagctcagccgggggtccgaggtggtgctggacgcctgcgacagctcctgcgaggtcatgatcccgaagggcaccggggacatcctggtggactgcagcggcggccagcagcacttcctcaaggacaacctgatcgacctggggtgccccaagatccccctcctgggcaagatggccatctacatctgccgcatgtccaaccaccccaagacgaccatggcgttcctgttctggttcagcttcgggtacgtgatcacctgcatcgtctgcaaggccatcttctacctcctgatcatcgtgggcaccctggggaagcggttcaagcagtaccgcgagctcaagccgcagacctgcacgatctgcgagaccacccccaccaacgccatcgacgccgagatgcacgacctgaactgctcctacaacatctgcccctactgcgccagccggctgacgtccgacggcctcgcgcgccacgtgacccactgccccaagcggaaggagaaggtcgaggagaccgagctgtacctgaacctcgagcgcatcccgtgggtggtgcggaagctgctgcaggtcagcgagtccaccggcgtggccctcaagcgcagctcctggctgatcgtgctgctcgtcctgttcgccgtgagcctgagccccgtgcagtccgcccccatcagccacgggaagacgatcgagacctaccaggtccgggaggagtacacctccatctgcctcttcgtgctgggcagcatcctgttcatcgtgtcctgcctcatgaaggggctggtcaacagcgtgggcaacatcttcttccccgggctgtccatctgcaagacctgcagcatcggctccatcaacggcttcgagatcgagagccacaagtgctactgctccctcctgtgctgcccgtactgccgccactgcagcgcggaccgggagatccaccagctgcacctctccatctgcaagaagcgcaagacggggagcaacgtgatgctggccgtctgcaagcggatgtgcttccgcgccaccatggaggtgtccaacaaggccctgttcatccgcagcatcatcaacaccaccttcgtggtctgcatcctcatcctggccgtgtgcgtggtctccacgagcgcggtggagatggagtccctgcccgccggcacctgggagcgggaggaggacctcaccaacttctgccaccaggagtgccaggtgaccgagacggagtgcctgtgcccctacgaggccctggtcctccgccggccgctgttccaggacagcatcgtgaaggggatgaagaacctgctcaacagcacctccctggagaccagcctgtccatcgaggccccctggggcgccatcaacgtgcagagcacctacaagcccgcggtctccgccgccaacatcgccctcagctggtccagcgtggagcaccgcgggtccaagatcctggtgagcggccggtccgagagcatcatgaagctggaggagcgcacgggcatctcctgggacctcggggtcgaggacgccagcgagtccaagctgctgaccgtgagcgtgatggacctctcccagatgtacagccccgtcttcgagtacctgtccggcgaccggcaggtggaggagtggccgaaggcgacctgcaccggggactgccccgagcgctgcggctgcacgagcagcacctgcctgcacaaggagtggccccactcccggaactggcgctgcaaccccacctggtgctggggggtgggcaccggctgcacgtgctgcgggctcgacgtcaaggacctgttcaccgactacatgttcgtgaagtggaaggtggagtacatcaagaccgaggccatcgtctgcgtggagctgaccagccaggagcggcagtgctccctcatcgaggccggcacgcgcttcaacctggggccggtcaccatcaccctgagcgagccccggaacatccagcagaagctcccccccgagatcatcaccctgcacccgcgcatcgaggagggcttcttcgacctgatgcacgtgcagaaggtgctctccgccagcaccgtctgcaagctgcagtcctgcacgcacggcgtgcccggggacctgcaggtgtaccacatcggcaacctcctgaagggggaccgggtcaacggccacctgatccacaagatcgagccccacttcaacaccagctggatgtcctgggacgggtgcgacctcgactactactgcaacatgggcgactggcccagctgcacctacaccggcgtgacgcagcacaaccacgcgtccttcgtgaacctgctgaacatcgagaccgactacaccaagagcttccacttccactccaagcgcgtcaccgcccacggggacacgccgcagctcgacctgaaggcccggcccaactacggcgccggggagatcaccgtgctggtggaggtcgccgacatggagctccacaccaagaagatcgagatcagcggcctgaagttcgcgtccctgacctgcacggggtgctacgcctgcagctccggcatcagctgcaaggtgcgcatccacgtggacgagcccgacgagctcaccgtccacgtgaagtccgacgaccccgacgtggtcgccgccagcagctccctgatggcccggaagctggagttcggcaccgacagcaccttcaaggcgttctccgccatgccgaagacgagcctctgcttctacatcgtggagcgcgagtactgcaagtcctgcagcaaggaggacacccagaagtgcgtgaacaccaagctggagcagccccagtccatcctgatcgagcacaaggggaccatcatcggcaagcagaacaacacgtgcaccgccaagaccagctgctggctcgagtccgtcaagagcttcttctacgggctgaagaacatgctgtccggcatcttcgggaacgtgttcgtgggcatcttcctcttcctggcccccttcatcctgctgatcctcttcttcatgttcggctggcggatcctgttctgcttcaagtgctgccgccgcacccgggggctgttccgctacaagcacctcgagaacgacgaggagacgggctaccggcgcatcatcgagcggctgaacaacaagaaggggaagaacaagctgctcgacggcgagcgcctggccgaccggcgcatcgcggagctgttcagcaccaagacccacatcggctga

SEQ ID NO: 12014 - RNA, 5055 nt, synthetic construct
  misc_feature 1..5055: note = derived and/or modified CDS sequence (opt1) from CCHFV(K168_125)__KX013460.1__GP
  source 1..5055: mol_type = other RNA
atgcacatcagcctgatgtgcgccgtgctctgcctgcagctgtacggcctcgggggcacccacgggctgcacaacggcaccgagcacaacaagacgaacgccgtcaccacctccagcaactcccagagctccgagagccccgcgcgcaccgccccgcccgtgacgcccgactcccccaccgtgaccccgaccacgcccgccagcgcccccgaggggtccggcgaggcccacagctcccccccgaacaacaccgagggccccagcctgcccgagtccaccagcgagcccccggcggccacctccacggggatccccagcgcctccgacgtcaacagctccacccaggccgcgcgggacaccagcacccccacggtgcgcaccagccccccgaactcccccagcaccccccccaccccgcaggagacgcaccaccccgtgcggaacctcctgtccgtcaccagccacaagcccgaggagacctccgcccccagcgagtccggcaaggagagcccggccgccaactccccccaccccgtggccagccgccccccgaccccctccacgaccgcgcaggggcccaccgagaacaacaactacaacaccacgggccagctggagagcctcacccagtccaccaccctggggccgatgacgagcctgacccagaccgacctcccccagtccgtgaccagcatcgccgtccaggacacgcacccctcccccaccaaccggagcaagcgcaacctggagatggagatcatcctgaccctcccgcagggcctgaagaagtactacggcaaggtgctgcggctcctgcagctgaccctcgaggaggacaccgaggggctgctggagtggtgcaagcgcaacctcggcctggactgcgacgacacgttcttccagaagcggatcgaggagttcttcatcaccggggagggccacttcaacgaggtgctgcagttccgcacccccggcaccctctccacgaccgagagcacccacgccgggctgcccaccgccgagcccttcaagagctacttcgccaagggcttcctgtccatcgacagcgggtacttctccgcgaagtgctacagccggacgtccaacagcggcctccagctgatcaacgtcacccgccactccacccggatcgccgacaccccggggctgaagatcacgaacctcaagaccatcagctgcatcaacctgaaggcctccgtgttcaaggagcaccgcgaggtggagatcaacgtcctgctcccccaggtggccgtgaacctgagcaactgccacgtcaccatcaagtcccacgtgtgcgactacagcctggacatcgacggcaccgtgcggctcccccacatccaccacgacggcacgttcatccccgggacctacaagatcgtcatcgaccgcaagaacaagctgaacgaccggtgcaccctgttcaccaactgcgtgatcaagggccgcgaggtgcggaaggggcagtccgtcctccgccagtacaagacggagatccggatcggcaaggccagcaccgggtcccgccgcctgctgagcgacgagtccggcgacgactgcatcagccggacccagctcctgcgcaccgagacggcggagatccacggcgacaactacgggggcccgggggacaagatcaccatctgcaacggcagcaccatcgtggaccagcggctggggtccgagctcggctgctacaccatcaaccgcgtcaagagcttcaagctgtgcgagaactccgccacgggcaagagctgcgaggtggactccatccccgtgaagtgccggcaggggtactgcctgaagatcacccaggagggccgcgggcacgtcaagctgagccggggctccgaggtggtgctcgacgcctgcgacagctcctgcgaggtcatgatccccaagggcaccggggacatcctggtggactgcagcggcgggcagcagcacttcctgaaggacaacctcatcgacctgggctgccccaaggtgccgctgctcgggaagatggccatctacatctgccgcatgtccaaccaccccaagaccacgatggccttcctgttctggttcagcttcggctacgtcatcacctgcatcgtgtgcaaggcgatcttctacctgctcatcatcgtgggcaccctggggaagcggttcaagcagtaccgcgagctgaagccccagacctgcacgatctgcgagaccacccccaccaacgccatcgacgccgagatgcacgacctcaactgctcctacaacatctgcccgtactgcgccagccggctgacctccgacggcctggcgcgccacgtcacgcactgccccaagcggaaggagaaggtggaggagaccgagctctacctgaacctggagcgcatcccctgggtggtccggaagctcctgcaggtgagcgagtccaccggggtggccctgaagcgcagctcctggctcatcgtcctgctggtgctcttcgccgtgagcctgagccccgtccagtccgccccgatcggccacgggaagaccatcgagacgtaccaggtgcgggaggagtacaccagcatctgcctgttcgtgctcggctccatcctgttcatcgtcagctgcctgatgaagggcctcgtgaactccgtggggaacatcttcttccccggcctgagcatctgcaagacctgctccatcgggagcatcaacggcttcgagatcgagtcccacaagtgctactgcagcctgctctgctgcccctactgccgccactgctccgccgaccgggagatccaccagctgcacctgagcatctgcaagaagcgcaagaccgggtccaacgtcatgctcgcggtgtgcaagcgcatgtgcttccgggccacggtggaggtcagcaacaaggccctgtccatccgcagcatcatcaacaccaccttcgtggtgtgcatcctgatcctcgccgtctgcgtggtgtccaccagcgccgtcgagatggagtccctgccggcgggcacgtgggagcgggaggaggacctgaccaacttctgccaccaggagtgccaggtgaccgagaccgagtgcctctgcccctacgaggccctggtgctgcgccggcccctcttcctggacagcatcgtcaagggcaagaagaacctgctcaacagcacgtccctggagaccagcctgtccatcgaggccccctggggggccatcaacgtgcagagcacctacaagccgaccgtgtccgccgcgaacatcgccctcagctggtccagcgtcgagcaccgcggcaacaagatcctggtgtccgggcggagcgagtccatcatgaagctggaggagcgcacgggcatcagctgggacctcggggtggaggacgcctccgagagcaagctgctgaccgtctccgtgatggacctcagccagatgtactcccccgtgttcgagtacctgagcggcgaccggcaggtcgaggagtggcccaaggccacctgcaccggcgactgccccgagcgctgcgggtgcacgtccagcacctgcctgcacaaggagtggccgcacagccggaactggcgctgcaaccccacctggtgctggggcgtggggaccggctgcacgtgctgcggcctcgacgtgaaggacctgttcaccgactacatgttcgtcaagtggaaggtggagtacatcaagaccgaggcgatcgtctgcgtggagctgacctcccaggagcggcagtgcagcctcatcgaggccgggacgcgcttcaacctgggccccgtgaccatcaccctgtccgagccccggaacatccagcagaagctcccgcccgagatcatcaccctgcacccccgcatcgaggaggggttcttcgacctgatgcacgtccagaaggtgctcagcgcctccacggtgtgcaagctgcagagctgcacccacggcgtccccggggacctgcaggtgtaccacatcggcaacctcctgaagggcgacaaggtgaacgggcacctgatccacaagatcgagccgcacttcaacacctcctggatgagctgggacggctgcgacctcgactactactgcaacatgggggactggccctcctgcacctacaccggcgtcacgcagcacaaccacgccagcttcatcaacctgctgaacatcgagaccgactacaccaagtccttccacttccacagcaagcgggtgaccgcccacggggacacgccccagctcgacctgaaggcgcgccccaactacggcgccggcgagatcaccgtgctggtcgaggtggccgacatggagctccacaccaagaagatcgagatctccgggctgaagttcgccagcctgacctgcacgggctgctacgcctgctccagcgggatctcctgcaaggtgcggatccacgtcgacgagccggacgagctcaccgtgcacgtgaagagcgacgaccccgacgtcgtggcggcctccagcagcctgatggcccgcaagctggagttcggcaccgactccaccttcaaggccttcagcgccatgcccaagacgtccctctgcttctacatcgtggagcgggagtactgcaagagctgctccaaggaggacacccagaagtgcgtcaacaccaagctggagcacccccagagcatcctgatcgagcacaaggggaccatcatcggcaagcagaacaacacgtgcaccgcgaagacctcctgctggctcgagagcgtgaagtccttcttctacggcctgaagaacatgctgagcgggatcttcggcaacgtgttcgtcgggatcttcctcttcctggccccgttcatcctgctgatcctcttcttcatgttcggctggcgcatcctgttctgcttcaagtgctgccgccggacccgcggcctgttccggtacaagcacctcgaggacgacgaggagacggggtaccgccggatcatcgagcgcctgaacaacaagaagggcaagaacaagctgctcgacggggagcggctggccgaccgccggatcgccgagctgttctccaccaagacccacatcggctga

SEQ ID NO: 12015 - RNA, 5052 nt, synthetic construct
  misc_feature 1..5052: note = derived and/or modified CDS sequence (opt1) from CCHFV(Kosova Hoti)__EU037902.1__GP
  source 1..5052: mol_type = other RNA
atgcacaccctgctcgtgtgcttcatcctgtacctgcagctcctgggcctggggggcgcccacgggcagagcaacgccaccgagcacaacggcacgaacaccaccaccgcgcccgggacgtcccagagcccgaagccccccgcctccaccacccccagccacgccccggagccctccaccatcaagctcacgacccccaccagcgagaccgagggctccggcgagacgacccccccgaccaacaccacgcaggacagcccccccctggagaccacccccgagcgctccgccaccacggccaccagcacctccgggaccgacaacatgaacagcacgacccagatgaccgacaacaccccgacgtccaccgtcagcacctccctgagctccagcccctccacccccagcacgagccagggcatgcaccaccccgtgcggtccctcctgagcgtgtccagcccgaagaccgcgaccacccccacgcccatgtcccccggggagatgagctccgagaccagctcccagcacagcgccatgtcccgcaccccgaccccccacaccgccacgcaggtcagcaccgagaacgccaaccggtccaccagccgccagtccgagagctccgcgcagcccgccacccagagccccgtgacgtccccggcccagagcatcctgctcatgagcgccacccccaccaccatccagaacatccacccctcccccacgaaccggagcaagcgcaacctggagatggagatcatcctgaccctctcccagggcctgaagaagtactacgggaagatcctgaagctcctgcacctgaccctcgaggaggacaccgagggcctgctggagtggtgcaagcggaacctcggcagcaactgcgacgacgacttcttccagaagcgcatcgaggagttcttcatcacgggggagggctacttcaacgaggtgctgcagttcaagaccctgtccaccccgagctccaccgagcccagccacgcccggctccccacggcggagccgttcaagtcctacttcgccaaggggttcctgagcatcgactccggctacttcagcgccaagtgctacccccgctccagcacctccggcctgcagctcatcaacgtcacccagcaccccgcccggatcgccgagacccccgggccgaagacgaccagcctgaagaccatcaactgcatcaacctgcgcgcgtccgtgttcaaggagcaccgggaggtggagatcaacgtcctcctgccccagatcgccgtgaacctgagcaactgccacgtggtcatcaacagccacgtgtgcgactactccctcgacaccgacggccccgtgcgcctgccccggatctaccacgaggggacgttcatgccgggcacctacaagatcgtcatcgaccgcaagaacaagctgaacgaccggtgcaccctcgtgaccaactgcgtgatcaaggggcgcgaggtccggaagggccagagcgtgctgcgccagtacaagacggagatcaagatcggcaaggcccccaccgggtcccggaagctgctcagcgaggagcccggcgacgactgcatctcccgcacccagctgctgcgcaccgagacggccgagatccacgacgacaactacgggggccccggggacaagatcaccatctgcaacggcagcaccatcgtggaccagcggctcggctccgagctggggtgctacaccatcaaccgcgtcaagagcttcaagctgtgcgagaactccgccacgggcaagacctgcgagatcgacagcaccccggtgaagtgccggcaggggttctgcctcaagatcacccagaagggccgcgggcacgtgaagctgtcccggggcagcgaggtcgtgctggacgcgtgcgactccaactgcgaggtcatgatccccaagggcaccggggacatcctggtggactgcagcggcgggcagcagcacttcctcaaggacaacctgatcgacctgggctgcccccacatccccctcctgggcaagatggccatctacatctgccgcatgtccaaccacccgaagacgaccatggccttcctgttctggttcagcttcgggtacgtgatcacctgcatcttctgcaaggccctcttctactccctgatcatcatcggcaccctggggaagaagatcaagcagtaccgggagctcaagccccagacgtgcaccatctgcgagaccgcccccgtcaacgcgatcgacgccgagatgcacgacctgaactgcagctacaacatctgcccctactgcgcctcccgcctgaccagcgacggcctcgcccggcacgtgaagcagtgcccgaagcgcaaggagaaggtggaggagacggagctgtacctgaacctcgagcggatcccctgggtcgtgcgcaagctgctgcaggtgagcgagtccaccggggtcgcgctcaagcggagctcctggctgatcgtgctgctcgtgctgctgaccgtcagcctctcccccgtgcagagcgcccccgtgggccacggcaagaccatcgagacgtaccagacccgcgaggggttcacctccatctgcctgttcatgctgggcagcatcctcttcatcgtctcctgcctggtgaaggggctggtggacagcgtctccgacagcttcttcccgggcctctccgtgtgcaagacctgcagcatcgggtccatcaacggcttcgagatcgagagccacaagtgctactgctccctgttctgctgcccctactgccggcactgcagcgccgaccgcgagatccaccagctgcacctcaacatctgcaagaagcggaagacgggctccaacgtgatgctggccgtctgcaagcgcatgtgcttccgggccaccatcgaggcgagccgccgcgccctgctcatccggagcatcatcaacaccaccttcgtgatctgcatcctgacgctgaccatctgcgtggtctccaccagcgccgtggagatggagaacctccccgccgggacctgggagcgcgaggaggacctgacgaacttctgccaccaggagtgccaggtgaccgagaccgagtgcctgtgcccgtacgaggccctcgtcctgcggaagcccctgttcctcgactccatcgtgaagggcatgaagaacctgctgaacagcacctccctcgagacgagcctgtccatcgaggcgccctggggggccatcaacgtgcagagcaccttcaagcccaccgtctccaccgccaacatcgccctgagctggtccagcgtggagcaccgcggcaacaagatcctcgtgacggggcggtccgagagcatcatgaagctggaggagcgcaccggcatctcctgggacctgggcgtcgaggacgccagcgagtccaagctcctgaccgtgagcatcatggacctgtcccagatgtacagcccggtgttcgagtacctcagcggggaccggcaggtcgaggagtggcccaaggcgacctgcacgggcgactgcccccagcgctgcgggtgcacctccagcacctgcctgcacaaggagtggccccactcccggaactggcgctgcaacccgacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctcaccagccaggagcggcagtgctccctgatcgaggccgggacgcgcttcaacctgggccccgtgaccatcaccctcagcgagccccggaacatccagcagaagctgcccccggagatcatcaccctgcaccccaagatcgaggaggggttcttcgacctcatgcacgtccagaaggtgctgtccgccagcacggtgtgcaagctgcagtcctgcacccacggcatccccggcgacctccaggtctaccacatcgggaacctgctgaagggcgaccgcgtgaacgggcacctcatccacaagatcgagccccacttcaacaccagctggatgtcctgggacggctgcgacctggactactactgcaacatgggggactggccgagctgcacctacacgggcgtgacccagcacaaccacgcggccttcgtcaacctgctcaacatcgagaccgactacaccaagacgttccacttccactccaagcgggtgaccgcccacggcgacaccccccagctggacctgaaggcccgccccacctacggggccggcgagatcacggtcctcgtggaggtggcggacatggagctgcacaccaagaaggtcgagatcagcgggctgaagttcgcctccctcgcctgcaccggctgctacgcctgcagctccgggatcagctgcaaggtgcggatccacgtggacgagcccgacgagctgaccgtccacgtgaagtccagcgacccggacgtggtcgccgcgggcacgagcctgatggcccgcaagctcgagttcggcaccgactccaccttcaaggccttcagcgccatgcccaagacctccctgtgcttctacatcgtggagaaggagtactgcaagagctgctccgaggacgacacgaagaagtgcgtggacaccaagctggagcagccccagagcatcctcatcgagcaccgggggaccatcatcggcaagcagaacgacacctgcacggccaaggcgtcctgctggctggagagcgtcaagtccttcttctacgggctgaagaacatgctcggcagcgtgttcgggaacttcttcatcggcatcctgctgttcctcgcccccttcgtgctgctggtcctgttcttcatgttcggctggaagatcctcttctgcttcaagtgctgccgccggacccgcgggctgttcaagtaccgccacctgaaggacgacgaggagaccggctaccggcgcatcatcgagcggctcaacaacaagaaggggaagaaccgcctgctggacggcgagcggctcgccgaccgcaagatcgccgagctgttctccaccaagacgcacatcggctga

SEQ ID NO: 12016 - RNA, 5049 nt, synthetic construct
  misc_feature 1..5049: note = derived and/or modified CDS sequence (opt1) from CCHFV(Oman)__DQ211632.1__GP
  source 1..5049: mol_type = other RNA
atgcacaccctgctcgtgtacgccgtcttctgcctgcagctgtggagccccggcgggacccgcggcctctccaacgagacgcagcacaacgagaccgggatcacccgggccccggagggcagccaggggccctccctgcccgtgagcaccgcgtcccccatcatgagcgacccgtccatcacgacccccagcgcctccaccagcggcctggagggctccggggacaccacgccgcccgccatcacccagggccccaccccgcccgagaccacgcccgagcccagcaccaccaccgggacgaacgccttctccaccgccatcgcgaacgtgagcacccagaccgtcaaggacacgcccacccccaccgtgcagacctccccgcccagcacgcccgacgcctccaccatcccccagggcacccaccacaccgcccgcgggctcctgagcgtgacggtcaccaagcccgaggaggtgccgacccccaccggccccgagcaggcctccatcgagacgaacagcccccggctggcgaccagcaagaccccgtcccccagccccaccgcccaggtgacgaccgagaactccaaccccaacaccagccgccagctcgtcctgtccacccagccggccaccagctcccccgtgacgagccccgcccagctgatcttcgtgcagtccgccaccaccgtcgcggtgcaggacgcccacccgagccccaccaaccggtccaagcgcaacctcgagatggaggtgatcctgacgctgagccagggcctccggaagtactacgggcgcatcctgaagctgctcgacctgaccctggaggaggacaccgagggcctcctggagtggtgcaagcggaacctggggctcacgtgcgacgacaacttcttccagaagcgcatcgaggagttcttcctgacgggcgagggccacttcaacgaggtcctgcagttcaagaccccctccaccctcagctccaccgagagcgcctccgtggggctgcccacggtggagccgttcaagagctacttcgccaagggcttcctgtccatcgacagcgggtacttcagcgccaagtgctacccccgggcgtccaacagcggcctccagctgatcaacgtcacccagcactccgcccgcatcgccgacacccccgggcccaagatcaccaacctgaagacgatcaactgcatcaacctcaaggccctggtgttcaaggagcaccgggagatcgagatcaacgtgctgctcccgcaggtcgccgtgaacctgagcaactgccacgtgcacatcaagtcccacgtctgcgactacagcctggacatcgacggcaccgtgcgcctcccccggatccaccacgagggcaccttcatccccgggacctacaagatcgtcatcgacaagaagaacaagcagaacgaccgctgcaacctggtgacgaactgcgtgatcaagggccgggaggtccgcaaggggcagtccgtgctgcggcagtaccgcaccgagatccggatcggcaaggcgagctccgggagccgccgcctcctgtccgaggagagcggcgaggactgcatctcccggacccagctgctccgcaccgagacggccgagatccacggcgacaactacgggggccccggggacaagatcaccatctgcaacggcagcaccatcgtggaccagcggctggggtccgagctgggctgctacaccatcaaccgcgtcaagagcttcaagctctgcgagaactccgccaccggcaagagctgcgagatcgacaacaccccggtgaagtgcaagcaggggttctgcctgaagatcacccaggagggccgggggcacgtgaagctgagccgcgactccgaggtcgtgctggacgcctgcgacagctcctgcgagatcatgatccccaagggcaccggcgacatcctcgtggactgcagcgggggccagcagcacttcctgaaggacaacctgatcgacctcgggtgccccaacatccccctgctgggcaagatggccatctacatctgccggatgtccaaccacccgaagacgaccatggcgttcctcttctggttcagcttcgggtacgtcatcacgtgcatcctgtgcaaggtgatcttctacctgctcatcgtggtcggcaccctgggcaagaagttcaagcagtaccgcgagctgaagccccagacctgcaccatctgcgagaccacccccgtgaacgccatcgacgccgagatgcacgacctcaactgctcctacaacatctgcccctactgcgccagccggctgacctccgacgggctggcgcgccacgtgatgcagtgcccgaagcggaaggagaagatcgaggagacggagctctacctgaacctggagcgcatcccctgggtcgtgcggaagctcctccaggtgagcgagtccaccggcgtcgccctgaagcgcagctcctggctcatcgtgctgctggtgctcctgaccgtcagcctgtcccccgtgcagagcgcccccatcgggcacggcaagaccatcgagacgtaccagacccgggaggggtacacctccatctgcctcttcgtgctgggcagcatcctgttcatcgtctcccacctcatgaagggcctggtggacagcgtggggaacagcttcttcccgggcctgtccatctgcaagacctgcagcatcgggtccatcaacggcttcgagatcgagagccacaagtgcttctgctccctcttctgctgcccctactgccgccactgcagcgccgacaaggagatccacaagctgcacctgtccatctgcaagaagcggaaggccgggagcaacgtcatgctcgcggtgtgcaagcgcatgtgcttccgggccacgatggaggtgtccaacaaggccctgctgatccgcagcgtcatcaacaccaccttcgtggtgtgcatcctcatcctggccgtctgcgtggtgtccaccagcgccgtcgagatggagtccctgcccgcgggcacgtgggagcgcgaggaggacctcaccaacttctgccaccaggagtgccaggtgaccgagaccgagtgcctgtgcccgtacgaggccctggtgctccggaagcccctgttcctggacagcatcgccaagggcatgaagaacctcctgaactccacgagcctggagacctccctcagcatcgaggccccctggggcgccatcaacgtccagtccaccttcaagcccaccgtgagcacggcgaacatcgccctgagctggtccagcgtggagcaccgcgggaacaagatcctggtctccgggcggagcgagtccatcatgaagctcgaggagcgcaccggcatcagctgggacctgggggtggaggacgcctccgagagcaagctgctcaccgtgtccgtcatggacctgagccagatgtactccccggtgttcgagtacctgagcggcgaccgccaggtggaggagtggcccaaggcgacctgcacgggcgactgccccgagcggtgcgggtgcacctcctccacgtgcctccacaaggagtggccccacagccggaactggcgctgcaacccgacctggtgctggggcgtcgggaccggctgcacgtgctgcggcctggacgtgaaggacctgttcaccgactacatgttcgtcaagtggaaggtggagtacatcaagaccgaggccatcgtgtgcgtcgagctcaccagccaggagcggcagtgctccctgatcgaggccgggacccgcttcaacctgggccccgtgaccatcaccctcagcgagccccggaacatccagcagaagctgcccccggagatcgtgacgctgcacccccgcatcgaggaggggttcttcgacctcatgcacgtccagaaggtgctgtccgccagcaccgtgtgcaagctgcagagctgcacccacggcgtccccggggacctccaggtgtaccacatcggcaacctgctgaagggcgacaaggtgaacgggcacctcatccacaaggtcgagccccacttcaacacctcctggatgagctgggacggctgcgacctggactactactgcaacatgggggactggccgtcctgcacctacacgggcgtgacccagcacaaccacgccgccttcgtgaacctgctcaacatcgagaccgactacaccaagaacttccacttccacagcaagcgggtcacggcgcacggggacaccccgcagctggacctgaaggcccgccccaactacggcgccggcgaggtgaccgtgctcgtcgaggtggccgacatggagctgcacaccaagaagatcgagatctccgggctgaagttcgccagcctcacgtgcaccggctgctacgcgtgctccagcgggatctcctgcaaggtgcggatccacgtcgacgagcccgacgagctgaccgtgcacgtcaagagcgaggaccccgacatcgtggccgcctccagctccctgatggcccgcaagctcgagttcggcaccgacagcacgttcaaggccttctccgcgatgcccaagaccagcctgtgcttctacatcgtggagcgggagtactgcaagtcctgcagcaaggaggacacccagaagtgcgtgaacgccaagctggagcgcccccagtccatcctcatcgagcacaaggggaccatcatcggcaagcagaacgacacgtgcaccgccaaggccagctgctggctggagagcgtcaagtccttcttctacggcctgaagaacatgctcagcgggatcttcggcaacgtgttcatcgggatcttcctgttcctggcgcccttcatcctgctcatcctgttcttcatgttcggctggcggatcctgttctgcttcaagtgctgccgccggacccgcggcctcttcaagtaccgccacctgaaggacgacgaggagaccgggtaccggaagatcatcgagcgcctgaacaacaagaagggcaagaacaagctcctggacggggagcggctggccgaccgcaagatcgccgagctgttctccacgaagacccacatcggctga

SEQ ID NO: 12017 - RNA, 5049 nt, synthetic construct
  misc_feature 1..5049: note = derived and/or modified CDS sequence (opt1) from CCHFV(Oman_812956)__KY362518.1__GP
  source 1..5049: mol_type = other RNA
atgcacaccctgctcgtgtacgccgtgttctgcctgcagctgtggagccccggcgggacccgcggcctctccaacgagacgcagcacaacgagaccgggatcacccgggccccggagggcagccaggggccctccctgcccgtgagcaccgcgtcccccatcatgagcgacccgtccatcacgaccctgagcgcctccaccagcggcctcgagggctccggggacaccacgccgcccgccatcacccagggccccaccctgccggagaccacgcccgagcccagcaccaccaccgggacgaacgccttctccaccgccatcgcgaacgtgagcacccagaccgtcaaggacacgcccaccccgaccgtgcagacctccccgcccagcacgcccgacgcctccaccatcccccagggcacccaccacaccgcccgcgggctgctcagcgtgacggtcaccaagcccgaggaggtgcccacccccaccggcccggagcaggcctccatcgagacgaacagcccccggctggcgaccagcaagaccccctcccccagcccgaccgcccaggtgacgaccgagaactccaaccccaacaccagccgccagctggtcctctccacccagcccgccaccagctcccccgtgacgagcccggcccagctgaacttcgtgcagtccgccaccaccatcgcggtccaggacgcccaccccagccccaccaaccggtccaagcgcaacctggagatggaggtgatcctcacgctgagccagggcctgcggaagtactacgggcgcatcctcaagctgctggacctcaccctggaggaggacaccgagggcctgctcgagtggtgcaagcggaacctggggctgacctgcgacgacaacttcttccagaagcgcatcgaggagttcttcctcacgggcgagggccacttcaacgaggtgctgcagttcaagaccccgtccaccctgagccccaccgagtccgccagcgtcgggctccccacggtggagcccttcaagtcctacttcgccaagggcttcctgagcatcgactccgggtacttcagcgccaagtgctacccgcgggcgagcaactccggcctgcagctcatcaacgtgacccagcacagcgcccgcatcgccgacacccccgggcccaagatcaccaacctgaagacgatcaactgcatcaacctgaaggccctcgtcttcaaggagcaccgggagatcgagatcaacgtgctgctgccccaggtggccgtcaacctctccaactgccacgtgcacatcaagagccacgtgtgcgactactccctggacatcgacggcaccgtccgcctgccgcggatccaccacgagggcaccttcatccccgggacctacaagatcgtgatcgacaagaagaacaagcagaacgaccgctgcaacctcgtcacgaactgcgtgatcaagggccgggaggtgcgcaaggggcagagcgtcctgcggcagtaccgcaccgagatccggatcggcaaggcgtccagcgggtcccgccgcctgctcagcgaggagtccggcgaggactgcatcagccggacccagctgctgcgcaccgagacggccgagatccacggcgacaactacgggggccccggggacaagatcaccatctgcaacggctccaccatcgtggaccagcggctcgggagcgagctgggctgctacaccatcaaccgcgtgaagtccttcaagctgtgcgagaacagcgccacgggcaagtcctgcgagatcgacaacacccccgtcaagtgcaagcaggggttctgcctgaagatcacccaggagggccgggggcacgtgaagctcagccgcgacagcgaggtggtcctggacgcctgcgactccagctgcgagatcatgatcccgaagggcaccggcgacatcctggtggactgctccgggggccagcagcacttcctcaaggacaacctgatcgacctggggtgccccaacatccccctcctgggcaagatggccatctacatctgccggatgagcaaccaccccaagacgaccatggcgttcctgttctggttctccttcgggtacgtgatcacgtgcatcctctgcaaggtcatcttctacctgctgatcgtggtgggcaccctcggcaagaagttcaagcagtaccgcgagctgaagccgcagacctgcaccatctgcgagaccacccccgtcaacgccatcgacgccgagatgcacgacctgaactgcagctacaacatctgcccctactgcgcctcccggctcaccagcgacgggctggcgcgccacgtgatgcagtgccccaagcggaaggagaagatcgaggagacggagctgtacctcaacctggagcgcatcccgtgggtggtccggaagctgctccaggtgtccgagagcaccggcgtggccctgaagcgctccagctggctgatcgtcctcctggtgctgctcaccgtgtccctgagccccgtccagtccgcccccatcgggcacggcaagaccatcgagacgtaccagacccgggaggggtacaccagcatctgcctgttcgtgctcggctccatcctgttcatcgtgagccacctgatgaagggcctcgtcgactccgtggggaacagcttcttccccggcctgagcatctgcaagacctgctccatcgggagcatcaacggcttcgagatcgagtcccacaagtgctactgcagcctgttctgctgcccgtactgccgccactgctccgccgacaaggagatccacaagctccacctgagcatctgcaagaagcggaaggccgggtccaacgtgatgctggcggtctgcaagcgcatgtgcttccgggccacgatggaggtgagcaacaaggccctcctgatccgctccgtgatcaacaccaccttcgtcgtgtgcatcctgatcctcgccgtgtgcgtcgtgagcacctccgccgtggagatggagagcctgcccgcgggcacgtgggagcgcgaggaggacctgaccaacttctgccaccaggagtgccaggtcaccgagaccgagtgcctctgcccctacgaggccctggtgctgcggaagcccctcttcttcgactccatcgccaagggcatgaagaacctgctgaacagcacgtccctcgagaccagcctgtccatcgaggccccctggggcgccatcaacgtgcagagcaccttcaagcccaccgtctccacggcgaacatcgccctgagctggagctccgtggagcaccgcgggaacaagatcctcgtgagcgggcggtccgagagcatcatgaagctggaggagcgcaccggcatctcctgggacctgggggtcgaggacgccagcgagtccaagctcctgaccgtgagcgtgatggacctgtcccagatgtacagccccgtcttcgagtacctctccggcgaccgccaggtggaggagtggccgaaggcgacctgcacgggcgactgccccgagcggtgcgggtgcaccagctccacgtgcctgcacaaggagtggccccacagccggaactggcgctgcaaccccacctggtgctggggcgtggggaccggctgcacgtgctgcggcctggacgtcaaggacctcttcaccgactacatgttcgtgaagtggaaggtcgagtacatcaagaccgaggccatcgtgtgcgtggagctgacctcccaggagcggcagtgcagcctgatcgaggccgggacccgcttcaacctcggcccggtcaccatcaccctgtccgagccccggaacatccagcagaagctgccgcccgagatcgtgacgctccacccccgcatcgaggaggggttcttcgacctgatgcacgtgcagaaggtcctgagcgcctccaccgtgtgcaagctccagagctgcacccacggcgtgcccggggacctgcaggtctaccacatcggcaacctgctcaagggcgacaaggtgaacgggcacctgatccacaaggtggagccccacttcaacaccagctggatgtcctgggacggctgcgacctggactactactgcaacatgggggactggcccagctgcacctacacgggcgtcacccagcacaaccacgccgccttcgtgaacctcctgaacatcgagaccgactacaccaagaacttccacttccactccaagcgggtgacggcgcacggggacaccccgcagctggacctcaaggcccgccccaactacggcgccggcgagatcaccgtcctggtggaggtggccgacatggagctgcacaccaagaagatcgagatcagcgggctcaagttcgcctccctgacgtgcaccggctgctacgcgtgcagctccgggatcagctgcaaggtccggatccacgtggacgagcccgacgagctgaccgtgcacgtcaagtccgaggaccccgacatcgtggccgccagctccagcctcatggcccgcaagctggagttcggcaccgactccacgttcaaggccttcagcgcgatgccgaagacctccctgtgcttctacatcgtggagcgggagtactgcaagagctgctccaaggaggacacccagaagtgcgtcaacgccaagctcgagcgcccccagagcatcctgatcgagcacaaggggaccatcatcggcaagcagaacgacacgtgcaccgccaaggcctcctgctggctggagagcgtcaagagcttcttctacggcctcaagaacatgctgtccgggatcttcggcaacgtgttcatcgggatcttcctgttcctggcgcccttcatcctcctgatcctgttcttcatgttcggctggcggatcctcttctgcttcaagtgctgccgccggacccgcggcctgttcaagtaccgccacctgaaggacgacgaggagaccgggtaccggaagatcatcgagcgcctcaacaacaagaagggcaagaacaagctgctggacggggagcggctcgccgaccgcaagatcgccgagctgttcagcacgaagacccacatcggctga

SEQ ID NO: 12018 - RNA, 5049 nt, synthetic construct
  misc_feature 1..5049: note = derived and/or modified CDS sequence (opt1) from CCHFV(Oman-199809166)__KR864901.1__GP
  source 1..5049: mol_type = other RNA
atgcacaccctgctcgtgtacgccgtcttctgcctgcagctgtggagccccggcgggacccgcggcctctccaacgagacgcagcacaacgagaccgggatcacccgggccccggagggcagccaggggccctccctgcccgtgagcaccgcgtcccccatcatgagcgacccgtccatcacgaccctgagcgcctccaccagcggcctcgagggctccggggacaccacgccgcccgccatcacccagggccccaccctgcccgagaccacgcccgagcccagcaccaccaccgggacgaacgccttctccaccgccatcgcgaacgtgagcacccagaccgtcaaggacacgcccaccccgaccgtgcagacctccccgcccagcacgcccgacgcctccaccatcccccagggcacccaccacaccgcccgcgggctgctcagcgtgacggtcaccaagcccgaggaggtgcccacccccaccggcccggagcaggcctccatcgagacgaacagcagccggctggcgacctccaagacccccagcccctcccccaccgcccaggtgacgaccgagaacagcaacccgaacacctcccgccagctggtcctcagcacccagcccgccacctccagccccgtgacgtcccccgcccagctgaacttcgtgcagagcgccaccaccatcgcggtccaggacgcccacccgtcccccaccaaccggagcaagcgcaacctggagatggaggtgatcctcacgctgtcccagggcctgcggaagtactacgggcgcatcctcaagctgctggacctcaccctggaggaggacaccgagggcctgctcgagtggtgcaagcggaacctggggctgacctgcgacgacaacttcttccagaagcgcatcgaggagttcttcctcacgggcgagggccacttcaacgaggtgctgcagttcaagacccccagcaccctgtccccgaccgagagcgcctccgtcgggctccccacggtggagcccttcaagagctacttcgccaagggcttcctgtccatcgacagcgggtacttcagcgccaagtgctacccccgggcgtccaacagcggcctgcagctcatcaacgtgacccagcactccgcccgcatcgccgacaccccggggcccaagatcaccaacctgaagacgatcaactgcatcaacctgaaggccctcgtcttcaaggagcaccgggagatcgagatcaacgtgctgctgccccaggtggccgtcaacctcagcaactgccacgtgcacatcaagtcccacgtgtgcgactacagcctggacatcgacggcaccgtccgcctgccccggatccaccacgagggcaccttcatcccggggacctacaagatcgtgatcgacaagaagaacaagcagaacgaccgctgcaacctcgtcacgaactgcgtgatcaagggccgggaggtgcgcaaggggcagtccgtcctgcggcagtaccgcaccgagatccggatcggcaaggcgagctccgggagccgccgcctgctctccgaggagagcggcgaggactgcatctcccggacccagctgctgcgcaccgagacggccgagatccacggcgacaactacgggggccccggggacaagatcaccatctgcaacggcagcaccatcgtggaccagcggctcgggtccgagctgggctgctacaccatcaaccgcgtcaagagcttcaagctgtgcgagaactccgccacgggcaagagctgcgagatcgacaacacccccgtgaagtgcaagcaggggttctgcctgaagatcacccaggagggccgggggcacgtgaagctcagccgcgactccgaggtggtcctggacgcctgcgacagctcctgcgagatcatgatccccaagggcaccggcgacatcctggtggactgcagcgggggccagcagcacttcctcaaggacaacctgatcgacctggggtgcccgaacatccccctcctgggcaagatggccatctacatctgccggatgtccaaccaccccaagacgaccatggcgttcctgttctggttcagcttcgggtacgtgatcacgtgcatcctctgcaaggtcatcttctacctgctgatcgtggtgggcaccctcggcaagaagttcaagcagtaccgcgagctgaagccccagacctgcaccatctgcgagaccaccccggtcaacgccatcgacgccgagatgcacgacctgaactgctcctacaacatctgcccctactgcgccagccggctcacctccgacgggctggcgcgccacgtgatgcagtgccccaagcggaaggagaagatcgaggagacggagctgtacctcaacctggagcgcatcccctgggtggtccggaagctgctccaggtgagcgagtccaccggcgtggccctgaagcgcagctcctggctgatcgtcctcctggtgctgctcaccgtgagcctgtccccggtccagagcgcccccatcgggcacggcaagaccatcgagacgtaccagacccgggaggggtacacctccatctgcctgttcgtgctcggcagcatcctgttcatcgtgtcccacctgatgaagggcctcgtcgacagcgtggggaacagcttcttccccggcctgtccatctgcaagacctgcagcatcgggtccatcaacggcttcgagatcgagagccacaagtgctactgctccctgttctgctgcccctactgccgccactgcagcgccgacaaggagatccacaagctccacctgtccatctgcaagaagcggaaggccgggagcaacgtgatgctggcggtctgcaagcgcatgtgcttccgggccacgatggaggtgtccaacaaggccctcctgatccgcagcgtgatcaacaccaccttcgtcgtgtgcatcctgatcctcgccgtgtgcgtcgtgtccaccagcgccgtggagatggagtccctgccggcgggcacgtgggagcgcgaggaggacctgaccaacttctgccaccaggagtgccaggtcaccgagaccgagtgcctctgcccctacgaggccctggtgctgcggaagcccctcttcctggacagcatcgccaagggcatgaagaacctgctcaactccacgagcctggagacctccctgagcatcgaggccccgtggggcgccatcaacgtgcagtccaccttcaagcccaccgtcagcacggcgaacatcgccctcagctggtccagcgtggagcaccgcgggaacaagatcctggtgtccgggcggagcgagtccatcatgaagctggaggagcgcaccggcatcagctgggacctcggggtcgaggacgcctccgagagcaagctgctgaccgtgtccgtgatggacctcagccagatgtactcccccgtcttcgagtacctgagcggcgaccgccaggtggaggagtggcccaaggcgacctgcacgggcgactgcccggagcggtgcgggtgcacctccagcacgtgcctgcacaaggagtggccccactcccggaactggcgctgcaaccccacctggtgctggggcgtggggaccggctgcacgtgctgcggcctcgacgtcaaggacctgttcaccgactacatgttcgtgaagtggaaggtcgagtacatcaagaccgaggccatcgtgtgcgtggagctgaccagccaggagcggcagtgctccctcatcgaggccgggacccgcttcaacctgggccccgtcaccatcaccctgagcgagccgcggaacatccagcagaagctcccgcccgagatcgtgacgctgcacccccgcatcgaggaggggttcttcgacctgatgcacgtgcagaaggtcctctccgccagcaccgtgtgcaagctgcagagctgcacccacggcgtgcccggggacctgcaggtctaccacatcggcaacctcctgaagggcgacaaggtgaacgggcacctgatccacaaggtggagccccacttcaacacctcctggatgagctgggacggctgcgacctcgactactactgcaacatgggggactggccctcctgcacctacacgggcgtcacccagcacaaccacgccgccttcgtgaacctgctgaacatcgagaccgactacaccaagaacttccacttccacagcaagcgggtgacggcgcacggggacacgccccagctcgacctgaaggcccgcccgaactacggcgccggcgagatcaccgtcctggtggaggtggccgacatggagctccacaccaagaagatcgagatctccgggctgaagttcgccagcctgacctgcaccggctgctacgcgtgctccagcgggatctcctgcaaggtccggatccacgtggacgagcccgacgagctcaccgtgcacgtcaagagcgaggaccccgacatcgtggccgcctccagctccctgatggcccgcaagctggagttcggcaccgacagcacgttcaaggccttctccgcgatgcccaagaccagcctctgcttctacatcgtggagcgggagtactgcaagtcctgcagcaaggaggacacccagaagtgcgtcaacgccaagctggagcgcccgcagtccatcctgatcgagcacaaggggaccatcatcggcaagcagaacgacacgtgcaccgccaaggccagctgctggctcgagagcgtgaagtccttcttctacggcctgaagaacatgctgagcgggatcttcggcaacgtgttcatcgggatcttcctgttcctcgcgcccttcatcctgctgatcctcttcttcatgttcggctggcggatcctgttctgcttcaagtgctgccgccggacccgcggcctgttcaagtaccgccacctcaaggacgacgaggagaccgggtaccggaagatcatcgagcgcctgaacaacaagaagggcaagaacaagctgctcgacggggagcggctggccgaccgcaagatcgccgagctgttctccacgaagacccacatcggctga

SEQ ID NO: 12019 - RNA, 5055 nt, synthetic construct
  misc_feature 1..5055: note = derived and/or modified CDS sequence (opt1) from CCHFV(BA66019)__AF350448.1__GP
  source 1..5055: mol_type = other RNA
atgtacaccctgctcgtgtgcgccgtcctgtgcccccagctgtggagcctcgagggcacccacgtgccgcacaacgagacgaagcacaacgggaccggcatcaccgccgcgcccggggagtcccagggccccatgagccccgcctccaccgccgtgccgctgacgcccgagccgcccaacaccaagcccgccgccagcgcgtccgagctggagagctccggggagggccacaccagcctcctggccaccacgcagggcctgacctcccccgaggccacccccgagctccccaccacgaccgacaccggggtcagctccaccagcgtggtggacatcggcacgcagatggccaaggacaccccgacctccaccgcgcacacgagcctgccctccaaccccagcgccccctccaccgcccaggggacccaccacaccatccgcggcctgctcagcgtcacgtccaccaagccggaggaggccagcacccccaccgaccccgggaaggccggcgcggagacgggcagcccccggccggccatctcccgcaagcccaccctgagccccaccgccgaggcccccaccgagatcaacaactccagcacgccgaagcagcccgagccctccatccagcccgccaccccgagcctggtgatctcccccgcgcagcccgccttcccgcagagcgccacctccaccgccgcccaggacatctacagctcccccacgaaccggagcaagcgcaacctcaagatggagatcatcctgaccctgtcccaggggctcaagaagtactacggcaagatccagaagaccctggggctgaccctcgaggaggacaccgagggcctgctggagtggtgcaagcggaacctcggcctgacgtgcgacgacaacttcttccagaagcgcatcgaggagttcttcctgaccggggagggctacttcaacgaggtgctccagttcaagacccccagcacccccgggtccacggagccgacccacgcggaggcccccaccgtcaagcccttcaagagctacttcgcccggggcttcctgaccatcaactccgggtacttcagcgccaagtgctactcctggacgagcaacagcggcctgcagctcatcaacgtgacccagcaccccgcccgcatcgcggacaccccgggccccaagatcaccaacctgaagacgatcaactgcatcaacctgaaggcctccgtgttcaaggagcaccgggagatcgagatcaacgtcctcctgccccaggtggccgtgaacctgagcaactgccacgtcctcatcaagtcccacgtgtgcgactacagcctggacatcgacgggaccatccgcctgccccggatctaccacgagggcaccttcatcccggggacctacaagatcgtgatcgacaagcgcgacaagcagaacgaccggtgcacgctcgtcaccaactgcgtgatcaagggccgcgaggtgcggaaggggcagtccgccctgcgccagtaccggaccgagatccgcatcggcaaggcgagcgccggctcccggcgcctgctcagcgaggagtccggggacgactgcatcagccggacccagctgctgcgcacggagaccgccgaggtccacggcgacaactacgggggccccggggacaagatcaccatctgcaacggctccaccatcgtggaccagcgcctcggcagcgagctggggtgctacacgatcaaccgggtgaagtccttcaagctgtgcgagaacagcggcaccgggaagtcctgcaagatcgacaagcaccccgtcaagtgccgccagggcttctgcctcaagatcacccaggagggccgggggcacgtgaagctgagccgcggctccgaggtcgtgctggacgcctgcgacagcagctgcgagatcatgatccccaaggggaccggcgacatcctggtggactgctccgggggccagcagcacttcctcaaggacaacctggtcgacctgggctgcccgaacatccccctcctggggaagatggccatctacatctgccggatgagcaaccaccccaagacgaccatggcgttcctgttctggttctccttcggctacgtgatcacgtgcatcttctgcaagatcatcttctacctcctgatcgtggtcgggaccctgggcaagaagttcaagcagtaccgcgagctcaagccccagacctgcaccatctgcgagaccaccccgacgaacgccatcgacgccgagatgcacgacctgaagtgcagctacaacatctgcccctactgcgcctcccggctgaccagcgacgggctcgcccgccacgtgacccagtgccccaagcggaaggagaaggtggaggagaccgagctgtacctgaacctcgagcgcatcccctggatcgtccggaagctgctccaggtgtccgagagcaccggcgtggcgctgaagcgctccagctggctgatcgtcctgctcgtgctgctgacggtgtccctcagcccggtccagtccgcccccatcggccacgggaagaccatcgaggcctaccagacccgggagggctacaccagcgtgtgcctgttcatgctcgggggcatcctgttcgtggtctcctgcctgatgaaggggctggtggacagcgtgtccaacagcttcttccccggcctctccatctgcaagacgtgcagcatcggcagcgtcaacgggttcgagatcgagtcccacaagtgctactgcagcctgctgtgctgcctctactgccgccactgctccgccgaccgggagatccaccagctgcacctgagcatctgcaagaagcgccgggccggcgggaacgtgatgctcgcggtgtgcaagcgcatgtgcctgcgggccaccatggaggtctccaacaaggtgctgttcatccgcagcatcatcaacaccaccttcgtgatctgcatcctcgtcctggccgtgtgcatcgtgtccacgagcgccgtcgagatggagtccctgccggcgggcacctgggagcgcgaggaggacctcaccaacttctgccaccaggagtgccaggtgaccgagacggagtgcctgtgcccctacgaggccctggtgctccggaagcccctgttcagcgactccatcgtcaaggggatgaagaacctgctcaacagcacctccctggagaccagcctgtccatcgaggccccctggggcgccatcaacgtgcagagcaccttcaagccgacggtgtccaccgccaacatcgcgctcagctggtccagcgtcgagcaccgcggcaacaagatcctggtgagcgggcggtccgagagcatcatgaagctggaggagcgcaccggcatctcctgggacctcggggtggaggacgccagcgagtccaagctgctgaccgtcagcgtgatggacctctcccagatgtacagccccgtgttcgagtacctgtccggcgaccggcaggtcgaggagtggcccaaggccacgtgcaccggcgactgccccgaccgctgcgggtgcaccagctccacgtgcctgcacaaggagtggccgcacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaactcccaggagcggcagtgcagcctcatcgaggccggcacccgcttcaacctgggccccgtgaccatcaccctgtccgagccccggaacatccagcagaagctcccgcccgagatcatcacgctgcacccccgcatcgaggaggggttcttcgacctgatgcacgtgcagaaggtcctcagcgcgtccaccgtgtgcaagctgcagagctgcacccacggcgtccccggggacctgcagatctaccacatcggcaacctcctgaagggggaccgggtgaacggccacctgatccacaagatcgagccgcacttcaacacctcctggatgagctgggacggctgcgacctcgactactactgcaacatgggggactggcccagctgcacgtacaccggcgtgacccagcacaaccacgccgccttcgtcaacctgctgaacatcgagaccgactacaccaagaacttccacttccactccaagcgcgtgacggcccacggggacacgccccagctcgacctgaaggcccggcccacctacggcgcgggggagatcaccgtgctggtcgaggtggccgacatggagctccacaccaagaagatcgccatcagcggcctgaagttcgcctccctgacctgcaccggctgctacgcgtgcagctccgggatcagctgcaaggtgcgcatccacgtcgacgagccggacgagctcaccgtgcacgtgaagtccgaggaccccgacatcgtcgccgccagctccagcctgatggcccggaagctggagttcggcacggactccaccttcaaggccttcagcgcgatgcccaagacctccctctgcttctacatcgtggagcgcgagtactgcgagagctgctccaaggaggacacccagaagtgcgtgaacacgaagctggagcagccccagagcatcctgatcgagcacaaggggaccatcatcggcaagcagaacgacacgtgcaccgccaaggcctcctgctggctcgagagcgtcaagtccttcttctacggcctgaagaacatgctgagcgggatcttcggcaacgtgttcatcgggatcttcctcttcctggccccgttcatcctgctgatcctcttcttcatgttcggctggcggatcctgttctgcttcaagtgctgccgccggacccgcgggctgttcaagtaccgctacctcaaggacgacgaggagagcggctaccggcgcatcatcgagcggctgaacaacaagaagggcaagaacaagctgctcgacggggagcgcctggccgaccggcgcatcgcggagctgttctccaccaagacccacatcggctga

SEQ ID NO: 12020 - RNA, 5055 nt, synthetic construct
  misc_feature 1..5055: note = derived and/or modified CDS sequence (opt1) from CCHFV(SPU 18/88)__KJ682810.1__GP
  source 1..5055: mol_type = other RNA
atgtacacgcccctgctctgcgccatcctgtgcctgcagctctggagcctggagggcatctacgggctgtccaacaagacccagcacaacgacaccagcaccatcaaggtgccggaggagtcccagaagaccagcctccccgccaacaccgcgtcccccatcacgagcgacccctccagcgccacctccaccgccctggccagcggcccggaggggtccggcgacaccagcacgtcccccagcgtcaccacccaggggcccaccctgctcgagacgacccccgagccgcacaccaccatcgacatcgacgagtccagcacggccatcgcggacatctccacccagaccgtgaaggacatccccacccccacgacccacaccagcctgccctccaccccgagcgcccccacgatcccccaggaggcccaccacaccgcccgcggcctgctcagcgtgacctccaccaagcccggcgagacgagcaccccgacctcccccggggaggcgagcaccgaggcctccagcccccagcccacgatctccgagaccccgagcccgccgcccaccacccaggcccccacggagatcaacaaccccaacacctcccggcagcccatgcccagcacccagccggccgcccccaactccgtcacgcccccggtgcagcccaccttcagccagtccgacgtgagcaccgtcgcgcaggacatccacccctcccccaccaaccgcagcaagcggaacctggagatggagatcatcctgaccctctcccagggcctgaagaagtactacgggaaggtgctgaagctcctggacctgaccctcgaggaggacacggagggcctgctggagtggtgcaagcgcaacctcgggctgacctgcgacgacaacttcttccagaagcggatcgaggagttcttcctgaccggcgagggccacttcaacgaggtgctccagttcaagaccccgagcacgctgtcccccaccgagcccgcccgcgtcgagagccccaccgtggagccgttcaagagctacttcgccaaggggttcctgtccatggacagcggctacttctccgccaagtgctaccccaagagctccaacagcgggctccagctgatcaacgtgacccagcactccatccggatcacggacacccccggccccaagatcaccagcctgaagaccatcaactgcatcaacctcaaggccctggtcttcaaggagcaccgcgagatcgagatcaacgtgctgctcccccaggtggcggtcaacctgtccaactgccacgtgctgatcaagagccacgcctgcgactactccctcgacatcgacggccccgtgcggctgccccgcatccaccacgaggggacgttcatccccggcacctacaagatcgtcatcgacaagaagaacaagcagaacgaccggtgcaccctggtgaccaactgcgtgatcaaggggcgcgagatccggaagggccagagcgtcctccgccagtaccggacggagatcaagatcgggaaggcctccagcggctcccgccggctgctgagcgaggagtccaacgacgactgcctcagccgcacccagctgctgcggaccgagaacgccgagatccacagcgacaactacggcgggccgggcgacaagatcaccatctgcaacgggtccacgatcgtggaccagcgcctcggcagcgagctggggtgctacaccatcaaccgggtgaagtccttcaagctgtgcgagaacagcgccaccggcaagtcctgcgagatcgacagcacccccgtccgctgccgccagggcttctgcctgaagatcacgcaggaggggcggggccacgtgaagctctcccgcgggagcgaggtcgtgctggacgcgtgcgactccagctgcgagatcatgatccccaagggcaccggggacatcctggtggactgctccggcggccagcagcacttcctcaaggacaacctggtcgacctggggtgccccaacatcccgctcctgggcaagatggccatctacatctgccggatgagcaaccaccccaagaccaccatggggttcctgttctggttctccttcggctacgtgatcacgtgcatcctctgcaaggtgatcttctacctgctgatcgtcgtgggcaccctcgggaagaagttcaagcagtaccgcgagctgaagccccagacctgcaccatctgcgagacgaaccccgtgaacgccatcgacgccgagatgcacgacctgaactgcagctacaacatctgcccgtactgcgcctcccggctcaccagcgacggcctggcgcgccacgtcatgcagtgccccaagcggaaggagaagatcgaggagaccgagctgtacctcaacctggagcgcatcccctgggtggtgcggaagctgctccaggtctccgagagcaccggggtggccctgaagcgctccagctggctggtgatcctcctggtcctgctcaccgtgagcctgtccccggtgcagagcgcccccatctcccacggcgagacggtcgaggtgtaccagacccgggaggggtacaccagcatctgcctgttcgtgctcggctccatcctgttcctggtcagctgcctcatgaagggcctggtggactccgtggggaacagcttctcccccggcctgagcatctgcaagacctgctccatcgggagcatcaacggcttcgagatcgagtcccacaagtgctactgcagcctcttctgctgcccctactgccgccactgctccgccgacatcgagatccacaagctgcacctgagcatctgcaagaagcggaagacggggtccaacgtcatgctcgcggtgtgcaagcgcatgtgcttccgggccaccgtggaggtcagcaacaaggccctgctgatccgcaacatcatcaacaccaccttcgtggtgtgcatcctcatcctggccgtctgcgtggtgtccacgagcgccgtcgagatggagaacctgccggcgggcacctgggagaaggaggaggacctcaccaacttctgccaccaggagtgccaggtgaccgagacggagtgcctgtgcccctacgaggccctggtgctccggaagcccctgttcctggacagcatcgtcaagggcaagaagaacctcctgaactccaccagcctggagacctccctcagcatcgaggccccctggggcgccatcaacgtgcagtccaccttcaagccgacggtgagcgccgcgaacatcgccctgtcctggagctccgtcgagcaccgcgggaacaagatcctggtgagcgggcggtccgagagcatcatgaagctcgaggagcgcaccggcatctcctgggacctgggggtggaggacgccagcgagtccaagctgctcaccgtcagcgtgatggacctgtcccagatgtacagccccgtgttcgagtacctgtccggcgaccgccaggtcgaggagtggcccaaggcgacctgcacgggcgactgccccgagcggtgcgggtgcaccagcagcacgtgcctccacaaggagtggccgcactcccgcaactggcggtgcaaccccacctggtgctggggcgtggggaccggctgcacgtgctgcgggctggacgtgaaggacctgttcaccgactacatgttcgtcaagtggaaggtggactacatcaagaccgaggccatcgtgtgcgtcgagctcaccagccaggagcgccagtgctccctgatcgaggccggcacccggttcaacctgggccccgtgaccatcaccctcagcgagccccgcaacatccagcagaagctgccgcccgagatcgtcacgctgcacccccggatcgaggaggggttcttcgacctcatgcacatccagaaggtgctgtccgccagcaccgtgtgcaagctgcagtcctgcacccacggcgtccccggggacctccagatctaccacatcggcaacctgctgaagggcgacaaggtgaacgggcacctcatccacaagatcgagccgcacttcaacaccagctggatgtcctgggacggctgcgacctggactactactgcaacatgggggactggcccagctgctcctacacgggcgtgacccagcacaaccacgccgccttcgtcaacatgctgaacatcgagaccgactacaccaagaacttccacttccacagcaagcgcgtgaccgcgcacggggacacgccccagctcgacctgaaggcccggcccacctacggcgccggcgagatcaccgtgctggtcgaggtggccgacatggagctccacaccaagaagatcgagatctccgggctgaagttcgccagcctgacgtgcaccggctgctacgcgtgctccagcgggatctcctgcaaggtgcgcatccacgtcgacgagccggacgagctcaccgtgcacgtcaagagcgaggaccccgacatcgtggccgcctccagcagcctgatggcccggaagctggagttcggcaccgactccacgttcaaggccttcagcgcgatgcccaagacctccctctgcttctacatcgtggagcgcgagtactgcaagagctgctccaaggaggacacccagaagtgcgtgaacaccaagctggagcagccccagagcatcctgatcgagcacaaggggacgatcatcggcaagcagaacgacacgtgcaccggcaaggccgggtgctggctcgagtccatcaagagcttcttctacggcctgaagaacatgctgtccgggatcttcggcaacgtcttcatcgggatcttcctgttcctcgccccgttcatcatgctgatcctgttcttcatgttcggctggcggatcctcttctgcttcaagtgctgccgccggacccgcggcctgttcaagtaccggcacctgaaggacgacgaggagatcgggtaccgcaagatcatcgagcggctcaagaacaagaagggcaagaacaagctgctggacggggagcgcctcgccgaccggaagatcgccgagctgttcagcaccaagacccacatcggctga

SEQ ID NO: 12021 - RNA, 5055 nt, synthetic construct
  misc_feature 1..5055: note = derived and/or modified CDS sequence (opt1) from CCHFV(66019)__AB069669.1__GP
  source 1..5055: mol_type = other RNA
atgtacaccctgctcgtgtgcgccgtcctgtgcccccagctgtggagcctcgagggcacccacgtgccgcacaacgagacgaagcacaacgggaccggcatcaccgccgcgcccggggagtcccagggccccatgagccccgcctccaccgccgtgccgctgacgcccgagccccccaacaccaagccggccgccagcgcgtccgagctggagagctccggggagggccacaccagcctcctggccaccacgcagggcctgacctcccccgaggccacccccgagctccccaccacgaccgacaccggggtcagctccaccagcgtggtggacatcggcacgcagatggccaaggacaccccgacctccaccgcgcacacgagcctgccctccaaccccagcgccccctccaccgcccaggggacccaccacaccatccgcggcctgctcagcgtcacgtccaccaagccggaggaggccagcacccccaccgaccccgggaaggccggcgcggagacgggcagcccccggccggccatctcccgcaagcccaccctgagccccaccgccgaggcccccaccgagatcaacaactccagcacgccgaagcagcccgagccctccatccagcccgccaccccgagcctggtgatctcccccgcgcagcccgccttcccgcagagcgccacctccaccgccgcccaggacatctacagctcccccacgaaccggagcaagcgcaacctcaagatggagatcatcctgaccctgtcccaggggctcaagaagtactacggcaagatccagaagaccctggggctgaccctcgaggaggacaccgagggcctgctggagtggtgcaagcggaacctcggcctgacgtgcgacgacaacttcttccagaagcgcatcgaggagttcttcctgaccggggagggctacttcaacgaggtgctccagttcaagacccccagcacccccgggtccacggagccgacccacaccgaggcgcccaccgtcaagcccttcaagagctacttcgcccggggcttcctgacgatcgactccgggtacttcagcgccaagtgctactcccgcaccagcaacagcggcctgcagctcatcaacgtgacccagcaccccgcccggatcgccgacaccccgggccccaagatcacgaacctgaagaccatcaactgcatcaacctgaaggcgtccgtgttcaaggagcaccgcgagatcgagatcaacgtcctcctgccccaggtggccgtgaacctgagcaactgccacgtcctcatcaagtcccacgtgtgcgactacagcctggacatcgacgggaccatccggctgccccgcatctaccacgagggcaccttcatcccggggacgtacaagatcgtgatcgacaagcgggacaagcagaacgaccgctgcaccctcgtcaccaactgcgtgatcaagggccgggaggtgcgccgggggcagtccgccctgcgccagtaccggaccgagatccgcatcggcaaggccagcgcgggctcccggcgcctgctcagcgaggagtccggggacgactgcatcagccgcacgcagctgctgcggaccgagaccgccgaggtccacggcgacaactacgggggccccggggacaagatcaccatctgcaacggctccacgatcgtggaccagcgcctcggcagcgagctggggtgctacaccatcaaccgggtgaagtccttcaagctgtgcgagaacagcggcaccgggaagtcctgcaagatcgacaacacccccgtcaagtgccgccagggcttctgcctcaagatcacgcaggagggccgggggcacgtgaagctgagccgcggctccgaggtcgtgctggacgcctgcgacagcagctgcgagatcatgatccccaaggggaccggcgacatcctggtggactgctccgggggccagcagcacttcctcaaggacaacctggtcgacctgggctgcccgaacatccccctcctggggaagatggccatctacatctgccggatgagcaaccaccccaagaccaccatggccttcctgttctggttctccttcggctacgtgatcacgtgcatcttctgcaagatcatcttctacctcctgatcgtggtcgggaccctgggcaagaagttcaagcagtaccgcgagctcaagccccagacctgcaccatctgcgagacgaccccgaccaacgcgatcgacgccgagatgcacgacctgaagtgcagctacaacatctgcccctactgcgcctcccggctgaccagcgacgggctcgcccgccacgtgacccagtgccccaagcggaaggagaaggtggaggagacggagctgtacctgaacctcgagcgcatcccctggatcgtccggaagctgctgcaggtgtccgagagcaccggcgtggccctcaagcgctccagctggctgatcgtcctgctcgtgctgctgaccgtgtccctcagcccggtccagtccgcgcccatcggccacgggaagaccatcgaggcctaccagacgcgggagggctacaccagcgtgtgcctgttcatgctggggggcatcctcttcgtggtctcctgcctgatgaaggggctggtggacagcgtgtccaacagcttcttccccggcctctccatctgcaagacctgcagcatcggcagcgtcaacgggttcgagatcgagtcccacaagtgctactgcagcctgctgtgctgcctctactgccgccactgctccgccgaccgggagatccaccagctgcacctgagcatctgcaagaagcgccgggccggcgggaacgtgatgctcgccgtgtgcaagcgcatgtgcctgcgcgcgaccatggaggtctccaacaaggtgctgttcatccggagcatcatcaacacgaccttcgtgatctgcatcctcgtcctggccgtgtgcatcgtgtccaccagcgccgtcgagatggagtccctgccggccggcacctgggagcgcgaggaggacctcacgaacttctgccaccaggagtgccaggtgaccgagaccgagtgcctgtgcccctacgaggcgctggtgctccggaagcccctgttcagcgactccatcgtcaaggggatgaagaacctgctcaacagcacctccctggagacgagcctgtccatcgaggccccctggggcgccatcaacgtgcagagcaccttcaagccgaccgtgtccaccgccaacatcgccctcagctggtccagcgtcgagcaccgcggcaacaagatcctggtgagcgggcggtccgagagcatcatgaagctggaggagcgcacgggcatctcctgggacctcggggtggaggacgcgagcgagtccaagctgctgaccgtcagcgtgatggacctctcccagatgtacagccccgtgttcgagtacctgtccggcgaccggcaggtcgaggagtggcccaaggccacctgcaccggcaactgccccgaccgctgcgggtgcacgagctccacctgcctgcacaaggagtggccgcacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaactcccaggagcggcagtgcagcctcatcgaggccggcacccgcttcaacctgggccccgtgacgatcaccctgtccgagccccggaacatccagcagaagctcccgagcgagatcatcaccctgcacccccgcatcgaggaggggttcttcgacctgatgcacgtgcagaaggtcctctccgccagcaccgtgtgcaagctgcagtcctgcacgcacggcgtccccggggacctgcagatctaccacatcggcaacctcctgaagggggaccgggtgaacggccacctgatccacaagatcgagccccacttcaacaccagctggatgagctgggacggctgcgacctcgactactactgcaacatgggggactggccgtcctgcacctacaccggcgtgacccagcacaaccacgcggccttcgtcaacctgctgaacatcgagacggactacaccaagaacttccacttccacagcaagcgcgtgaccgcccacggggacaccccccagctcgacctgaaggcccggcccacgtacggcgccggggagatcaccgtgctggtcgaggtggcggacatggagctccacaccaagaagatcgccatctccggcctgaagttcgccagcctgacctgcacgggctgctacgcctgctccagcgggatctcctgcaaggtgcgcatccacgtcgacgagcccgacgagctcaccgtgcacgtgaagagcgaggacccggacatcgtcgcggcctccagctccctgatggcccggaagctggagttcggcaccgacagcaccttcaaggccttctccgccatgcccaagacgagcctctgcttctacatcgtggagcgcgagtactgcgagtcctgcagcaaggaggacacccagaagtgcgtgaacaccaagctggagcagccccagtccatcctgatcgagcacaaggggaccatcatcggcaagcagaacgacacgtgcaccgcgaaggccagctgctggctcgagtccgtcaagagcttcttctacggcctgaagaacatgctgagcgggatcttcggcaacgtgttcatcgggatcttcctcttcctggcccccttcatcctgctgatcctcttcttcatgttcggctggcggatcctgttctgcttcaagtgctgccgccgcacccgggggctgttcaagtaccgctacctcaaggacgacgaggagtccggctaccggcgcatcatcgagcggctgaacaacaagaagggcaagaacaagctgctcgacggggagcgcctggccgaccggcgcatcgccgagctgttcagcaccaagacgcacatcggctga

SEQ ID NO: 12022 - RNA, 5052 nt, synthetic construct
  misc_feature 1..5052: note = derived and/or modified CDS sequence (opt1) from CCHFV(Gaib)__KX013445.1__GP
  source 1..5052: mol_type = other RNA
atgtacatccccctggtgtacgccgtcatctacctccagctgtacggcctcgggggcgcccacgggctcctgaacaagaccgagcagaacgagaccggcatcacggcgacccacgggcgcgtgcagggcccgcccagcgcctccatcaccctgcccgtgacccccgacccgctcagcgccacgtccgccgccagcacctccggccccgaggggagcggcgaggtccccacctcccccagcaccatcacgcaggggctgacctccagcgagaacaccccgcagctgcccaccgcgacggacaccggcatctccagcacctccatcatcgacgtgagcacccagacggccggggacacctccacccccaccgcccacacgagcctccccaactccccgagcgcccccttcacctcccaggacacccggcacaccgtgcgcggcctgctgacggtcaccagcaccaagagcgacgaggcgtccaccctcacggaccccaaggaggccagcaccgaggcccggtcccccagcccgtccatcagccgcacccccaccccctcccccacggtgcaggccagcaccgagaacaacaccccgtccacgccccggcagcccgagcccaccacccgcccggccctgcccagccccaccacctcccccacccagccgagcctgtcccagagcgcgacgtccgccgccatccaggacatgcaccccagccccaccaaccggtcccgccggaacctcgagatggagatcatcctgaccctgagccagggcctcaagaagtactacgggaagatcctgaagctgctcgacctgaccctggaggaggacacggagggcctcctggagtggtgcaagcgcaacctggacctgacctgcgacgagaacttcttcctgaagcggatcgaggagttcttcctgtccggggagggccacttcaacgaggtgctccagttcaaggccccgagcaccatgagctccaccgagcccacgcacgccggcccgcccaccgtcgagcccttcaagagctacttcgcgaaggggttcctgtccatcgacagcggctacttctccgccaagtgctacccccgcaccagcaactccgggctgcagctcatcaacgtgacccagcacacggcccggatcgccgacacccccggccccaagatcaccaacgtgaagaccatcaactgcatcaacctgaaggccagcgtcttcaagaagcaccgcgaggtggagatcaacgtgctgctcccgcagatcgcggtcaacctgtccaactgccacgtgctgatcaagagccacgtgtgcgactactccctcaacttcgacgggatggtccggctgccccgcatccaccacgagggcacgttcatccccggcacctacaagatcgtgatcgaccggaagaacaagcagaacgaccgctgcaccctggtgaccaactgcgtcatcaaggggcgggaggtgcgcaagggccagagcgccctccggcagtaccgcacggagatcaagatcggggaggcctccatcggcagccgccggctgctgtccgaggagagctccgacgactgcatcagccgcacccagctcctgcggaccgagaccgccgagatccacaacgacaactacgggggccccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccatcccggtgaagtgccgccaggggttctgcctgaagatcacgcaggagggccggggccacgtcaagctgagccgcgggtccgaggtggtgctcgacgcgtgcgacagctcctgcgagatcatgatccccaagggcaccggggacatcctggtcgactgcagcggcggccagcagcacttcctgaaggacaacctcatcgacctggggtgccccaacatccccctgctcggcaagatggccatctacatctgccggatgtccaaccacccgaagaccaccatggccttcctgttctggttcagcttcgggtacgtgatcacgtgcatcttctgcaaggccatcttctacctgctcatcatcgtgggcaccctggggaagaagttcaagcagtaccgcgagctgaagccccagacctgcaccatctgcgagacgacccccgtcaacgcgatcgacgccgagatgcacgacctcaactgctcctacaacatctgcccctactgcgccagccggctgacctccgacggcctggcccgccacgtggtgcactgcccgaagcggaaggagaagatcgaggagaccgagctctacctgaacctggagcgcgtcccctgggtggtgcggaagctcctgcaggtcagcgagtccaccggcgtggccctgaagcgcagctcctggctcatcgtgctgctggtcctcctgacggtgagcctgagccccgtgcagtccgcgcccatcgggcacggcaagaccatcgagacctaccagacccgggaggggtacacgagcatctgcctcttcgtcctgggcgggatcctgttcatcgtgtcctgcctcatgaagggcctggtggacagcgtcggcaacaacttcttcccggggctgaccatctgcaagacctgctccatcagctccatcaacggcttcgagatcgagagccacaagtgctactgctccctcctgtgctgcccctactgccgccactgcagcgccgaccgggagatccaccagctgcacctctccatctgcaagaagcgcaagaccgggagcaacgtgatgctggccgtgtgcaagcgcatgtgcctgcgggtcacgaccgaggtgtccaaccgcgccctcttcatccggagcatcatcaacaccaccttcgtgatctgcatcctgatcctggccgtctgcgtgatctccacgagcgcggtggagatggagaacctccccgccggcacctgggagcgcgaggaggacctgaccaacttctgccaccaggagtgccaggtcaccgagacggagtgcctgtgcccgtacgaggccctcgtgctgcggaagcccctgttctccgacagcatcgtgaaggggatgaagaacctcctgaactccaccagcctggagaccagcctctccatcgaggccccctggggcgccatcaacgtccagagcaccttcaagcccacggtgtccaccgcgaacatcgccctgagctggtccagcatcgagcaccgcggcaacaagatcctggtgtccgggcggagcgagtccatcatgaagctcgaggagcgcaccggcatcagctgggacctgggggtcgaggacgcctccgagagccggctgctcaccgtgtccgtgatggacctgagccagatgtactccccggtcttcgagtacctgagcggcgaccgccaggtggaggagtggcccaaggccacgtgcaccggggactgccccgagcggtgcggctgcacctccagcacgtgcctccacaaggagtggccccactcccgcaactggcggtgcaacccgacctggtgctggggcgtggggaccggctgcacgtgctgcgggctggacgtcaaggacctgttcaccgactacatgttcgtgaagtggaaggtggagtacatcaagaccgaggcgatcgtctgcgtggagctcaccagccaggagcgccagtgcagcctgatcgaggccggcacccggttcaacctgggccccgtgaccatcacgctctccgagccccgcaacatccagcagaagctgcccccggagatcatcaccctgcacccccggatcgaggaggggttcttcgacctcatgcacgtccagaaggtgctgagcgcctccaccgtgtgcaagctgcagagctgcacccacggcgtccccggggacctccaggtgtaccacatcggcaacctgctgaagggggacaaggtcaacggccacctcatccacaagatcgagccccacttcaacacctcctggatgagctgggacggctgcgacctggactactactgcaacatgggggactggccgtcctgcacgtacaccggcgtgacccagcacaaccacgccgccttcgtgaacctgctcaacatcgagaccgactacacgaagaacttccacttccacagcaagcgcgtcaccgcgcacggggacacgccccagctggacctgaaggcccggcccacctacggcgccggggagatcaccgtgctcgtggaggtcgccgacatggagctgcacaccaagaagatcgagatctccggcctgaagttcgccagcctgacctgcaccggctgctacgcgtgctccagcgggatctcctgcaaggtgcgcatccacgtggacgagcccgacgagctcacggtccacgtcaagagcgaggacccggacatcgtggccgcctccagctccctgatggcccggaagctcgagttcggcaccgacagcaccttcaaggccttctccgcgatgcccaagaccagcctgtgcttctacatcgtggagcgcgagtactgcaagagctgctcccgcgaggacacgcagaagtgcgtgagcaccaagctggagcagccccagtccatcctcatcgagcacaaggggaccatcatcggcaagcagaacaacacgtgcaccaccaagacgacctgctggctggagagcgtgaagtccttcttctacgggctgaagaacatgctcagctccatcttcggcaacgtcttcgtgggcatcttcagcttcctggcccccttcatcctgctgatcctcttcttcatgttcgggtggcggatcctgttctgcttcaagtgctgccgccggacccgcggcctgttcaagtaccggcacctcaaggacgacgaggagaccgggtaccgccggatcatcgagcgcctgaacaacaagaagggcaagtccaagctgctcgacggcgagcggctggccgaccgcaagatcgccgagctgttcagcaccaagacccacatcgggtga

SEQ ID NO: 12023 - RNA, 5055 nt, synthetic construct
  misc_feature 1..5055: note = derived and/or modified CDS sequence (opt1) from CCHFV(SPU415/85)__DQ211635.1__GP
  source 1..5055: mol_type = other RNA
atgtacacccccctggtgtgcgccgtcatctgcctccagctgtggaacctgggcgggaccctcgtgttcatcaaccgcacgcagcacaacgagaccggcaccgtggccaccccggaggggacgctgcggccccgcctgcccgtcagcaccgcgctccccaccaagtccgaccggccgagcgtgggccccgccgcctccagctccgggctggagggcagcggcgagcccaacacctcccccagcatcacgaccaaggggctgaccccgcccgagaccacgcccgccctccccaccgccaccgacaccgacgcgtccagcacgggcgtggtcgacgtgtccacccagatgaccaaggacatcccgatgagcaccgcctacacgaaccccccctccacccccagcgccccgtccaccccccaggggacccaccacacggcccgcggcctgctgagcgtggcgtccaccaagagcgaggaggtctccatgagcaccagccccgccaagacctccacggagaccagctcccccccgcccgccaccagcgagacccccacgccctccccgaccacccaggtgcccaccgggaacaacaaccccaacacgagccggcagcccaccccgtccgcccagcccgccatgagcaaccccgcgacctccccggcccagcccaacctcagccagtccgccccccccaccgccgaccagggcgtgcacccgagccccaccaaccgctccaagcggaacctggagatcgagatcatcctgacgctcagccagggcctgcgcaagtactacgggaagatcctgaagctcctggacctgaccctcgaggaggacaccgagggcctgctggagtggtgcaagcggaacctcgggctgacctgcgacgacaacttcttccagaagcgcatcgaggagttcttcctgacgggcgagggctacttcaacgaggtcctccagttcaaggtgccctccaccctgagctccaccgagcccacccacacgcggccgcccaccgtggagcccttcaagagctacttcgccaaggggttcctgtccatgaacagcggctacttcagcgcgaagtgctacccccgcacctccaacagcgggctccagctgatcaacgtcaccaagcactccgccaagatcgccgacacgccgggccccaagatcaccaacctgaagaccatcaactgcatcaacctccgggccagcgtgttcaaggagcaccgcgaggtggagatcaacgtcctgctgccccaggtggccgtgaacctctccaactgccacgcgcagatcaagagccacgtctgcgactactccctggccaccgacgggatggtgcggctgccccacatccaccacgagggcacgttcatcccgggcacctacaagatcgtgatcgacaagaagaacaagcagaacgaccgctgcaccctcgtcaccaactgcgtgatcaaggggcgggaggtccgcaagggccagagcgccctgcggcagtacaagacggagatccgcatcgggaaggcctccagcggctcccggcgcctgctcagcgaggagtccgacggggactgcatcagccgcacccagctgctgcggaccgagaccacggagatccactccgacaactacggcggccccggggacaagatcaccatctgcaacggcagcaccatcgtggaccagcgcctcgggtccgagctgggctgctacaccatcaaccgggtgaagagcttcaagctgtgcgagaacagcgccacggggaagtcctgcgagatcgacagcacccccgtcaagtgccgccagggcttctgcctcaagatcacccaggagggccgggggcacgtgaagctgtcccgcggcagcgagatcgtgctggacgcgtgcgactccaactgcgagatcatgatccccaaggggaccggcgacatcctggtcgactgcagcggcgggcagcagcacttcctcaaggacaacctgatcgacctgggctgcccgaacatccccctcctggggaagatggccatctacatctgccggatgtccaaccaccccaagacgaccatggccttcctgttctggttcagcttcggctacgtgatcacctgcatcctctgcaaggtgatcttctacctgctgatcgtcgccgggaccgtgggcaagaagttcaagcagtaccgcgagctccggccccagacgtgcaccatctgcgagaccatcccggtgaacgcgatcgacgccgagatgcacgacctgaactgctcctacaacatctgcccctactgcgccagccgcctgacctccgacggcctcgcccggcacgtcatgcagtgccccaagcgcaaggagaaggtggaggagaccgagctgtacctgaacctcgagcggatcccgtgggtggtccgcaagctgctgcaggtgagcgagtccacgggggtggccctcaagcggagctcctggctgaccgtcctgctcgtgctgctgatcgtgagcctctcccccgtccagagcgcgcccatcggccacgggaagaccatcgagacctaccaggcccgcgagggctacacgtccttctgcctgttcatcctggggagcatcctcttcgtggtgagctgcctggtcaagggcctgatcgactccgtgggcaacagcttcttccccgggctctccatctgcaagacctgcagcatcggctccatcaacgggttcgagatcgagagccacaagtgctactgctccctgttctgctgcccgtactgccggcactgcagcgccgaccgcgagatccacaagctgcacctctccatctgcaagaagcggaagaccggcagcaacgtgatgctggccgtctgcaagcgcatgtgcttccgcgccaccatcgaggtgtccaaccgggcgctgctcatccgcaacatcatcaacacgaccttcgtggtctgcatcctgaccctggccgtgtgcgtggtcagcacctccgccgtggagatggagagcctccccgccgggacgtgggagaaggaggaggacctgaccaacttctgccaccaggagtgccaggtgaccgagaccgagtgcctgtgcccctacgaggccctcgtcctgcggaagcccctgttcctcgactccatcgtgaagggcatgaagaacctgctgaacagcacgtccctcgagaccagcctgtccatcgaggcgccgtggggcgccatcaacgtgcagagcaccttcaagcccaccgtcagcgccgccaacatcgcgctgtcctggagctccgtggagcaccgcgggaacaagatcctcgtgagcggccggtccgagagcatcatgaagctggaggagcgcacggggatctcctgggacctgggcgtcgaggacgccagcgagtccaagctcctgaccgtgagcgtgatggacctgtcccagatgtacagccccgtcttcgagtacctctccggggaccggcaggtggaggagtggcccaaggccacctgcaccggcgactgcccggagcgctgcggctgcacgagctccacctgcctgcacaaggagtggccccacagccggaactggcgctgcaaccccacctggtgctggggggtgggcaccgggtgcacgtgctgcggcctggacgtcaaggacctcttcaccgactacatgttcgtgaagtggaaggtggagtacatcaagaccgaggccatcgtctgcgtggagctgacctcccaggagcggcagtgcagcctgatcgaggccggcacgcgcttcaacctcgggcccgtcaccatcaccctgtccgagccgcggaacatccagcagaagctgccccccgagatcatcaccctccacccccgcatcgaggagggcttcttcgacctgatgcacgtgcagcgggtgctgagcgcgagcacggtctgcaagctccagtcctgcacccacggggtgccgggcgacctgcaggtgtaccacatcgggaacctgctcaagggcgacaaggtcaacggccacctgatccacaagatcgagccccacttcaacaccagctggatgtcctgggacgggtgcgacctggactactactgcaacatgggcgactggcccagctgcacctacaccggggtgacgcagcacaaccacgccgccttcgtgaacctcctgaacatcgagaccgactacaccaagaacttccacttccactccaagcgcgtcaccgcccacggcgacacgccccagctggacctcaaggcccggccgacctacggggcgggcgaggtgaccgtgctggtcgaggtggccgacatggagctgcacaccaagaagatcgagatcagcggcctcaagttcgcctccctgacgtgcaccgggtgctacgcctgcagctccggcatcagctgcaaggtgaagatccacgtcgacgagcccgacgagctgaccgtgcacgtgaagtccgaggaccccgacatcgtcgccgcggggagctccctcatggcccgcaagctggagttcggcgccgacagcaccttcaaggccttctccgcgatgcccaagacgagcctgtgcttctacatcgtggagcgggagtactgcaagtcctgcagccgcgaggacacccggaagtgcgtgaacaccaagctcgaccgcccgcagtccatcctgatcgagcacaaggggaccatcatcggcaagcagaacaacacgtgcaccgccaaggccagctgctggctggagagcgtcaagtccttcttctacggcctcaagaacatgctgagcgggatcttcggcaacgtgttcatcgggatcttcctgttcatcgcccccttcgtgctcctgatcctgttcttcatgttcggctggcgcatcctgttctgcttcaagtgctgccggcgcacccggggcctcttcaagtaccgccacctgaaggacgacgaggagaccgggtaccggaagatcatcgagcgcctgaacaacaagaagggcaagaacaagctcctggacggggagcggctggccgaccgcaagatcgcggagctcttctccacgaagagccacatcggctga

SEQ ID NO: 12024 - RNA, 5055 nt, synthetic construct
  misc_feature 1..5055: note = derived and/or modified CDS sequence (opt1) from CCHFV(SPU 431/85)__KJ682812.1__GP
  source 1..5055: mol_type = other RNA
atgtacacgcccctggtgtgcgccgtcatctgcctccagctgtggaacctgggcgggaccctggtgagcaccaaccgcacccagcacaacgagaccgggaccgtggccacccccgaggggaccctgcggccccgcctgcccgtgtccaccgccctccccaccaagagcgaccggccctccgtggggcccgccgccagctccagcgggctggagggctccggcgagcccaacaccagcccctccatcaccaccaaggggctgaccccgcccgagaccacccccgccctccccaccgccaccgacaccgacgccagctccaccggcgtggtcgacgtgagcacccagatgaccaaggacatcccgatgtccacggcctacaccaacccgcccagcaccccctccgccccgagcacgccccaggggacgcaccacaccgcccgcggcctgctgtccgtggcgagcaccaagtccgaggaggtcagcatgagcacctcccccgccaagacgagcaccgagacctcctccccgccgcccgccacctccgagacgcccacccccagccccaccacccaggtgcccacggggaacaacaaccccaacacctcccggcagcccacccccagcgcccagcccgccatgtccaaccccgcgaccagcccggcccagcccaacctctcccagagcgcgccgcccaccgccgaccagggcgtgcacccgtcccccacgaaccgcagcaagcggaacctggagatcgagatcatcctgaccctctcccagggcctgcgcaagtactacgggaagatcctgaagctcctggacctgaccctcgaggaggacaccgagggcctgctggagtggtgcaagcggaacctcgggctgacgtgcgacgacaacttcttccagaagcgcatcgaggagttcttcctgaccggcgagggctacttcaacgaggtcctccagttcaaggtgcccagcaccctgtccagcaccgagcccacgcacacccggccgcccaccgtggagcccttcaagtcctacttcgccaaggggttcctgagcatgaacagcggctacttctccgcgaagtgctacccccgcaccagcaactccgggctccagctgatcaacgtcacgaagcacagcgccaagatcgccgacaccccgggccccaagatcaccaacctgaagaccatcaactgcatcaacctccgggcctccgtgttcaaggagcaccgcgaggtggagatcaacgtcctgctgccccaggtggccgtgaacctcagcaactgccacgcgcagatcaagtcccacgtctgcgactacagcctggccacggacgggatggtgcggctgccccacatccaccacgagggcaccttcatcccgggcacctacaagatcgtgatcgacaagaagaacaagcagaacgaccgctgcaccctcgtcacgaactgcgtgatcaaggggcgggaggtccgcaagggccagtccgccctgcggcagtacaagaccgagatccgcatcgggaaggccagctccggcagccggcgcctgctctccgaggagagcgacggggactgcatctcccgcacccagctgctgcggaccgagacgaccgagatccacagcgacaactacggcggccccggggacaagatcaccatctgcaacggctccaccatcgtggaccagcgcctcgggagcgagctgggctgctacacgatcaaccgggtcaagagcttcaagctgtgcgagaactccgccaccggcaagagctgcgagatcgactccacccccgtcaagtgccgccagggcttctgcctcaagatcacccaggagggccgggggcacgtgaagctgagccgcggctccgagatcgtgctggacgcgtgcgacagcaactgcgagatcatgatccccaaggggacgggcgacatcctggtcgactgctccggcgggcagcagcacttcctcaaggacaacctgatcgacctgggctgcccgaacatccccctcctggggaagatggccatctacatctgccggatgagcaaccaccccaagaccaccatggccttcctgttctggttctccttcggctacgtgatcacgtgcatcctctgcaaggtgatcttctacctgctgatcgtcgccgggacggtgggcaagaagttcaagcagtaccgcgagctccggccccagacctgcaccatctgcgagaccatcccggtgaacgcgatcgacgccgagatgcacgacctgaactgcagctacaacatctgcccctactgcgcctcccgcctgaccagcgacggcctcgcccggcacgtcatgcagtgccccaagcgcaaggagaaggtggaggagacggagctgtacctgaacctcgagcggatcccgtgggtggtccgcaagctgctccaggtgtccgagagcaccggggtggccctcaagcggtccagctggctgaccgtcctgctcgtgctgctgatcgtgtccctcagccccgtccagtccgcgcccatcggccacgggaagaccatcgagacgtaccaggcccgcgagggctacaccagcttctgcctgttcatcctggggagcatcctcttcgtggtgtcctgcctggtcaagggcctgatcgacagcgtgggcaactccttcttccccgggctcagcatctgcaagacctgctccatcggcagcatcaacgggttcgagatcgagtcccacaagtgctactgcagcctgttctgctgcccgtactgccggcactgccccgccgaccgcgagatccacaagctgcacctctccatctgcaagaagcggaagaccggcagcaacgtgatgctggccgtctgcaagcgcatgtgcttccgcgccacgatcgaggtgtccaaccgggcgctgctcatccgcaacatcatcaacaccaccttcgtggtctgcatcctgaccctggccgtgtgcgtggtcagcacgtccgccgtggagatggagagcctccccgccgggacctgggagaaggaggaggacctgaccaacttctgccaccaggagtgccaggtgaccgagacggagtgcctgtgcccctacgaggccctcgtcctgcggaagccgctgttcctcgactccatcgtgaagggccgcaagaacctgctgaacagcacctccctcgagaccagcctgtccatcgaggcgccctggggcgccatcaacgtgcagagcaccttcaagcccacggtcagcgccgccaacatcgcgctgtcctggagctccgtggagcaccgggggaacaagatcctcgtgagcggccgctccgagagcatcatgaagctggaggagcggaccgggatctcctgggacctgggcgtcgaggacgccagcgagtccaagctcctgaccgtgagcgtgatggacctgtcccagatgtacagccccgtcttcgagtacctctccggggaccgccaggtggaggagtggccgaaggcgacctgcacgggcgactgccccgagcggtgcggctgcaccagcagcacgtgcctgcacaaggagtggccccacagccgcaactggcggtgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgacgtcccaggagcgccagtgcagcctgatcgaggccggcacccggttcaacctcgggccggtcaccatcaccctgtccgagccccgcaacatccagcagaagctgccgcccgagatcatcacgctccacccgcggatcgaggagggcttcttcgacctgatgcacgtgcagcgcgtgctgagcgcgagcaccgtctgcaagctccagtcctgcacccacggggtgcccggcgacctccaggtgtaccacatcgggaacctgctcaagggcgacaaggtcaacggccacctgatccacaagatcgagccccacttcaacaccagctggatgtcctgggacgggtgcgacctggactactactgcaacatgggcgactggcccagctgcacctacacgggggtgacccagcacaaccacgccgccttcgtgaacctcctgaacatcgagaccgactacaccaagaacttccacttccactccaagcgggtcacggcccacggcgacaccccgcagctggacctcaaggcccgccccacctacggggcgggcgaggtgaccgtgctggtcgaggtggccgacatggagctgcacacgaagaagatcgagatcagcggcctcaagttcgcctccctgacctgcaccgggtgctacgcctgcagctccggcatcagctgcaaggtgaagatccacgtcgacgagcccgacgagctgaccgtgcacgtgaagtccgaggaccccgacatcgtcgccgcggggagctccctcatggcccggaagctggagttcggcgccgacagcacgttcaaggccttctccgcgatgccgaagaccagcctgtgcttctacatcgtggagcgcgagtactgcaagtcctgcagccgggaggacacccgcaagtgcgtgaacaccaagctcgaccgcccccagtccatcctgatcgagcacaaggggacgatcatcggcaagcagaacaacacgtgcaccgccaaggccagctgctggctggagagcgtcaagtccttcttctacggcctcaagaacatgctgagcgggatcttcggcaacgtgttcatcgggatcttcctgttcatcgcccccttcgtgctcctgatcctgttcttcatgttcggctggcggatcctgttctgcttcaagtgctgccgccggacccgcggcctcttcaagtaccggcacctgaaggacgacgaggagacggggtaccgcaagatcatcgagcggctgaacaacaagaagggcaagaacaagctcctggacggggagcgcctggccgaccggaagatcgcggagctgttctccaccaagagccacatcggctga

SEQ ID NO: 12025 - RNA, 5055 nt, synthetic construct
  misc_feature 1..5055: note = derived and/or modified CDS sequence (opt1) from CCHFV(8402)__AB069674.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtctcccaggagctcggcctgcccgtgagcaccgtgtccacgatcaccagcgacccgccctccatcaccagcgcggtctccgtgagcgggtccgagggcagcggggacaccaacacgtcccccagcgtgaccacccagggccccaccctgcccgagacgaccctcgagcccctgaccaccacggacaccgacgcctccagcaccgtcgtggtggacgtctccacccagacggtgaaggacaccccgatcagcaccacctacacgagcctgccctccacccccagcgagcccaccaccccgcagggcacgcaccacaccgcccgcgggctcctgtccgtgaccagcaccaagcccgaggaggcctccacgcaggccaaccccggcaagatcagcatggagaccaacgggccccggctggcgatctccgagaccccgagcttctcccccaccacgcaggcccccaccgagaacagcaaccccatcacctccaagcagctcatgctgagcgcccagccggtcacccccaaccccatgacctcccccgtgcagccggccctgagccagtccgacacgagcaccgcgatccaggacgtgcacccctcccccaccggccgcagcaagcggaacctcgagatggagatcatcctgaccctgtcccaggggctcaagaagtactacggcaagatcctgaagctgctcgacctgacgctggaggaggacaccgagggcctcctggagtggtgcaagcgcaacctggggctcgtctgcgacgacaacttcttccagaagcggatcgaggagttcttcctgaccggcaaggggcacttcaacgaggtgctgcagttcaagacccccagcacgctcagcccgaccggccccgcccgcaccggctcccccaccgtggagccgttcaagagctacttcgccaaggggttcctgtccatggacagcggctacttctccgccaagtgctacccccgggccagcaactccgggctgcagctcatcaacgtcacgcagcacagcacccgcatcaccgacacccccggccccaagatcacgaacctgaagaccatcaactgcatcaacctgaaggcgtccgtgttcaaggagcaccgggagatcgagatcaacgtgctcctgccgcaggtcgccgtgaacctgagctcctgccacgtgctcatcaagagccacgtctgcgactactccctggacatcgacgggcccgtgcgcctgccccggatccaccacgagggcaccttcatccccggcacctacaagatcgtcatcgacaagaagaacaagcagaacgaccgctgcacgctcgtgaccaactgcgtgatcaaggggcgggagatccgcaagggccagagcgtcctgcggcagtaccgcaccgagatcaagatcgggaaggcctccagcggctcccggcgcctgctcagcgaggagagcggggacgactgcatctcccggacccagctgctgcgcacggagaccgccgagatccacaacgacaactacggcggcccgggggacaagatcaccatctgcaacggcagcaccgtggtggaccagcggctggggtccgagctcggctgctacacgatcaaccgcgtcaagagcttcaagctgtgcgagaactccgccaccggcaagagctgcgagatcgactccacccccgtgaagtgccgccaggggttctgcctgaagatcacccaggagggccgggggcacgtgaagctcagccgcggctccgaggtcgtgctggacgcgtgcgacagctcctgcgagatcatgatccccaaggggacgggcgacatcctggtggactgcagcggcgggcagcagcacttcctcaaggacaacctgatcgacctgggctgccccaacatcccgctcctggggaagatggccatctacatctgccggatgtccaaccaccccaagaccaccatggccttcctgttctggttcagcttcggctacgtcgtgacctgcatcctctgcaaggtgatcttctacctgctgatcgtcgtggggacgctcggcaagaagttcaagcagtaccgcgagctgaagccccagacctgcaccatctgcgagaccacccccgtgaacgccatcgacgccgagatgcacgacctgaactgctcctacaacatctgcccgtactgcgcgagccggctcacgtccgacggcctggcccgccacgtcatgcagtgccccaagcggaaggagaagatcgaggagaccgagctgtacctcaacctggagcgcatcccctgggtggtgcggaagctgctccaggtcagcgagtccaccggggtggccctgaagcgcagcagctggctggtggtcctcctggtgctgctcaccgtgtccctgagccccgtccagtccgccccgatcggccacgggaagacggtggagacctaccagacccgggagggctacaccagcatctgcctgttcgtgctcgggtccatcctgttcatcgtcagctgcctgatgaagggcctcgtggactccgtgggcaacagcttcttccccgggctgtccatctgcaagacgtgcagcatcggctccgtcaacgggttcgagatcgagagccacaagtgctactgctccctgttctgctgcccctactgccgccactgcagcgccgaccgggagatccaccgcctccacctgtccatctgcaagaagcggaagaccggcagcaacgtgatgctggcggtgtgcaagcgcatgtgcttccgggccaccgtcgaggtgtccaacaaggccctcctgatccgcaacatcatcaacaccacgttcgtgctgtgcatcctcatcctggccgtctgcgtggtgagcacctccgcggtcgagatggagagcctgcccgccgggacctgggagcgggaggaggacctcaccaacttctgccaccaggagtgccaggtgacggagaccgagtgcctgtgcccgtacgaggccctggtgctccgcaagcccctgttcagcgactccatcgtcaagggcatgaagaacctgctcaacagcacctccctggagaccagcctgtccatcgaggccccctggggcgccatcaacgtgcagagcacgttcaagccgaccgtgtccgcggccaacatcgccctcagctggtccagcgtcgagcaccgcgggaacaagatcctggtgtccggccggagcgagtccatcatgaagctggaggagcgcaccgggatcagctgggacctcggcgtggaggacgcctccgagagcaagctgctgaccgtctccgtgatggacctcagccagatgtactcccccgtcttcgagtacctgagcggggaccgccaggtggaggagtggcccaaggccacgtgcaccggcgactgccccgagcggtgcggctgcaccagctccacgtgcctgcacaaggagtggccgcacagccggaactggcgctgcaaccccacctggtgctggggcgtggggaccgggtgcacgtgctgcggcctcgacgtcaaggacctgttcaccgactacatgttcatcaagtggaaggtggagtacatcaagaccgaggcgatcgtgtgcgtcgagctgacctcccaggagcggcagtgcaccctcatcgaggccggcacccgcttcaacctggggcccgtgacgatcaccctgagcgagccccggaacatccagcagaagctcccgcccgagatcgtgaccctgcacccccgcatcgaggagggcttcttcgacctgatgcacgtccagaaggtgctctccgccagcaccgtgtgcaagctgcagtcctgcacccacggggtccccggcgacctccaggtgtaccacatcgggaacctcctgaagggcgacaaggtgaacggccacctgatccacaagatcgagccgcacttcaacacgagctggatgtcctgggacgggtgcgacctcgactactactgcaacatgggcgactggcccagctgcacctacaccggggtcacccagcacaaccacgccgccttcgtgaacatgctgaacatcgagacggactacaccaagaacttccacttccactccaagcgggtgaccgcgcacggcgacacgccccagctggacctcaaggcccgccccacctacggggccggcgagatcaccgtcctggtggaggtggccgacatggagctgcacaccaagaagatcgagatcagcggcctcaagttcgcgtccctgacctgcacggggtgctacgcctgcagctccggcatcagctgcaaggtccggatccacgtggacgagccggacgagctgaccgtgcacgtcaagtccgaggaccccgacatcgtggccgccagctccagcctcatggcccgcaagctggagttcgggaccgacagcaccttcaaggcgttctccgccatgcccaagacgagcctgtgcttctacatcgtggagcgggagtactgcaagtcctgcagcaaggaggacacccagaagtgcgtcaacaccaagctcgagcagccccagtccatcctgatcgagcacaagggcaccatcatcgggaagcagagcaacacgtgcaccgccaaggcctcctgctggctggagagcgtgaagtccttcttctacggcctgaagaacatgctcagcggcatcttcgggaacgtgttcatcggcgtcttcctgttcttcgccccgttcatcctgctcatcctgttcttcatgttcgggtggcgcatcctgttctgcttcaagtgctgccggcgcacccggggcctcttcaagtaccgccacctgaaggacgacgaggagaccggctaccggaagatcatcgagcgcctgaacaacaagaaggggaagaacaagctcctggacggcgagcgcctggcggaccggaagatcgccgagctgttctccacgaagacccacatcgggtga

SEQ ID NO: 12026 - RNA, 5055 nt, synthetic construct
  misc_feature 1..5055: note = derived and/or modified CDS sequence (opt1) from CCHFV(SPU 383/87)__KJ682806.1__GP
  source 1..5055: mol_type = other RNA
atgtacacgcccctgctctgcgccatcctgtgcctgcagctctggagcctggagggcatctacgggctgtccaaccgcacccagcacaacgacaccagcaccatcaaggtgccggaggagtcccagaagaccagcctccccgccaacaccgcgtcccccatcacgagcgacccgccctccaccaccagcaccgcctccgccagcggccccgaggggtccggcgacacgagcacctccccgcccgtcaccacccaggggcccacgccgcccgagaccacccccgagccccacaccacgatcgacatcgacaagagctccaccgccatcgccgacatcagcacccagaccgtgaaggacatccccacgcccaccacccacacctccctgcccagcacgctgtccgcgccgaccatcccccaggaggcccaccacaccgcccggggcctcctgagcatcaccagcacgaagcccggcgaggcctccacccccatcagcccgggggaggcgtccaccgaggccagcagcccccagcccaccatctccgagacgccctccccgccgcccaccgcccaggcccccaccgagatcaacagccccaacacctcccgccagcccatgcccagcacgcagccggccgcgcccaactccgtgacccaccccgcccagcccaccccgagccagtccgacgtccccaccgccgcccaggacatccaccccaaccccatcaaccggagcaagcgcaacctggagatggagatcatcctcaccctgtcccagggcctgaagaagtactacgggaaggtgctcaagctgctggacctcacgctggaggaggacaccgagggcctgctcgagagctgcaagcggaacctggggctgacctgcgacgacaacttcttccagaagcgcatcgaggagttcttcctcaccggcgagggccacttcaacgaggtgctgcagttcaagacgccgtccaccctgagccccaccgagcccgcccgggtcgagtcccccaccgtggagccgttcaagagctacttcgcgaaggggttcctcagcatggactccggctacttcagcgccaagtgctactccaagagctccaacagcgggctgcagctgatcaacgtgacgcagcacctcatccgcatcaccgacacccccggccccaagatcaccaacctgaagacgatcaactgcatcaacctgaaggccctcgtcttcaaggagcaccgggagatcgagatcaacgtgctgctgccccaggtggccgtcaacctctccaactgccacgtgctgatcaagagccacgtgtgcgactactccctggacatcgacggcccggtccgcctcccccggatccaccacgaggggaccttcatccccggcacctacaagatcgtgatcgacaagaacaacaagcagaacgaccgctgcaccctggtgacgaactgcgtcatcaaggggcgggagatccgcaagggccagagcgtgctgcggcagtaccgcaccgagatcaagatcgggaaggcctccagcggctcccggcgcctcctgagcgaggagtccaacgacgactgcctgagccggacccagctcctgcgcaccgagaacgcggagatccactccgacaactacggcgggcccggcgacaagatcacgatctgcaacgggagcaccatcgtggaccagcggctgggcagcgagctcgggtgctacaccatcaaccgcgtcaagtccttcaagctgtgcgagaacagcgccaccggcaagtcctgcgagatcgacagcacgccggtgcgctgccggcagggcttctgcctgaagatcacccaggaggggcgcggccacgtgaagctgtcccgggggagcgaggtcgtgctcgacgcctgcgactccagctgcgagatcatgatccccaagggcaccggggacatcctggtcgactgctccggcggccagcagcacttcctgaaggacaacctcgtggacctggggtgccccaacatccccctgctcggcaagatggccatctacatctgccgcatgagcaaccacccgaagaccacgatggccttcctgttctggttctccttcgggtacgtgatcacgtgcatcctgtgcaaggtcatcttctacctcctggtggtggtcggcaccctgggcaagaagttcaagcagtaccgggagctcaagccccagacctgcaccatctgcgagaccaaccccgtgaacgcgatcgacgccgagatgcacgacctgaactgcagctacaacatctgcccgtactgcgcctcccgcctgaccagcgacgggctcgcccggcacgtgatccagtgccccaagcgcaaggagaagatcgaggagaccgagctgtacctgaacctcgagcggatcccctgggtcgtgcgcaagctgctccaggtgtccgagagcacgggcgtcgcgctcaagcggtccagctggctggtgatcctgctcgtgctgctgaccgtctccctcagccccgtgcagagcgccccgatctcccacggggagaccgtggaggtctaccagacccgcgagggctacaccagcatctgcctgttcgtgctggggtccatcctcttcctggtgagctgcctgatgaagggcctcgtcgactccgtgggcaacagcttcttccccgggctgtccatctgcaagacgtgcagcatcggctccatcaacgggttcgagatcgagagccacaagtgctactgctccctgttctgctgcccctactgccggcactgcagcgccgacatcgagatccaccgcctccacctgtccatctgcaagaagcggaagaccggcagcaacgtgatgctggccgtctgcaagcgcatgtgcttccgggccaccgtggaggtgtccaacaaggcgctcctgatccgcaacatcatcaacaccacgttcgtcgtgtgcatcctgatcctcgccgtgtgcgtcgtgagcacctccgccgtggagatggagaacctgcccgccgggacctgggagaaggaggaggacctgaccaacttctgccaccaggagtgccaggtcacggagaccgagtgcctctgcccgtacgaggccctggtgctgcggaagcccctcttcctggacagcatcgtgaagggcatgaagaacctgctcaactccaccagcctggagaccagcctgtccatcgaggcgccctggggcgccatcaacgtccagagcacgttcaagcccaccgtgtccgccgccaacatcgccctcagctggtccagcgtggagcaccgcgggaacaagatcctggtctccggccgcagcgagtccatcatgaagctggaggagcggaccgggatcagctgggacctcggcgtggaggacgcgtccgagagcaagctgctgaccgtgtccgtcatggacctcagccagatgtactccccggtgttcgagtacctgagcggggaccgccaggtggaggagtggcccaaggccacgtgcaccggcgactgccccgagcggtgcggctgcacctcctccacgtgcctgcacaaggagtggccccacagccgcaactggcggtgcaacccgacctggtgctggggcgtcgggaccgggtgcacgtgctgcggcctcgacgtgaaggacctgttcaccgactacatgttcgtgaagtggaaggtcgactacatcaagaccgaggccatcgtgtgcgtggagctgaccagccaggagcgccagtgcagcctcatcgaggccgggacccggttcaacctgggccccgtcaccatcacgctgtccgagccccgcaacatccagcagaagctgcccccggagatcgtgaccctccacccccggatcgaggagggcttcttcgacctgatgcacatccagaaggtcctcagcgcgtccaccgtgtgcaagctgcagagctgcacccacggggtgcccggcgacctgcagatctaccacatcgggaacctcctgaagggcgacaaggtcaacggccacctgatccacaagatcgagccccacttcaacacgtcctggatgagctgggacgggtgcgacctcgactactactgcaacatgggcgactggccgtcctgcagctacaccggggtgacccagcacaaccacgccgccttcgtgaacatgctgaacatcgagaccgactacacgaagaacttccacttccactccaagcgcgtcaccgcccacggcgacacgccccagctggacctcaaggcccggcccacctacggggcgggcgagatcaccgtgctggtggaggtcgccgacatggagctgcacaccaagaagatcgagatcagcggcctcaagttcgcctccctgacctgcaccgggtgctacgcctgcagctccggcatcagctgcaaggtgcgcatccacgtggacgagcccgacgagctgaccgtccacgtgaagtccgaggacccggacatcgtggccgcgagctccagcctcatggcccggaagctggagttcgggacggactccaccttcaaggccttcagcgccatgcccaagaccagcctgtgcttctacatcgtcgagcgcgagtactgcaagtcctgcagcaaggaggacacccagaagtgcgtgaacacgaagctcgagcagccccagtccatcctgatcgagcacaagggcaccatcttcgggaagcagaacgacacgtgcaccgccaaggcgagctgctggctggagtccgtcaagagcttcttctacggcctcaagaacatgctgtccggcatcttcgggaacgtgttcatcggcgtgttcctgttcctggccccgttcatcatgctcatcctgttcttcatgttcgggtggcggatcctgttctgcttcaagtgctgccgccggacccgcggcctcttcaagtaccggcacctgaaggacgacgaggagatcgggtaccgcaagatcatcgagcggctgaacaacaagaagggcaagaacaagctcctggacggcgagcgcctggccgaccgcaagatcgccgagctgttcagcaccaagacccacatcgggtga

SEQ ID NO: 12027 - RNA, 5055 nt, synthetic construct
  misc_feature 1..5055: note = derived and/or modified CDS sequence (opt1) from CCHFV(SPU 497/88)__KJ682808.1__GP
  source 1..5055: mol_type = other RNA
atgtacacccccctgctctgcgccatcctgtgcctgcagctctggagcctggagggcatctacgggctgtccaacaagacccagcacaacgacacgagcaccatcaaggtgccggaggagtcccagaagaccagcctccccgccaacatcgcgtcccccaccacgagcgaccccccgtccgccaccagcaccgcctccgccagcggccccgaggggtccggcgacaccagcacgtcccccagcgtcaccacccaggggcccaccccgctggagatcacgcccgagccccacaccaccatcgacatcgacaagtccagcacctccatcgccgacatcagcacgcgcaccgtgaaggacatccccaccccgaccacgcacacctccctgcccagcacccccagcgcgcccaccatcccgcaggaggtgcaccacacggcccggggcctcctgtccgtcaccagcaccaagcccgaggaggcctccaccctgacgagccccggcgaggcctccaccgaggcgagctccccccagccgaccatcagcgagaccccctccccccccccgacgacccaggcccccaccgagatcaacaaccccaacaccagccgccagcccatgccgtccacgcagcccgccgcccccaacagcgtgaccccgcccgtgcagcccaccttctcccagagcgacgtctccaccgccgcgcaggacatccaccccagcccgaccaaccggtccaagcgcaacctcgagatggagatcatcctgacgctgagccaggggctcaagaagtactacggcaaggtgctgaagctgctcgacctgaccctggaggaggacaccgaggggctcctggagtggtgcaagcggaacctgggcctcacctgcgacgacaacttcttccagaagcgcatcgaggagttcttcctgacgggggagggccacttcaacgaggtgctgcagttcaagaccccctccaccctcagccccaccgagcccgcccgggtcgagagcccgacggtggagcccttcaagtcctacttcgccaagggcttcctgagcatggactccgggtacttcagcgccaagtgctaccccaagtccagcaactccggcctgcagctcatcaacgtgacccagcacctgatccgcatcaccgacacccccgggccgaagatcacgaacctgaagaccatcaactgcatcaacctcaaggccctggtcttcaaggagcaccgggagatcgagatcaacgtgctgctcccccaggtggcggtcaacctgagcaactgccacgtgctgatcaagtcccacgtgtgcgactacagcctcgacatcgacggccccgtccgcctgccccggatccaccacgagggcaccttcatcccggggacctacaagatcgtgatcgacaagaagacgaagcagaacgaccgctgcaccctggtgaccaactgcgtcatcaagggccgggagatccgcaaggggcagtccgtgctccggcagtaccgcaccgagatcaagatcggcaaggccagctccgggagccggcgcctgctgtccgaggagagcaacgacgactgcctctcccggacgcagctgctgcgcaccgagaacgccgagatccacagcgacaactacggcggccccggggacaagatcaccatctgcaacggcagcaccatcgtggaccagcggctcgggtccgagctgggctgctacacgatcaaccgcgtcaagagcttcaagctgtgcgagaactccgccaccgggaagagctgcgagatcgactccacccccgtgcgctgccggcagggcttctgcctgaagatcacccaggagggcaaggggcacgtcaagctcagccgcggctccgaggtggtgctggacgcctgcgacagctcctgcgagatcatgatccccaaggggacgggcgacatcctggtcgactgcagcgggggccagcagcacttcctcaaggacaacctggtggacctgggctgcccgaacatccccctcctggggaagatggcgatctacatctgccggatgtccaaccaccccaagaccaccatggtgttcctgttctggttcagcttcggctacgtcatcacctgcatcctctgcaaggtgatcttctacctgctgatcgtggtcgggacgctcggcaagaagttcaagcagtaccgcgagctgaagccccagacctgcaccatctgcgagaccaacccggtgaacgccatcgacgccgagatgcacgacctgaactgctcctacaacatctgcccctactgcgccagccggctcacgtccgacggcctggcccgccacgtgatgcagtgccccaagcggaaggagaagatcgaggagaccgagctgtacctcaacctggagcgcatcccgtgggtcgtgcggaagctgctccaggtgagcgagtccaccggggtcgcgctgaagcgcagctcctggctggtgatcctcctggtgctgctcaccgtcagcctgagccccgtgcagtccgcccccatcagccacggcgagaccgtggaggtctaccagacgcgggaggggtacacctccatctgcctgttcgtgctcggcgggatcctgttcctggtgagctgcctcatgaagggcctggtcgactccgtgggcaacagcttcttccccgggctgtccatctgcaagacctgcagcatcggctccatcaacgggttcgagatcgagagccacaagtgctactgctccctcttctgctgcccgtactgccgccactgcagcgccgacatcgagatccacaagctgcacctgtccatctgcaagaagcggaagacctggagcaacgtgatgctcgccgtctgcaagcgcatgtgcttccgggcgacggtggaggtgtccaacaaggccctgctgatccgcaacatcatcaacaccaccttcgtcgtgtgcatcctcatcctggccatctgcgtggtcagcacctccgccgtggagatggagaacctgcccgccggcacgtgggagaaggaggaggacctcaccaacttctgccaccaggagtgccaggtgaccgagaccgagtgcctgtgcccctacgaggcgctggtcctccggaagcccctgttcctggacagcatcgtgaaggggatgcgcaacctcctgaactccacgagcctggagaccagcctctccatcgaggccccgtggggcgccatcaacgtgcagagcaccttcaagcccaccgtctccgccgccaacatcgcgctgagctggtccagcgtggagcaccggggcaacaagatcctggtgtccgggcgcagcgagtccatcatgaagctcgaggagcgcacgggcatcagctgggacctgggggtcgaggacgcctccgagagcaagctgctcaccgtgtccgtgatggacctgagccagatgtactcccccgtcttcgagtacctgagcggcgaccggcaggtggaggagtggcccaaggccacctgcaccggggactgcccggagcgctgcggctgcacgtccagcacctgcctccacaaggagtggccccactcccggaactggcgctgcaaccccacctggtgctggggcgtggggaccggctgcacgtgctgcgggctggacgtcaaggacctgttcaccgactacatgttcgtgaagtggaaggtggactacatcaagaccgaggccatcgtctgcgtggagctcaccagccaggagcggcagtgcagcctgatcgaggccggcacgcgcttcaacctggggcccgtcaccatcaccctctccgagccgcggaacatccagcagaagctgccccccgagatcgtgaccctgcacccccgcatcgaggagggcttcttcgacctcatgcacatccagaaggtgctgagcgcgtccacggtctgcaagctgcagagctgcacccacggcgtgccgggggacctccagatctaccacatcggcaacctgctgaagggggacaaggtgaacggccacctcatccacaagatcgagccccacttcaacacctcctggatgagctgggacggctgcgacctggactactactgcaacatgggggactggccctcctgcagctacaccggcgtcacgcagcacaaccacgccgccttcgtgaacatgctgaacatcgagaccgactacaccaagaacttccacttccactccaagcgggtgaccgcccacggggacaccccccagctcgacctgaaggcgcgcccgacgtacggcgccggggagatcaccgtcctggtggaggtggccgacatggagctccacaccaagaagatcgagatcagcggcctgaagttcgcctccctgacctgcacgggctgctacgcctgcagctccgggatcagctgcaaggtccggatccacgtggacgagcccgacgagctcaccgtgcacgtcaagtccgaggaccccgacatcgtggcggccagctccagcctgatggcccgcaagctggagttcggcaccgactccaccttcaaggccttcagcgccatgcccaagacgagcctctgcttctacatcgtggagcgggagtactgcaagtcctgcagcaaggaggacacccagaagtgcgtcaacaccaagctggagcagccgcagtccatcctgatcgagcacaaggggaccatcatcggcaagcagaacgacacgtgcaccgcgcgcgccagctgctggctcgagtccatcaagagcttcttctacgggctgaagaacatgctgtccggcatcttcggcaacgtgttcatcgggatcttcctgttcttcgcccccttcatcatgctcatcctgttcttcatgttcggctggcggatcctgttctgcttcaagtgctgccgccggacccgcgggctcttcaagtaccggcacctgaaggacgacgaggaggtgggctaccgcaagatcatcgagcggctgaacaacaagaaggggaagaacaagctcctggacggcgagcgcctggccgaccgcaagatcgccgagctcttcagcaccaagacgcacatcggctga

SEQ ID NO: 12028 - RNA, 5055 nt, synthetic construct
  misc_feature 1..5055: note = derived and/or modified CDS sequence (opt1) from CCHFV(88166)__AB069675.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtctcccaggagctcggcctgcccgtgagcaccgtgtccacgatcaccagcgacccgccctccatcaccagcgcggtctccgtgagcgggtccgagggcagcggggacaccaacacgtccccgagcgtgaccacccagggccccaccctgcccgagacgaccctcgagcccctgaccaccacggacaccgacgcctccagcaccgtcgtggtggacgtctccacccagacggtgaaggacaccccgatcagcaccacctacacgagcctgccctccacccccagcgagcccaccaccccgcagggcacgcaccacaccgcccgcgggctcctgtccgtgaccagcaccaagcccgaggaggcctccacgcaggccaaccccggcaagatcagcatggagaccaacagcccccggctggcgatcagcgagaccccgtccttcagccccaccacgcaggcccccaccgagaactccaaccccatcaccagcaagcagctcatgctgtccgcccagccggtcacccccaaccccatgaccagccccgtgcagccggccctgtcccagagcgacacgtccaccgcgatccaggacatccaccccagccccaccgggcgctccaagcggaacctcgagatggagatcatcctgaccctgagccagggcctcaagaagtactacgggaagatcctgaagctgctcgacctgacgctggaggaggacaccgagggcctcctggagtggtgcaagcgcaacctgggcctcgtgtgcgacgacaacttcttccagaagcggatcgaggagttcttcctgaccgggaagggccacttcaacgaggtcctgcagttcaagacccccagcacgctctccccgaccgggcccgcccgcaccggcagccccaccgtggagccgttcaagtcctacttcgccaagggcttcctgagcatggactccgggtacttcagcgccaagtgctacccccgggcctccaacagcggcctgcagctcatcaacgtgacgcagcactccacccgcatcaccgacacccccgggcccaagatcacgaacctgaagaccatcaactgcatcaacctgaaggcgagcgtcttcaaggagcaccgggagatcgagatcaacgtgctcctgccccaggtggccgtcaacctgtccagctgccacgtgctcatcaagtcccacgtgtgcgactacagcctggacatcgacggccccgtccgcctgccccggatccaccacgaggggaccttcatccccggcacctacaagatcgtgatcgacaagaagaacaagcagaacgaccgctgcacgctcgtcaccaactgcgtgatcaagggccgggagatccgcaaggggcagtccgtgctgcggcagtaccgcaccgagatcaagatcggcaaggccagctccgggagccggcgcctgctcagcgaggagtccggcgacgactgcatcagccggacccagctgctgcgcacggagaccgccgagatccactccgacaactacgggggcccgggcgacaagatcaccatctgcaacgggagcaccgtcgtggaccagcggctgggctccgagctcgggtgctacacgatcaaccgcgtgaagtccttcaagctgtgcgagaactccgccaccggcaagagctgcgagatcgactccacccccgtcaagtgccgccaggggttctgcctgaagatcacccaggagggccggggccacgtgaagctcagccgcgggtccgaggtggtcctggacgcgtgcgacagctcctgcgagatcatgatccccaagggcacgggggacatcctggtggactgcagcggcggccagcagcacttcctcaaggacaacctgatcgacctggggtgccccaacatcccgctcctgggcaagatggccatctacatctgccggatgtccaaccaccccaagaccaccatggggttcctgttctggttcagcttcggctacgtggtgacctgcatcctctgcaaggtgatcttctacctgctgatcgtggtcgggacgctcggcaagaagttcaagcagtaccgcgagctgaagccccagacctgcaccatctgcgagaccacccccgtgaacgccatcgacgccgagatgcacgacctgaactgctcctacaacatctgcccgtactgcgccagccggctcacgtccgacggcctggcgcgccacgtgatgcagtgccccaagcggaaggagaagatcgaggagaccgagctgtacctcaacctggagcgcatcccctgggtcgtgcggaagctgctccaggtgagcgagagcaccggggtcgccctgaagcgctccagctggctggtggtgctcctggtcctgctcaccgtgtccctgagccccgtgcagtccgccccgatcggccacgggaagacggtcgagacctaccagacccgggagggctacaccagcatctgcctgttcgtgctcgggtccatcctgttcatcgtgagctgcctgatgaagggcctcgtcgactccgtgggcaacagcttcttccccgggctgtccatctgcaagacgtgcagcatcggctccgtgaacgggttcgagatcgagagccacaagtgctactgctccctgttctgctgcccctactgccgccactgcagcgccgaccgggagatccaccgcctccacctgtccatctgcaagaagcggaagacctggagcaacgtcatgctggccgtgtgcaagcgcatgtgcttccgggcgaccgtggaggtctccaacaaggccctcctgatccgcaacatcatcaacaccacgttcgtgctgtgcatcctcatcctggccgtgtgcgtcgtgagcaccagcgccgtggagatggagtccctgcccgcgggcacctgggagcgggaggaggacctcaccaacttctgccaccaggagtgccaggtcacggagaccgagtgcctgtgcccgtacgaggccctggtgctccgcaagcccctgttcagcgactccatcgtgaaggggatgaagaacctgctcaacagcacctccctggagaccagcctgtccatcgaggccccctggggcgccatcaacgtccagagcacgttcaagccgaccatgtccgccgcgaacatcgccctcagctggtccagcgtggagcaccgcggcaacaagatcctggtgtccgggcggagcgagtccatcatgaagctggaggagcgcaccggcatcagctggaacctcggggtcgaggacgcctccgagagcaagctgctgaccgtgtccgtgatggacctcagccagatgtacagccccgtcttcgagtacctgtccggcgaccgccaggtggaggagtggcccaaggccacgtgcaccggggactgccccgagcggtgcggctgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcatcaagtggaaggtggagtacatcaagaccgaggccatcgtctgcgtggagctgacctcccaggagcggcagtgcaccctcatcgaggcgggcacccgcttcaacctgggccccgtgacgatcaccctgagcgagccccggaacatccagcagaagctcccgcccgagatcgtcaccctgcacccccgcatcgaggaggggttcttcgacctgatgcacgtgcagaaggtgctctccgccagcaccgtctgcaagctgcagtcctgcacccacggcgtgcccggggacctccaggtgtaccacatcggcaacctgctgaagggggacaaggtcaacggccacctgatccacaagatcgagccgcacttcaacacgagctggatgtcctgggacggctgcgacctcgactactactgcaacatgggggactggcccagctgcacctacaccggcgtgacccagcacaaccacgccgccttcgtgaacatgctgaacatcgagacggactacaccaagaacttccacttccactccaagcgggtcaccgcccacggggacacgccccagctggacctcaaggcgcgccccacctacggcgccggggagatcaccgtgctggtggaggtcgccgacatggagctgcacaccaagaagatcgagatcagcggcctcaagttcgcctccctgacctgcacgggctgctacgcgtgcagctccgggatcagctgcaaggtgcggatccacgtggacgagccggacgagctgaccgtccacgtgaagtccgaggaccccgacctcgtggccgccagcagctccctgatggcccgcaagctggagttcggcaccgacagcaccttcaaggccttctccgcgatgcccaagacgagcctctgcttctacatcgtcgagcgggagtactgcaagtcctgcagcaaggaggacacccagaagtgcgtgaacaccaagctggagcagccccagtccatcctgatcgagcacaaggggaccatcatcggcaagcagaacaacacgtgcaccgccaaggccagctgctggctggagtccgtcaagagcttcttctacgggctcaagaacatgctgtccggcatcttcggcaacgtcttcatcggggtgttcctgttcttcgccccgttcatcctcctgatcctgttcttcatgttcggctggcgcatcctcttctgcttcaagtgctgccggcgcacccgggggctgttcaagtaccgccacctgaaggacgacgaggagaccggctaccggaagatcatcgagcgcctcaacaacaagaagggcaagaacaagctgctggacggggagcgcctcgccgaccggaagatcgcggagctgttcagcacgaagacccacatcggctga

SEQ ID NO: 12029 - RNA, 5055 nt, synthetic construct
  misc_feature 1..5055: note = derived and/or modified CDS sequence (opt1) from CCHFV(strain BA88166)__AF338470.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtctcccaggagctcggcctgcccgtgagcaccgtgtccacgatcaccagcgacccgccctccatcaccagcgcggtctccgtgagcgggtccgagggcagcggggacaccaacacgtccccgagcgtgaccacccagggccccaccctgcccgagacgaccctcgagcccctgaccaccacggacaccgacgcctccagcaccgtcgtggtggacgtctccacccagacggtgaaggacaccccgatcagcaccacctacacgagcctgccctccacccccagcgagcccaccaccccgcagggcacgcaccacaccgcccgcgggctcctgtccgtgaccagcaccaagcccgaggaggcctccacgcaggccaaccccggcaagatcagcatggagaccaacagcccccggctggcgatctccgagaccccgtccttcagccccaccacgcaggcccccaccgagaactccaaccccatcaccagcaagcagctcatgctgtccgcccagccggtcacccccaaccccatgaccagccccgtgcagccggccctgtcccagagcgacacgtccaccgcgatccaggacatccaccccagccccaccgggcgctccaagcggaacctcgagatggagatcatcctgaccctgagccagggcctcaagaagtactacgggaagatcctgaagctgctcgacctgacgctggaggaggacaccgagggcctcctggagtggtgcaagcgcaacctgggcctcgtgtgcgacgacaacttcttccagaagcggatcgaggagttcttcctgaccgggaagggccacttcaacgaggtcctgcagttcaagacccccagcacgctctccccgaccgggcccgcccgcaccggcagccccaccgtggagccgttcaagtcctacttcgccaagggcttcctgagcatggactccgggtacttcagcgccaagtgctacccccgggcctccaacagcggcctgcagctcatcaacgtgacgcagcactccacccgcatcaccgacacccccgggcccaagatcacgaacctgaagaccatcaactgcatcaacctgaaggcgagcgtcttcaaggagcaccgggagatcgagatcaacgtgctcctgccccaggtggccgtcaacctgtccagctgccacgtgctcatcaagtcccacgtgtgcgactacagcctggacatcgacggccccgtccgcctgccccggatccaccacgaggggaccttcatccccggcacctacaagatcgtgatcgacaagaagaacaagcagaacgaccgctgcacgctcgtcaccaactgcgtgatcaagggccgggagatccgcaaggggcagtccgtgctgcggcagtaccgcaccgagatcaagatcggcaaggccagctccgggagccggcgcctgctcagcgaggagtccggcgacgactgcatcagccggacccagctgctgcgcacggagaccgccgagatccactccgacaactacgggggcccgggcgacaagatcaccatctgcaacgggagcaccgtcgtggaccagcggctgggctccgagctcgggtgctacacgatcaaccgcgtcaagagcttcaagctgtgcgagaactccgccaccggcaagagctgcgagatcgactccacccccgtcaagtgccgccaggggttctgcctgaagatcacccaggagggccggggccacgtgaagctcagccgcgggtccgaggtggtcctggacgcgtgcgacagctcctgcgagatcatgatccccaagggcacgggggacatcctggtggactgcagcggcggccagcagcacttcctcaaggacaacctgatcgacctggggtgccccaacatcccgctcctgggcaagatggccatctacatctgccggatgtccaaccaccccaagaccaccatggggttcctgttctggttcagcttcggctacgtggtgacctgcatcctctgcaaggggatcttctacctgctgatcgtggtgggcacgctcggcaagaagttcaagcagtaccgcgagctgaagccccagacctgcaccatctgcgagaccacccccgtcaacgccatcgacgccgagatgcacgacctgaactgctcctacaacatctgcccgtactgcgccagccggctcacgtccgacgggctggcgcgccacgtgatgcagtgccccaagcggaaggagaagatcgaggagaccgagctgtacctcaacctggagcgcatcccctgggtggtccggaagctgctccaggtgagcgagagcaccggcgtggccctgaagcgctccagctggctggtcgtgctcctggtgctgctcaccgtctccctgagccccgtgcagtccgccccgatcgggcacggcaagacggtggagacctaccagacccgggaggggtacaccagcatctgcctgttcgtcctcggctccatcctgttcatcgtgagctgcctgatgaagggcctcgtggactccgtcgggaacagcttcttccccggcctgtccatctgcaagacgtgcagcatcgggtccgtgaacggcttcgagatcgagagccacaagtgctactgctccctgttctgctgcccctactgccgccactgcagcgccgaccgggagatccaccgcctccacctgtccatctgcaagaagcggaagacctggagcaacgtgatgctggccgtctgcaagcgcatgtgcttccgggcgaccgtggaggtgtccaacaaggccctcctgatccgcaacatcatcaacaccacgttcgtcctgtgcatcctcatcctggccgtgtgcgtggtcagcaccagcgccgtggagatggagtccctgcccgcggggacctgggagcgggaggaggacctcaccaacttctgccaccaggagtgccaggtgacggagaccgagtgcctgtgcccgtacgaggccctggtcctccgcaagcccctgtacctggacagcatcgtgaagggcatgaagaacctcctgaactccaccagcctggagacctccctcagcatcgaggccccctggggcgccatcaacgtgcagtccacgttcaagccgaccatgagcgccgcgaacatcgccctgtcctggagctccgtcgagcaccgcgggaacaagatcctggtgagcggccggtccgagagcatcatgaagctcgaggagcgcaccgggatctcctggaacctgggcgtggaggacgccagcgagtccaagctgctcaccgtcagcgtgatggacctgtcccagatgtacagccccgtgttcgagtacctgagcggggaccggcaggtcgaggagtggcccaaggccacgtgcaccggcgactgccccgagcgctgcggctgcacctccagcacgtgcctccacaaggagtggccgcactcccggaactggcgctgcaaccccacctggtgctggggcgtggggaccgggtgcacgtgctgcggcctggacgtcaaggacctgttcaccgactacatgttcatcaagtggaaggtggagtacatcaagaccgaggccatcgtgtgcgtcgagctcaccagccaggagcggcagtgcaccctgatcgaggcgggcacccgcttcaacctggggcccgtgatcatcacgctctccgagccccggaacatccagcagaagctgccgcccgagatcgtgaccctgcacccccgcatcgaggagggcttcttcgacctcatgcacgtccagaaggtgctgagcgcctccaccgtgtgcaagctgcagagctgcacccacggggtccccggcgacctccaggtgtaccacatcgggaacctgctgaagggcgacaaggtgaacggccacctcatccacaagatcgagccgcacttcaacacctcctggatgagctgggacgggtgcgacctggactactactgcaacatgggcgactggccctcctgcacgtacaccggggtcacccagcacaaccacgccgccttcgtgaacatgctgaacatcgagaccgactacacgaagaacttccacttccacagcaagcgggtgaccgcccacggcgacacgccccagctcgacctgaaggcgcgccccacctacggggccggcgagatcaccgtcctggtggaggtggccgacatggagctccacaccaagaagatcgagatctccggcctgaagttcgccagcctgacctgcaccgggtgctacgcgtgctccagcggcatctcctgcaaggtccggatccacgtggacgagccggacgagctcacggtgcacgtcaagagcgaggaccccgacatcgtggccgcctccagcagcctgatggcccgcaagctggagttcgggaccgactccaccttcaaggccttcagcgcgatgcccaagacctccctctgcttctacatcgtggagcgggagtactgcaagagctgctccaaggaggacacgcagaagtgcgtcaacaccaagctggagcagccccagagcatcctgatcgagcacaagggcaccatcatcgggaagcagaacaacacgtgcaccgccaaggcctcctgctggctggagagcgtgaagtccttcttctacggcctcaagaacatgctgagcggcatcttcgggaacgtgttcatcggcgtcttcctgttcttcgccccgttcatcctcctgatcctgttcttcatgttcgggtggcgcatcctcttctgcttcaagtgctgccggcgcacccggggcctgttcaagtaccgccacctgaaggacgacgaggagaccggctaccggaagatcatcgagcgcctcaacaacaagaaggggaagaacaagctgctggacggcgagcgcctcgccgaccggaagatcgcggagctgttctccaccaagacgcacatcgggtga

SEQ ID NO: 12030 - RNA, 5055 nt, synthetic construct
  misc_feature 1..5055: note = derived and/or modified CDS sequence (opt1) from CCHFV(SPU 130/89)__KJ682807.1__GP
  source 1..5055: mol_type = other RNA
atgtacacgcccctgctctgcgccatcctgtgcctgcagctctggagcctggagggcatctacgggctgtccaacaagacccagcacaacgacaacagcaccaccaaggccccggaggagtcccacaagaccagcctccccgcgaacaccgcctcccccatcacgagcgacccgccctccaccaccagcaccacgtccgccagcggccccgaggggtccggcgacaccagcacctccccgcccgtgaccacgcaggggcccgccagccccgagaccacccccgagccccacaccacgatcgacatcgacaagtccagcaccgccatcgcggacatctccacccagaccgtcaaggacatcccgacgcccaccacccacaccagcctgccctccacgctgagcgcccccaccatcccgcaggaggcccaccacaccgcccgcggcctcctgagcgtgacccggcacaagcccggcgaggcgtccaagcccacgagccccggggaggcctccaccgaggccagctccagccagccgaccatctccgagacccccagcccgccgcccacgacccaggcccccaccgagatcaacaaccccaacacctcccgccagcccatgcccagcacgcagcccgccgcgccctccagcgtgacccacccggcccagcccaccccctcccagagcgacgtccccaccgccgcccaggacatccacccgtcccccaccaaccggagcaagcgcaacctggagatggagatcatcctcacgctgtcccagggcctgaagaagtactacgggaaggtgctcaagctgctggacctcaccctggaggaggacaccgagggcctgctcgagtggtgcaagcggaacctggggctgacctgcgacgacaacttcttccagaagcgcatcgaggagttcttcctcacgggcgagggccacttcaacgaggtgctgcagttcaagacccccagcaccctgtcccccaccgagccggcccgggtcgagagccccacggtggagcccttcaagagctacttcgcgaaggggttcctctccatggacagcggctacttctccgccaagtgctaccccaagagctccaacagcgggctgcagctgatcaacgtgacccagcacctcatccgcatcaccgacaccccgggccccaagatcacgaacctgaagaccatcaactgcatcaacctgaaggccctcgtcttcaaggagcaccgggagatcgagatcaacgtgctgctgccccaggtggccgtcaacctctccaactgccacgtgctgatcaagagccacgtgtgcgactactccctggacatcgacggccccgtccgcctcccgagcatccaccacgaggggaccttcatccccggcacctacaagatcgtgatcgacaagaagaacaagcagaacgaccggtgcacgctggtgaccaactgcgtcatcaaggggcgcgagatccggaagggccagtccgtgctgcgccagtaccggaccgagatcaagatcgggaaggccagctccggcagccgccggctcctgtccgaggagcccaactacgactgcctgagccgcacccagctcctgcggacggagaacgcggagatccactccgacaactacggcgggcccggcgacaagatcaccatctgcaacgggagcaccatcgtggaccagcgcctgggcagcgagctcgggtgctacaccatcaaccgggtcaagtccttcaagctgtgcgagaacagcgccacgggcaagtcctgcgagatcgacagcaccccggtgcgctgccgccagggcttctgcctgaagatcacccaggaggggcggggccacgtgaagctgtcccgcgggagcgaggtcgtgctcgacgcctgcgactccagctgcgagatcatgatccccaagggcaccggggacatcctggtcgactgctccggcggccagcagcacttcctgaaggacaacctcgtggacctggggtgccccaacatccccctgctcggcaagatggccatctacatctgccggatgagcaaccacccgaagacgaccatggccttcctgttctggttctccttcgggtacgtgatcacgtgcatcctgtgcaaggtcatcttctacctcctgatcgtggtgggcaccctgggcaagaagttcaagcagtaccgcgagctcaagccccagacctgcaccatctgcgagaccaaccccgtcaacgcgatcgacgccgagatgcacgacctgaactgcagctacaacatctgcccgtactgcgcctcccggctgaccagcgacgggctcgcccgccacgtgatgcagtgccccaagcggaaggagaagatcgaggagacggagctgtacctgaacctcgagcgcatcccctgggtggtccggaagctgctccaggtgtccgagagcaccggcgtggcgctgaagcgctccagctggctggtcgtgctgctcgtgctgctgaccgtctccctcagccccgtgcagagcgccccgatctcccacggggagaccgtggaggtctaccagacccgggagggctacacgagcatctgcctgttcgtgctggggtccatcctcttcctggtgagctgcctgatgaagggcctcgtcgactccgtgggcaacagcttcttccccgggctgtccatctgcaagacctgcagcatcggctccatcaacgggttcgagatcgagagccacaagtgctactgctccctgttctgctgcccctactgccgccactgcagcgccgacatcgagatccacaagctccacctgtccatctgcaagaagcggaagaccggcagcaacgtgatgctggccgtctgcaagcgcatgtgcttccgggccaccgtggaggtgtccaacaaggcgctcctgatccgcaacatcatcaacacgaccttcgtcgtgtgcatcctgatcctcgccgtgtgcgtcgtgagcacctccgccgtggagatggagaacctgcccgccgggacctgggagaaggaggaggacctgacgaacttctgccaccaggagtgccaggtcaccgagaccgagtgcctctgcccgtacgaggccctggtgctgcggaagcccctcagcctggactccatcgtgaagggcatgaagaacctgctcaacagcaccagcctggagacgtccctgagcatcgaggcgccctggggcgccatcaacgtccagtccaccttcaagcccaccgtgagcgccgccaacatcgccctctcctggagctccgtggagcaccgcgggaacaagatcctggtcagcggccggtccgagagcatcatgaagctggaggagcgcaccgggatctcctgggacctcggcgtggaggacgcgagcgagtccaagctgctgacggtgagcgtcatggacctctcccagatgtacagcccggtgttcgagtacctgtccggggaccgccaggtggaggagtggcccaaggcgacctgcaccggcgactgccccgagcggtgcggctgcaccagctccacgtgcctgcacaaggagtggccccacagccgcaactggcggtgcaacccgacctggtgctggggcgtcgggaccgggtgcacgtgctgcggcctcgacgtgaaggacctgttcaccgactacatgttcgtgaagtggaaggtcgactacatcaagaccgaggccatcgtgtgcgtggagctgaccagccaggagcgccagtgctccctcatcgaggccgggacccggttcaacctgggccccgtcacgatcaccctgagcgagccccgcaacatccagcagaagctgcccccggagatcgtgaccctccacccccggatcgaggagggcttcttcgacctgatgcacatccagaaggtcctctccgccagcaccgtgtgcaagctgcagtcctgcacgcacggggtgcccggcgacctgcagatctaccacatcgggaacctcctgaagggcgacaaggtcaacggccacctgatccacaagatcgagccccacttcaacaccagctggatgtcctgggacgggtgcgacctcgactactactgcaacatgggcgactggccgagctgctcctacaccggggtgacccagcacaaccacgccgccttcgtgaacatgctgaacatcgagacggactacaccaagaacttccacttccacagcaagcgcgtcaccgcccacggcgacacgccccagctggacctcaaggcccggcccacctacggggcgggcgagatcaccgtgctggtggaggtcgccgacatggagctgcacaccaagaaggtggagatctccggcctcaagttcgccagcctgacctgcaccgggtgctacgcctgctccagcggcatctcctgcaaggtgcgcatccacgtcgacgagcccgacgagctgacggtgcacgtcaagagcgaggacccggacatcgtggccgcgtccagctccctcatggcccggaagctggagttcgggaccgacagcaccttcaaggccttcagcgccatgcccaagacctccctgtgcttctacatcgtggagcgcgagcactgcaagagctgctccaaggaggacacgcagcggtgcgtgaacaccaagctcgagcagccccagagcatcctgatcgagcacaagggcaccatcatcgggaagcagaacgacacgtgcaccgccaaggcgtcctgctggctggagagcatcaagtccttcttctacggcctcaagaacatgctgagcggcatcttcgggaacgtcttcatcggcgtgttcctgttcctggccccgttcatcatcctcatcctgttcttcatgttcgggtggcgcatcctgttctgcttcaagtgctgccggcgcacccggggcctcctgaagtaccgccacctgaaggacgacgaggagatcgggtaccggaagatcatcgagcgcctcaacaacaagaagggcaagaacaagctgctggacggcgagcggctcgccgaccgcaagatcgccgagctgttctccaccaagacccacatcgggtga

SEQ ID NO: 12031 - RNA, 5052 nt, synthetic construct
  misc_feature 1..5052: note = derived and/or modified CDS sequence (opt1) from CCHFV(4701-ST-2009)__KR814872.1__GP
  source 1..5052: mol_type = other RNA
atgcacaccctgctcgtgtgcttcatcctgtacctgcagctcagcggcctcgggggcgcccacgggcagtccaacgccaccgagcacaacggcacgaacaccaccaccgcgcccgggacgagccagtccccgaagccgcccgccagcaccaccctgccccacacccccgagtccagcacggtcaagctcaccacccccacctccgagacggagggcagcggcgagaccaccccgccgcccaacaccacgcaggggctgcccctgaccggcaccacccccgagcgctccgccacgaccgccaccagcacctccagcacggacaacatgaactccaccacccaggtgaccgacaacacgcccaccagcaccgtgtccatcagcccctccagctccagcagcatgccctccacgccccaggggacccaccaccccgtccggagcctcctgtccgtgagctccccgaagaccgtgaccacccccacgcccatgagccccggcgagatgtccccggagaccagctcccagcacagcgccatgtcccgcgtccccaccctgtacaccgcgacccaggtgagcacggagaacaccgaccggtccacgccccgccagagcgagtccagcgtgcagcccgccacccagtccccgatcaccagccccgcccagaccatcctcctgatgtccgccgcgcccaaggccatccaggacatgcaccccagcccgaccaaccggagcaagcgcaacctggaggtcgagatcatcctcaccctgtcccaggggctgaagaagtactacggcaagatcctcaagctgctgcacctcacgctggaggaggacaccgagggcctgctcgagtggtgcaagcggaacctggggagcaactgcgacgacgacttcttccagaagcgcatcgaggagttcttcatcaccggcgaggggtacttcaacgaggtgctgcagttcaagaccctctccacgctgagccccaccgagccctcccacgtgcggctgccgaccgccgagcccttcaagagctacttcgccaagggcttcctctccatcgacagcggctacttctccgccaagtgctacccccgcagctccaccagcgggctgcagctgatcaacgtcacgcagcaccccgcgcggatcgccgagaccccgggccccaagaccacctccctcaagacgatcaactgcatcaacctgcgcgccagcgtgttcaaggagcaccgggaggtggagatcaacgtcctgctcccccagatcgccgtgaacctgtccaactgccacgtggtcatcaacagccacgtgtgcgactactccctggacaccgacgggcccgtgcgcctcccgcggatccaccacgagggcaccttcatccccgggacctacaagatcgtcatcgaccgcaagaacaagctgaacgaccggtgcagcctggtgacgaactgcgtgatcaagggccgcgaggtccggaagggccagagcgtgctccgccagtacaagaccgagatcaagatcgggaaggcctccaccggcagccggaagctgctgtccgaggagcccggggacgactgcatcagccgcacccagctcctgaagacggagaccgcggagatccacgacgacaactacggcgggcccggcgacaagatcaccatctgcaacggctccaccgtcgtggaccagcgcctggggagcgagctcggctgctacacgatcaaccgggtgaagtccttcaagctgtgcgagaacagcgccaccgggaagacctgcgagatcgactccaccccggtcaagtgccgccagggcttctgcctgaagatcacgcaggaggggcggggccacgtgaagctgagccgcggctccgaggtggtcctcgacgcctgcgacagctcctgcgagatcatgatccccaaggggaccggcgacatcctggtggactgcagcgggggccagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcatcttctgcaaggcgctgttctactccctcatcatcatcgggaccctgggcaagaagatcaagcagtaccgggagctgaagccccagacctgcaccatctgcgagaccgcccccgtcaacgccatcgacgccgagatgcacgacctcaactgcagctacaacatctgcccctactgcgcctcccgcctgacgagcgacgggctggcgcggcacgtgacccagtgcccgaagcgcaaggagaaggtggaggagaccgagctctacctgaacctggagcggatcccctggatcgtccgcaagctcctccaggtgagcgagtccaccggcgtggccctgaagcggagctcctggctcatcgtcctgctggtgctcctgacggtgagcctgtcccccgtccagagcgcccccgtgggccacgggaagaccatcgagacctaccagacccgcgagggcttcacgtccatctgcctcttcatgctggggagcatcctgttcatcgtgtcctgcctcgtcaagggcctggtggacagcgtgtccgacagcttcttcccggggctgtccgtctgcaagacctgcagcatcggctccatcaacggcttcgagatcgagagccacaagtgctactgctccctcttctgctgcccctactgccggcactgcagcgccgaccgcgagatccaccagctgcacctgtccatctgcaagaagcggaagaccgggagcaacgtgatgctcgcggtgtgcaagcgcatgtgcttcaaggccaccatcgaggccagccggcgcgccctgctgatccgctccatcatcaacacgaccttcgtcatgtgcatcctcaccctggccatctgcgtggtgagcacctccgcggtcgagatggaggacctgcccgccggcacgtgggagcgggaggaggacctcaccaacttctgccaccaggagtgccaggtgaccgagaccgagtgcctgtgcccgtacgaggccctggtgctccgcaagcccctgttcctggacagcatcgtcaaggggatgaagaacctcctgaactccacgagcctggagacctccctcagcatcgaggccccctggggcgccatcaacgtgcagtccaccttcaagcccaccgtgagcacggcgaacatcgccctgtcctggagctccgtcgagcaccgggggaacaagatcctggtgaccggccgcagcgagtccatcatgaagctcgaggagcggaccggcgtgagctgggacctgggggtcgaggacgcctccgagagcaagctgctcaccgtgtccatcatggacctgagccagatgtacagcccggtgttcgagtacctgtccggcgaccgccaggtcgaggagtggcccaaggccacgtgcaccggggactgccccgagcggtgcggctgcaccagcagcacgtgcctccacaaggagtggccccactcccgcaactggcggtgcaacccgacctggtgctggggcgtggggaccggctgcacgtgctgcggggtggacgtcaaggacctgttcaccgaccacatgttcatcaagtggaaggtggagtacatcaagaccgaggccatcgtgtgcgtcgagctgacctcccaggagcgccagtgcagcctcatcgaggcgggcacccggttcaacctggggcccgtgaccatcaccctgtccgagccccgcaacatccagcagaagctgcccccggagatcatcacgctgcaccccaagatcgaggagggcttcttcgacctgatgcacgtgcagaaggtcctcagcgcctccaccgtgtgcaagctgcagagctgcacccacggcatccccggggacctgcagatctaccacatcggcaacctcctgaagggggaccgggtcaacggccacctgatccacaagatcgagccccacttcaacacctcctggatgagctgggacgggtgcgacctcgactactactgcaacatgggcgactggccgtcctgcacgtacaccggcgtgacccagcacaaccacgccgccttcgtgaacctgctgaacatcgagaccgactacacgaagaccttccacttccacagcaagcgcgtcaccgcgcacggggacacgccccagctcgacctgaaggcccggcccacctacggcgccggggagatcaccgtgctggtggaggtcgccgacatggagctccacaccaagaaggtggagatctccggcctgaagttcgccagcctgacctgcacggggtgctacgcgtgctccagcggcatctcctgcaaggtgcgcatccacgtcgacgagcccgacgagctcaccgtgcacgtcaagagcagcgacccggacgtggtggccgcctccaccagcctgatggcccggaagctggagttcggcaccgactccacgttcaaggccttcagcgcgatgcccaagacctccctctgcttctacatcgtggagcgcgagtactgcaagagctgctccgaggacgacaccaagaagtgcgtcgacaccaagctggagcagccccagagcatcctgatcgagcacaaggggacgatcatcggcaagcagaacgacacgtgcaccgccaaggcctcctgctggctcgagagcgtgaagtccttcttctacgggctgaagaacatgctgggcagcgtgttcgggggcttcttcgtcggcatcctcctgttcctggcccccttcgtgctgctcgtgctgttcttcatgttcgggtggaagatcctgttctgcttcaagtgctgccggcgcacccggggcctcttcaagtaccgccacctgaaggacgacgaggagaccgggtaccgccggatcatcgagcgcctgaactccaagaagggcaagaaccggctcctggacggcgagcgcctggccgaccggaagatcgcggagctgttcagcaccaagacccacatcgggtga

SEQ ID NO: 12032 - RNA, 5052 nt, synthetic construct
  misc_feature 1..5052: note = derived and/or modified CDS sequence (opt1) from CCHFV(36-ST-2014)__KR814857.1__GP
  source 1..5052: mol_type = other RNA
atgcacaccctgctcgtgtgcttcatcctgtacctgcagctcagcggcctggggggcgcccacgggcagtccaacgccaccgagcacaacggcacgaacaccaccaccgtccccgggacgagccagtccccgaagccccccgcgagcaccaccctgccccacaccccggagtccagcacggtgaagctcaccacccccacctccgagacggagggcagcggcgagaccaccccccccccgaacaccacgcaggggctgcccccccccggcaccaccccggagcgccccgccaccacggccacctccatgagctccaccgacaacatgaacagcaccacgcaggtgaccgacaacacccccacctccacggtcagcatctcccccagctccagcccgtccatgcccagcaccagccaggggatccactaccccgtgcggtccctgctcagcgtgtccagccccaagaccgtcaccacgccgacccccatgtcccccggcgagatgagccccgagacctccagccagcactccgccatgagccgcatcccgaccctgtacacggccacccaggtgtccaccgagaacaccaaccggagcaccccccgccagtccgagagctccgcgcagcccgccacgcagagccccaccacctccccgacccagacgatcctgctcatgagcgccgcccccaaggcgatccaggacatgcacccctccccgaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgagcaccctctcccccacggagcccagccacgtgcggctgcccaccgccgagccgttcaagtcctacttcgccaagggcttcctgagcatcgactccggctacttcagcgccaagtgctacccccgctccagcacctccgggctccagctgatcaacgtgacccagcaccccgcccggatcgcggagacgcccggcccgaagaccaccagcctgaagaccatcaactgcatcaacctccgcgcctccgtcttcaaggagcaccgggaggtggagatcaacgtgctgctgccccagatcgccgtcaacctcagcaactgccacgtggtgatcaactcccacgtctgcgactacagcctggacacggacgggcccgtgcgcctgccccggatccaccacgagggcaccttcatcccggggacctacaagatcgtgatcgacaagaagaacaagctcaacgaccgctgctccctggtcaccaactgcgtgatcaagggccgggaggtgcgcaagggccagagcgtcctgcggcagtacaagacggagatcaagatcgggaaggccagcaccggctcccgcaagctcctgagcgaggagcccggggacgactgcatctcccggacccagctgctcaagaccgagacggccgagatccacgacgacaactacggcgggcccggcgacaagatcaccatctgcaacggcagcaccatcgtggaccagcgcctggggtccgagctgggctgctacaccatcaaccgcgtcaagagcttcaagctctgcgagaactccgcgacggggaagacctgcgagatcgacagcacccccgtgaagtgccggcagggcttctgcctgaagatcacccaggaggggcgcggccacgtgaagctgtcccggggcagcgaggtcgtgctggacgcctgcgactccagctgcgagatcatgatcccgaaggggacgggcgacatcctcgtggactgctccgggggccagcagcacttcctgaaggacaacctgatcgacctcggctgcccccacatccccctgctggggaagatggccatctacatctgccgcatgagcaaccacccccggaccaccatggccttcctcttctggttctccttcggctacgtcatcacctgcatcttctgcaaggccctgttctacagcctgatcatcatcgggaccctcggcaagaagatcaagcagtaccgcgagctgaagccgcagacgtgcaccatctgcgagaccgcgcccgtgaacgccatcgacgccgagatgcacgacctgaactgctcctacaacatctgcccctactgcgccagccggctcacctccgacgggctggcccgccacgtgacgcagtgccccaagcggaaggagaaggtcgaggagaccgagctgtacctcaacctggagcgcatcccgtggatcgtgcggaagctgctccaggtgagcgagagcaccggcgtcgcgctgaagcgctccagctggctgatcgtgctcctggtgctgctcaccgtctccctgagccccgtgcagtccgcccccgtgggccacgggaagacgatcgagacctaccagacccgggagggcttcaccaacatctgcctgttcatgctcgggagcatcctgttcatcgtctcctgcctggtgaagggcctcgtggacagcgtctccgacagcttcttcccggggctgtccgtgtgcaagacgtgcagcatcggctccatcaacggcttcgagatcgagagccacaagtgctactgctccctgttctgctgcccctactgccgccactgcagcgccgaccgggagatccaccagctccacctggggatctgcaagaagcgcaagaccggctccaacgtgatgctggccgtctgcaagcggatgtgcttcaaggcgaccatcgaggccagccgccgggccctcctgatccgctccatcatcaacaccacgttcgtgatctgcatcctgaccctcgccatctgcgtggtcagcaccagcgccgtggagatggagaacctgcccgcggggacctgggagcgcgaggaggacctgacgaacttctgccaccaggagtgccaggtgtccgagaccgagtgcctctgcccctacgaggccctggtcctgcggaagccgctcttcctggacagcatcgtgaagggcatgaagaacctgctcaactccaccagcctggagacctccctgagcatcgaggccccctggggggccatcaacgtgcagtccacgttcaagcccaccgtcagcaccgccaacatcgcgctctcctggagctccgtggagcaccgcggcaacaagatcctggtgaccggccggagcgagtccatcatgaagctggaggagcgcacgggggtcagctgggacctcggcgtggaggacgcctccgagagcaagctgctgaccgtgtccatcatggacctcagccagatgtactcccccgtcttcgagtacctgagcggggaccggcaggtggaggagtggccgaaggccacctgcaccggcgactgccccgagcgctgcgggtgcacgagctccacctgcctgcacaaggagtggccccacagccggaactggcgctgcaaccccacctggtgctggggcgtgggcaccgggtgcacgtgctgcggcgtcgacgtgaaggacctcttcaccgaccacatgttcatcaagtggaaggtggagtacatcaagaccgaggccatcgtctgcgtggagctgacctcccaggagcggcagtgcagcctgatcgaggccgggacccgcttcaacctcggcccggtgacgatcaccctgtccgagccccggaacatccagcagaagctgccccccgagatcatcaccctccacccgaagatcgaggagggcttcttcgacctgatgcacgtccagaaggtgctgagcgcgtccaccgtgtgcaagctccagagctgcacgcacgggatccccggcgacctgcagatctaccacatcgggaacctgctcaagggcgaccgcctgaacgggcacctgatccacaagatcgagccccacttcaacacctcctggatgagctgggacggctgcgacctcgactactactgcaacatgggcgactggccctcctgcacctacaccggggtcacgcagcacaaccacgccgccttcgtgaacctgctgaacatcgagaccgactacaccaagaccttccacttccacagcaagcgggtcacggcccacggcgacaccccgcagctcgacctgaaggcgcgccccacctacggggccggcgagatcaccgtgctggtggaggtcgccgacatggagctccacacgaagaaggtggagatctccgggctgaagttcgccagcctggcctgcaccggctgctacgcgtgctccagcggcatctcctgcaaggtgcggatccacgtcgacgagcccgacgagctcaccgtgcacgtgaagagctccgaccccgacgtcgtggccgccagcaccagcctgatggcccgcaagctggagttcgggacggactccaccttcaaggccttcagcgcgatgccgaagacctccctctgcttctacatcgtggagcgggagtactgcaagagctgctccgaggacgacaccaagaagtgcgtcgacacgaagctggaccagccccagagcatcctgatcgagcacaagggcaccatcatcgggaagcagaacgacacctgcaccgccaaggcctcctgctggctcgagagcgtgaagtccttcttctacggcctgaagaacatgctggggagcgtgttcggcaacttcttcgtcggcatcctcctgttcctggcccccttcgtgctgctcgtgctgttcttcatgtgcgggtggaagttcctgttctgcttcaagtgctgccgccggacgcgcggcctcttcaagtaccggcacctgaaggacgacgaggagaccgggtaccgccgcatcatcgagcggctgaactccaagaagggcaagaaccgcctcctggacggcgagcggctggccgaccgcaagatcgcggagctcttcagcaccaagtcccacatcgggtga

SEQ ID NO: 12033 - RNA, 5055 nt, synthetic construct
  misc_feature 1..5055: note = derived and/or modified CDS sequence (opt1) from CCHFV(Matin)__AF467769.2__GP
  source 1..5055: mol_type = other RNA
atgtacaccctgctgctgtgcgccatcctgtgcagccagctctggtccagcgaggggatccacgggctgtccaacgagacccagcacggcaacgccagcaccatcaaggcccccgaggtgtcccaggggctgggcctccccgtcagcaccgcgccgcccatcacctccgacccgcccagcatcacctccgccgccagcgtgtccgggcccgagggcagcggcgacaccaacaccagcccgcccgtgaccacccaggggctgaccctgcccgagaccaccctcgagctgctgaccaccaccaacaccggcgccagctccaccgtcatcgtggacgtgagcacccagaccgtcaaggacacccccgtgtccaccgcccacaccagcccgcccgggaccccctccgcccccaccacgccccagggcacgcaccacaccgcccgcgggctcctgagcgtgaccagcaccaagtccgaggaggccagcacgcagaccaaccccaagaagacctccatggagaccaacagcccgggccccgcgacgtccgagacccccagcccctcccccaccacccaggcccccacggagaacaacaaccccaacacgccccggcagccgacgccgcccacccagcccgccaccccgagccccgtcacgtcccccgccctgctcgccagctcccagggcgacaccagcaccgcggtgcaggacgtgcacccgtcccccaccaaccgcagcaagcggaacctggagatggagatcatcctgacgctctcccaggggctgaagaagtactacggcaagatcctgaagctcctggacctgaccctcgaggaggacaccgaggggctgctggagtggtgcaagcgcaacctcggcctggtctgcgacgacagcttcttccagaagcggatcgaggagttcttcctgaccggcgaggggcacttcaacgaggtgctccagttcaagacgccctccaccctgagccccaccgagccggcccgcgccggctcccccaccgtggagcccttcaagagctacttcgcccgggggctgctcagcatggactccggctacttcagcgccaagtgctacccccgcgcgtccaacagcgggctgcagctgatcaacatcacgcagcactccgcccggatcaccgacaccccgggccccaagatcaccaacctcaagacgatcaactgcatcaacctgaaggccagcaccttcaaggagcaccgcgagatcgagatcaacgtcctgctcccccaggtggccgtgaacctgtccagctgccacgtcctgatcaagtcccacgtgtgcgactacagcctcgacatcgacggccccgtgcggctgccgcgcatccaccacgaggggaccttcatccccggcacctacaagatcgtcatcgacaagaagaacaagcagaacgaccggtgcacgatcgtgaccaactgcgtgatcaaggggcgcgagatccggaagggccagtccgtcctgcgccagtacaagaccgagatcaagatcgggaaggccagctccggcagccggcgcctcctgtccgaggagagcggcgacgactgcatctcccggacccagctgctccgcacggagaccgcggagatccacagcgacagctacgggggccccggggacaagatcaccatctgcaacggctccaccgtggtcgaccagcggctggggagcgagctgggctgctacacgatcaaccgcgtgaagtccttcaagctgtgcgagaacagcgccaccggcaagtcctgcgagatcgacagcacccccgtgaagtgccgccaggggttctgcctcaagatcacccaggagggccgggggcacgtcaagctgtcccgcggcagcgaggtggtgctggacgcctgcgactccagctgcgagatcatgatccccaagggcacgggggacatcctcgtcgactgctccggcgggcagcagcacttcctgaaggacaacctgatcgacctcggctgccccaacatccccctgctggggaagatggccatctacatctgccggatgagcaaccaccccaagaccaccatggtgttcctcttctggttctccttcggctacgtgatcacgtgcatcctgtgcaaggtcatcttctacctgctcatcgtggtgggcacgctggggaagaagttcaagcagtaccgcgagctgaagccgcagacctgcaccatctgcgagaccacccccgtcaacgccatcgacgcggagatgcacgacctcaactgcagctacaacatctgcccctactgcgcctcccggctgacgagcgacggcctggcccgccacgtgatgcagtgccccaagcggaaggagaagatcgaggagaccgagctctacctgaacctggagcgcatcccgtgggtggtccggaagctcctccaggtgtccgagagcaccggggtggccctgaagcgctccagctggctcgtcgtgctgctggtgctcctgaccgtcagcctgtcccccgtgcagagcgcgcccatcggccacgggaagacggtggagacctaccagatccgggagggctacacctccgtctgcctcttcgtgctgggcagcatcctgttcatcgtgtcctgcctcatgaaggggctggtcgacagcgacggcaactccttcttcccggggctgagcatctgcaagacctgctccatcggcagcatcaacgggttcgagatcgagtcccacaagtgctactgcagcctcttctgctgcccctactgccgccactgctccacggaccgggagatccacaagctgcacctgagcatctgcaagaagcgcaagaccggctccaacgtgatgctcgccgtgtgcaagcggatgtgcttccgcgccaccgtcgaggtgagcaacaaggccctgctgatccggtccatcatcaacaccacgttcgtggtctgcatcctcatcctggccgtgtgcgtggtcagcacctccgcggtggagatggagagcctgcccgccggcacctgggagcgcgaggaggacctcatcaacttctgccaccaggagtgccaggtgaccgagacggagtgcctgtgcccctacgaggccctggtcctccggaagccgctgttcctggacagcatcatcaaggggatgaagaacctcctgaactccaccagcctggagacctccctcagcatcgaggccccctggggcgccatcaacgtgcagtccaccttcaagcccacgatgagcgcggccaacatcgccctgtcctggagctccgtggagcaccgcgggaacaagatcctggtcagcggccgctccgagagcatcatgaagctcgaggagcggaccgggatctcctgggacctgggcgtggaggacgccagcgagtccaagctgctcaccgtgagcgtcatggacctgtcccagatgtacagccccgtgttcgagtacctgtccggcgaccgccaggtggaggagtggccgaaggcgacctgcacgggggactgccccgagcggtgcggctgcaccagctccacgtgcctccacaaggagtggccccactcccgcaactggcggtgcaaccccacctggtgctggggcgtgggcaccggctgcacgtgctgcgggctggacgtgaaggacctgttcaccgactacatgttcgtgaagtggaaggtcgagtacatcaagaccgaggtgatcgtctgcgtggagctcacgagccaggagcgccagtgctccctgatcgaggcgggcacccggttcaacctggggccggtgaccatcaccctcagcgagccccgcaacatccagcagaagctgccgcccgagatcgtcacgctgcacccgcggatcgaggagggcttcttcgacctcatgcacgtgcagaaggtgctgtccgccagcaccgtctgcaagctgcagtcctgcacccacggggtgcccggcgacctccaggtgtaccacatcggcaacctgctgaagggggacaaggtcaacggccacctcatccacaagatcgagccccacttcaacaccagctggatgtcctgggacgggtgcgacctggactactactgcaacatgggcgactggcccagctgctcctacaccggggtgacgcagcacaaccacgccgccttcgtgaacatgctgagcatcgagaccgactacaccaagaacttccacttccactccaagcgcgtcaccgcgcacggcgacacgccgcagctcgacctgaaggcccggcccacctacggcgccggggagatcaccgtgctggtggaggtcgccgacatggagctccacaccaagaagatcgagatcagcggcctgaagttcgcctccctgacgtgcaccgggtgctacgcgtgcagctccggcatcagctgcaaggtgcgcatccacgtggacgagcccgacgagctcaccgtccacgtgaagtccgaggaccccgacatcgtggccgccagcagctccctgatggcccggaagctggagttcgggaccgacagcacgttcaaggccttctccgcgatgccgaagaccagcctctgcttctacatcgtcgagcgcgagtactgcaagtcctgcagcaaggaggacacccagaagtgcgtgaacaccaagctggagcagccccagtccatcctgatcgagcacaagggcacgatcatcggcaagcagaacgacacgtgcaccgccaaggccagctgctggctcgagtccgtcaagagcttcttctacgggctgaagaacatgctgtccggcatcttcgggaacgtcttcatcggcatcttcctgttcctcgcccccttcgccctgctgatcctcttcttcatgttcggctggcggatcctgttctgcttcaagtgctgccgccggacccgcgggctgttcaagtaccggcacctcaaggacgacgaggagacgggctaccgcaagatcatcgagcggctgaacaacaagaaggggaagaacaagctgctcgacggcgagcgcctggcggaccgcaagatcgccgagctgttcagcaccaagacccacgtggggtga

SEQ ID NO: 12034 - RNA, 5052 nt, synthetic construct
  misc_feature 1..5052: note = derived and/or modified CDS sequence (opt1) from CCHFV(UCCR4405)__KY484029.1__GP
  source 1..5052: mol_type = other RNA
atgcacgccctgctcgtgtgcttcatcctgtacctgcagctcagcggcctcgggggcgcccaccgccagtccaacgcgaccgagcacaacgggaccaacacgaccaccgcccccggcaccagccagtccccgaagccgcccgtcagcacgaccctgccccacacccccgaggcctccaccatcaagctgacgacccccaccagcgagaccgaggggtccggcgagacgaccccgccgcccaacaccacccagggcctgcccctgcccgggacgacccccgagcggagcgccaccaccgccacgtccaccagctccaccgacgacatgaacagcaccacgcagatgaccgacaacacccccacctccacggtgagcatcggcctctccagctcccccagcatgccctccaccagccaggggatccactaccccgtgcgcagcctgctgtccgtcagctccccgaagaccgcgaccacgcccacccccatgagccccggcgaggtgtccccggagaccagctcccagcacagcgccatgtcccggatccccaccctctacacggccacccaggtgagcaccgagaacaccaaccgctccatcccccggcagagcgagtccagcgtccagcccgccacccagtccccgatcacgagccccgcgcagaccatcctgctgatgtccgccgcccccaccgccatccaggacatgcaccccagcccgaagaaccgctccaagcggaacctcgaggtggagatcatcctgaccctgagccaggggctcaagaagtactacggcaagatcctgaagctgctccacctgacgctggaggaggacaccgagggcctcctggagtggtgcaagcgcaacctggggagcaactgcgacgacgacttcttccagaagcggatcgaggagttcttcatcaccggcgaggggtacttcaacgaggtgctccagttcaagaccccctccacgctgagccccaccgagccgtcccacgtccgcctgcccaccgccgagcccttcaagagctacttcgcgaagggcttcctctccatcgacagcggctacttctccgccaagtgctacccccggagctccaccagcgggctgcagctgatcaacgtgacgcagcacccggcccgcatcgccgagacccccggccccaagaccacctccctcaagacgatcaactgcatcaacctgcgggccagcgtgttcaaggagcaccgcgaggtcgagatcaacgtgctgctcccccagatcgcggtgaacctgtccaactgccacgtcgtgatcaacagccacgtgtgcgactactccctggacaccgacgggccggtccggctcccccgcatccaccacgagggcgccttcatccccgggacctacaagatcgtgatcgacaagaagaacaagctgaacgaccggtgcagcctggtgaccaactgcgtcatcaagggccgcgaggtgcggaagggccagtccgtgctccgccagtacaagacggagatcaagatcgggaaggccagcaccggcagccggaagctgctgtccgaggagcccggggacgactgcatcagccgcacccagctcctgaagaccgagacggccgagatccacgacgacaactacggcgggccgggcgacaagatcaccatctgcaacggctccaccatcgtcgaccagcgcctggggagcgagctcggctgctacaccatcaaccgggtgaagtccttcaagctgtgcgagaacagcgccacggggaagacctgcgagatcgactccacccccgtcaagtgccgccagggcttctgcctgaagatcacccaggaggggcggggccacgtgaagctgagccgcggctccgaggtggtcctcgacgcgtgcgacagctcctgcgaggtgatgatccccaaggggacgggcgacatcctggtggactgcagcgggggccagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtcatcacgtgcatcttctgcaaggccctgttctactccctcatcatcatcgggaccctgggcaagaagatcaagcagtaccgggagctgaagccccagacctgcaccatctgcgagaccgcccccgtgaacgcgatcgacgccgagatgcacgacctcaagtgcagctacaacatctgcccgtactgcgcctcccgcctgaccagcgacgggctggcccggcacgtgacgcagtgccccaagcgcaaggagaaggtcgaggagaccgagctctacctgaacctggagcggatcccctggatcgtgcgcaagctcctccaggtgtccgagagcaccggcgtcgcgctgaagcggagctcctggctcatcgtgctgctggtgctcctgaccgtcagcctgtcccccgtgcagagcgccccggtgggccacgggaagacgatcgagacctaccagacccgcgagggcttcacctccatctgcctcttcatgctggggagcatcctgttcatcgtctcctgcctcgtgaagggcctggtggacagcgtctccgacagcttcttccccgggctgtccgtgtgcaagacgtgcagcatcggctccatcaacggcttcgagatcgagagccacaagtgctactgctccctcttctgctgcccctactgccggcactacagcgccgaccgcgagatccaccagctgcacctgtccatctgcaagaagcggaagaccgggagcaacgtgatgctcgccgtctgcaagcgcatgtgcttcaaggccaccatcgaggcgtcccggcgcgccctgctgatccgcagcatcatcaacaccacgttcgtgatctgcatcctcatcctggccatctgcgtggtcagcacctccgccgtggagatggagaacctgccggccggcacctgggagcgggaggaggacctcaccaacttctgccaccaggagtgccaggtgacggagaccgagtgcctgtgcccctacgaggcgctggtcctccgcaagcccctgttcctggacagcaccgtgaaggggatgaagaacctcctgaactccaccagcctggagacgtccctcagcatcgaggccccctggggcgccatcaacgtgcagtccaccttcaagccgaccgtcagcaccgccaacatcgccctgtcctggagctccgtggagcaccgggggaacaagatcctggtgacgggccgcagcgagtccatcatgaagctcgaggagcggaccggcgtcagctgggacctgggggtggaggacgcgtccgagagcaagctgctcaccgtgtccatcatggacctgagccagatgtactcccccgtcttcgagtacctgagcggcgaccgccaggtggaggagtggcccaaggcgacctgcacgggggactgccccgagcggtgcggctgcaccagcagcacgtgcctccacaaggagtggccgcactcccgcaactggcggtgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacctcccaggagcgccagtgcagcctcatcgaggccggcacccggttcaacctggggcccgtcaccatcaccctgtccgagccccgcaacatccagcagaagctcccgcccgagatcatcaccctgcaccccaagatcgaggagggcttcttcgacctgatgcacgtgcagaaggtgctcagcgcctccacggtctgcaagctgcagagctgcacccacggcatccccggggacctgcagatctaccacatcggcaacctcctgaagggggaccgggtgaacggccacctgatccacaagatcgagccgcacttcaacacctcctggatgagctgggacgggtgcgacctcgactactactgcaacatgggcaactggccctcctgcacctacacgggcgtcacccagcacaaccacgccgccttcgtgaacctgctgaacatcgagaccgactacaccaagacgttccacttccacagcaagcgcgtgaccgcccacggggacacgccccagctcgacctgaaggcccggcccacctacggcgcgggggagatcaccgtcctggtggaggtggccgacatggagctccacaccaagaaggtcgagatctccggcctgaagttcgccagcctggtgtgcaccgggtgctacgcctgctccagcggcatctcctgcaaggtgcgcatccacgtcgacgagccggacgagctcaccgtgcacgtcaagagctccgaccccgacgtggtggccgcgagcacgagcctgatggcccggaagctggagttcggcaccgactccatcttcaaggccttcagcgccatgcccaagacctccctctgcttctacatcgtggagcgcgagtactgcaagagctgctccgaggacgacaccaagaagtgcgtcgacacgaagctggagcagccccagagcatcctgatcgagcacaaggggaccatcatcggcaagcagaacgacacgtgcaccgccaaggcgtcctgctggctcgagagcgtgaagtccttcttctacgggctgaagaacatgctgggcagcgtgttcgggaacttcttcgtcggcatcctcctgttcctggccccgttcgtgctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaactccaagaaggggaagaaccggctcctggacggcgagcgcctggccgaccggaagatcgccgagctgttcagcaccaagacccacatcggctga

SEQ ID NO: 12035 - RNA, 5052 nt, synthetic construct
  misc_feature 1..5052: note = derived and/or modified CDS sequence (opt1) from CCHFV(Drosdov)__DQ211630.1__GP
  source 1..5052: mol_type = other RNA
atgcacgccctgctcgtgtgcttcatcctgtacctgcagctcagcggcctcgggggcgcccaccgccagtccaacgcgaccgagcacaacgggaccaacacgaccaccgcccccggcaccagccagtccccgaagccgcccgtcagcacgaccctgccccacacccccgaggcctccaccatcaagctgacgacccccaccagcgagaccgaggggtccggcgagacgaccccgccgcccaacaccacccagggcctgcccctgcccgggacgacccccgagcggagcgccaccaccgccacgtccaccagctccaccgacgacatgaacagcaccacgcagatgaccgacaacacccccacctccacggtgagcatcggcctctccagctcccccagcatgccctccaccagccaggggatccactaccccgtgcgcagcctgctgtccgtcagctccccgaagaccgcgaccacgcccacccccatgagccccggcgaggtgtccccggagaccagctcccagcacagcgccatgtcccggatccccaccctctacacggccacccaggtgagcaccgagaacaccaaccgctccatcccccggcagagcgagtccagcgtccagcccgccacccagtccccgatcacgagccccgcgcagaccatcctgctgatgtccgccgcccccaccgccatccaggacatgcaccccagcccgaagaaccgctccaagcggaacctcgaggtggagatcatcctgaccctgagccaggggctcaagaagtactacggcaagatcctgaagctgctccacctgacgctggaggaggacaccgagggcctcctggagtggtgcaagcgcaacctggggagcaactgcgacgacgacttcttccagaagcggatcgaggagttcttcatcaccggcgaggggtacttcaacgaggtgctccagttcaagaccccctccacgctgagccccaccgagccgtcccacgtccgcctgcccaccgccgagcccttcaagagctacttcgcgaagggcttcctctccatcgacagcggctacttctccgccaagtgctacccccggagctccaccagcgggctgcagctgatcaacgtgacgcagcacccggcccgcatcgccgagacccccggccccaagaccacctccctcaagacgatcaactgcatcaacctgcgggccagcgtgttcaaggagcaccgcgaggtcgagatcaacgtgctgctcccccagatcgcggtgaacctgtccaactgccacgtcgtgatcaacagccacgtgtgcgactactccctggacaccgacgggccggtccggctcccccgcatccaccacgagggcgccttcatccccgggacctacaagatcgtgatcgacaagaagaacaagctgaacgaccggtgcagcctggtgaccaactgcgtcatcaagggccgcgaggtgcggaagggccagtccgtgctccgccagtacaagacggagatcaagatcgggaaggccagcaccggcagccggaagctgctgtccgaggagcccggggacgactgcatcagccgcacccagctcctgaagaccgagacggccgagatccacgacgacaactacggcgggccgggcgacaagatcaccatctgcaacggctccaccatcgtcgaccagcgcctggggagcgagctcggctgctacaccatcaaccgggtgaagtccttcaagctgtgcgagaacagcgccacggggaagacctgcgagatcgactccacccccgtcaagtgccgccagggcttctgcctgaagatcacccaggaggggcggggccacgtgaagctgagccgcggctccgaggtggtcctcgacgcgtgcgacagctcctgcgaggtgatgatccccaaggggacgggcgacatcctggtggactgcagcgggggccagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtcatcacgtgcatcttctgcaaggccctgttctactccctcatcatcatcgggaccctgggcaagaagatcaagcagtaccgggagctgaagccccagacctgcaccatctgcgagaccgcccccgtgaacgcgatcgacgccgagatgcacgacctcaagtgcagctacaacatctgcccgtactgcgcctcccgcctgaccagcgacgggctggcccggcacgtgacgcagtgccccaagcgcaaggagaaggtcgaggagaccgagctctacctgaacctggagcggatcccctggatcgtgcgcaagctcctccaggtgtccgagagcaccggcgtcgcgctgaagcggagctcctggctcatcgtgctgctggtgctcctgaccgtcagcctgtcccccgtgcagagcgccccggtgggccacgggaagacgatcgagacctaccagacccgcgagggcttcacctccatctgcctcttcatgctggggagcatcctgttcatcgtctcctgcctcgtgaagggcctggtggacagcgtctccgacagcttcttccccgggctgtccgtgtgcaagacgtgcagcatcggctccatcaacggcttcgagatcgagagccacaagtgctactgctccctcttctgctgcccctactgccggcactacagcgccgaccgcgagatccaccagctgcacctgtccatctgcaagaagcggaagaccgggagcaacgtgatgctcgccgtctgcaagcgcatgtgcttcaaggccaccatcgaggcgtcccggcgcgccctgctgatccgcagcatcatcaacaccacgttcgtgatctgcatcctcatcctggccatctgcgtggtcagcacctccgccgtggagatggagaacctgccggccggcacctgggagcgggaggaggacctcaccaacttctgccaccaggagtgccaggtgacggagaccgagtgcctgtgcccctacgaggcgctggtcctccgcaagcccctgttcctggacagcaccgtgaaggggatgaagaacctcctgaactccaccagcctggagacgtccctcagcatcgaggccccctggggcgccatcaacgtgcagtccaccttcaagccgaccgtcagcaccgccaacatcgccctgtcctggagctccgtggagcaccgggggaacaagatcctggtgacgggccgcagcgagtccatcatgaagctcgaggagcggaccggcgtcagctgggacctgggggtggaggacgcgtccgagagcaagctgctcaccgtgtccatcatggacctgagccagatgtactcccccgtcttcgagtacctgagcggcgaccgccaggtggaggagtggcccaaggcgacctgcacgggggactgccccgagcggtgcggctgcaccagcagcacgtgcctccacaaggagtggccgcactcccgcaactggcggtgcaaccccacctggtgctggggcgtggggaccggctgcacgtgctgcggggtcgacgtgaaggacctgttcaccgaccacatgttcgtgaagtggaaggtcgagtacatgaagaccgaggccatcgtgtgcgtggagctgacctcccaggagcgccagtgcagcctcatcgaggccggcacccggttcaacctggggcccgtcaccatcaccctgtccgagccccgcaacatccagcagaagctcccgcccgagatcatcaccctgcaccccaagatcgaggagggcttcttcgacctgatgcacgtgcagaaggtgctcagcgcctccacggtctgcaagctgcagagctgcacccacggcatccccggggacctgcagatctaccacatcggcaacctcctgaagggggaccgggtgaacggccacctgatccacaagatcgagccgcacttcaacacctcctggatgagctgggacgggtgcgacctcgactactactgcaacatgggcaactggccctcctgcacctacacgggcgtcacccagcacaaccacgccgccttcgtgaacctgctgaacatcgagaccgactacaccaagacgttccacttccacagcaagcgcgtgaccgcccacggggacacgccccagctcgacctgaaggcccggcccacctacggcgcgggggagatcaccgtcctggtggaggtggccgacatggagctccacaccaagaaggtcgagatctccggcctgaagttcgccagcctggtgtgcaccgggtgctacgcctgctccagcggcatctcctgcaaggtgcgcatccacgtcgacgagccggacgagctcaccgtgcacgtcaagagctccgaccccgacgtggtggccgcgagcacgagcctgatggcccggaagctggagttcggcaccgactccatcttcaaggccttcagcgccatgcccaagacctccctctgcttctacatcgtggagcgcgagtactgcaagagctgctccgaggacgacaccaagaagtgcgtcgacacgaagctggagcagccccagagcatcctgatcgagcacaaggggaccatcatcggcaagcagaacgacacgtgcaccgccaaggcgtcctgctggctcgagagcgtgaagtccttcttctacgggctgaagaacatgctgggcagcgtgttcgggaacttcttcgtcggcatcctcctgttcctggccccgttcgtgctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaactccaagaaggggaagaaccggctcctggacggcgagcgcctggccgaccggaagatcgccgagctgttcagcaccaagacccacatcggctga

SEQ ID NO: 12036 - RNA, 5052 nt, synthetic construct
  misc_feature 1..5052: note = derived and/or modified CDS sequence (opt1) from CCHFV(44-ST-2010)__KR814859.1__GP
  source 1..5052: mol_type = other RNA
atgcacaccctgctcgtgtgcttcatcctgtacctgcagctcagcggcctggggggcgcccacgggcagtccaacgccaccgagcacaacggcacgaacaccaccaccgtccccgggacgagccagtccccgaagccccccgcgagcaccaccctgccccacaccccggagtccagcacggtgaagctcaccacccccacctccgagacggagggcagcggcgagaccaccccccccccgaacaccacgcaggggctgcccccccccggcaccaccccggagcgccccgccaccacggccacctccatgagctccaccgacaacatgaacagcaccacgcaggtgaccgacaacacccccacctccacggtcagcatctcccccagctccagcccgtccatgcccagcaccagccaggggatccactaccccgtgcggtccctgctcagcgtgtccagccccaagaccgtcaccacgccgacccccatgtcccccggcgagatgagccccgagacctccagccagcactccgccatgagccgcatcccgaccctgtacacggccacccaggtgtccaccgagaacaccaaccggagcaccccccgccagtccgagagctccgcgcagcccgccacgcagagccccaccacctccccgacccagacgatcctgctcatgagcgccgcccccaaggcgatccaggacatgcacccctccccgaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgagcaccctctcccccacggagcccagccacgtgcggctgcccaccgccgagccgttcaagtcctacttcgccaagggcttcctgagcatcgactccggctacttcagcgccaagtgctacccccgctccagcacctccgggctccagctgatcaacgtgacccagcaccccgcccggatcgcggagacgcccggcccgaagaccaccagcctgaagaccatcaactgcatcaacctccgcgcctccgtcttcaaggagcaccgggaggtggagatcaacgtgctgctgccccagatcgccgtcaacctcagcaactgccacgtggtgatcaactcccacgtctgcgactacagcctggacacggacgggcccgtgcgcctgccccggatccaccacgagggcaccttcatcccggggacctacaagatcgtgatcgacaagaagaacaagctcaacgaccgctgctccctggtcaccaactgcgtgatcaagggccgggaggtgcgcaagggccagagcgtcctgcggcagtacaagacggagatcaagatcgggaaggccagcaccggctcccgcaagctcctgagcgaggagcccggggacgactgcatctcccggacccagctgctcaagaccgagacggccgagatccacgacgacaactacggcgggcccggcgacaagatcaccatctgcaacggcagcaccatcgtggaccagcgcctggggtccgagctgggctgctacaccatcaaccgcgtcaagagcttcaagctctgcgagaactccgcgacggggaagacctgcgagatcgacagcacccccgtgaagtgccggcagggcttctgcctgaagatcacccaggaggggcgcggccacgtgaagctgtcccggggcagcgaggtcgtgctggacgcctgcgactccagctgcgagatcatgatcccgaaggggacgggcgacatcctcgtggactgctccgggggccagcagcacttcctgaaggacaacctgatcgacctcggctgcccccacatccccctgctggggaagatggccatctacatctgccgcatgagcaaccacccccggaccaccatggccttcctcctgtggttctccttcggctacgtcatcacctgcatcttctgcaaggccctgttctacagcctcatcatcatcgggaccctgggcaagaagatcaagcagtaccgcgagctgaagccgcagacgtgcaccatctgcgagaccgcgcccgtgaacgccatcgacgccgagatgcacgacctcaactgctcctacaacatctgcccctactgcgccagccggctgacctccgacgggctggcccgccacgtgacgcagtgccccaagcggaaggagaaggtcgaggagaccgagctctacctgaacctggagcgcatcccgtggatcgtgcggaagctcctgcaggtgagcgagagcaccggcgtcgcgctgaagcgctccagctggctcatcgtgctgctggtgctcctgaccgtctccctgagccccgtgcagtccgcccccgtgggccacgggaagacgatcgagacctaccagacccgggagggcttcaccaacatctgcctcttcatgctggggagcatcctgttcatcgtctcctgcctcgtgaagggcctggtggacagcgtctccgacagcttcttcccggggctgtccgtgtgcaagacgtgcagcttcggctccatcaacggcttcgagatcgagagccacaagtgctactgctccctcttctgctgcccctactgccgccactgcagcgccgaccgggagatccaccagctgcacctggggatctgcaagaagcgcaagaccggctccaacgtgatgctcgccgtctgcaagcggatgtgcttcaaggcgaccatcgaggccagccgccgggccctgctgatccgctccatcatcaacaccacgttcgtgatctgcatcctcaccctggccatctgcgtggtcagcaccagcgccgtggagatggagaacctgcccgcggggacctgggagcgcgaggaggacctcacgaacttctgccaccaggagtgccaggtgtccgagaccgagtgcctgtgcccctacgaggccctggtcctccggaagccgctgttcctggacagcatcgtgaagggcatgaagaacctcctgaactccaccagcctggagacctccctcagcatcgaggccccctggggggccatcaacgtgcagtccacgttcaagcccaccgtcagcaccgccaacatcgcgctgtcctggagctccgtggagcaccgcggcaacaagatcctggtgaccggccggagcgagtccatcatgaagctcgaggagcgcacgggggtcagctgggacctgggcgtggaggacgcctccgagagcaagctgctcaccgtgtccatcatggacctgagccagatgtactcccccgtcttcgagtacctgagcggggaccggcaggtggaggagtggccgaaggccacctgcaccggcgactgccccgagcgctgcgggtgcacgagctccacctgcctccacaaggagtggccccacagccggaactggcgctgcaaccccacctggtgctggggcgtgggcaccgggtgcacgtgctgcggcgtcgacgtgaaggacctgttcaccgaccacatgttcatcaagtggaaggtggagtacatcaagaccgaggccatcgtctgcgtggagctgacctcccaggagcggcagtgcagcctcatcgaggccgggacccgcttcaacctgggcccggtgacgatcaccctgtccgagccccggaacatccagcagaagctcccccccgagatcatcaccctgcacccgaagatcgaggagggcttcttcgacctgatgcacgtccagaaggtgctcagcgcgtccaccgtgtgcaagctgcagagctgcacgcacgggatccccggcgacctgcagatctaccacatcgggaacctcctgaagggcgaccgcctgaacgggcacctcatccacaagatcgagccccacttcaacacctcctggatgagctgggacggctgcgacctggactactactgcaacatgggcgactggccctcctgcacctacaccggggtcacgcagcacaaccacgccgccttcgtgaacctgctcaacatcgagaccgactacaccaagaccttccacttccacagcaagcgggtcacggcccacggcgacaccccgcagctggacctgaaggcgcgccccacctacggggccggcgagatcaccgtgctcgtggaggtcgccgacatggagctgcacacgaagaaggtggagatctccgggctgaagttcgccagcctcgcctgcaccggctgctacgcgtgctccagcggcatctcctgcaaggtgcggatccacgtcgacgagcccgacgagctgaccgtgcacgtgaagagctccgaccccgacgtcgtggccgccagcaccagcctgatggcccgcaagctcgagttcgggacggactccaccttcaaggccttcagcgcgatgccgaagacctccctgtgcttctacatcgtggagcgggagtactgcaagagctgctccgaggacgacaccaagaagtgcgtcgacacgaagctggaccagccccagagcatcctcatcgagcacaagggcaccatcatcgggaagcagaacgacacctgcaccgccaaggcctcctgctggctggagagcgtgaagtccttcttctacggcctgaagaacatgctcgggagcgtgttcggcaacttcttcgtcggcatcctgctgttcctggcccccttcgtgctcctggtgctgttcttcatgtgcgggtggaagatcctcttctgcttcaagtgctgccgccggacgcgcggcctgttcaagtaccggcacctgaaggacgacgaggagaccgggtaccgccgcatcatcgagcggctcaactccaagaagggcaagaaccgcctgctggacggcgagcggctcgccgaccgcaagatcgcggagctgttcagcaccaagtcccacatcgggtga

SEQ ID NO: 12037 - RNA, 5052 nt, synthetic construct
  misc_feature 1..5052: note = derived and/or modified CDS sequence (opt1) from CCHFV(3756-ST-2007)__KR814866.1__GP
  source 1..5052: mol_type = other RNA
atgcacaccctgctcgtgtgcttcatcctgtacctgcagctcagcggcctggggggcgcccacgggcagtccaacgccaccgagcacaaccgcacgaacaccaccaccgtccccggcacgagccagtccccgaagccccccgcgagcaccaccctgccccacaccccggagtccagcacggtgaagctcaccacccccacctccgagacggaggggagcggcgagaccaccccccccccgaacaccacgcagggcctgcccctgcccgggaccacccccgagcggtccgccaccacggccaccagcacctccagcaccgacaacatgaacacgaccacccaggtgaccgacaacacgccgacctccaccgtcagcatctcccccagctccagcccctccatgcccagcaccagccagggcatccactacccggtgcgctccctcctgagcgtgtccagccccaagacggtcaccacccccacccccatgtccccgggggagatgagccccgagacgtccagccagcactccgccatgagccggatccccaccctgtacaccgccacccaggtgtccaccgagaacatcaaccgcagcacgccccggcagtccgagagctccgtgcagccggcgacccagagccccatcacctcccccgcccagaccatcctcctgatgagcgccgcccccaaggcgatccaggacatgcacccgtcccccacgaaccgcagcaagcggaacctggaggtcgagatcatcctcaccctgagccagggcctgaagaagtactacgggaagatcctcaagctgctgcacctcaccctggaggaggacaccgagggcctgctcgagtggtgcaagcgcaacctgggctccaactgcgacgacgacttcttccagaagcggatcgaggagttcttcatcacgggggagggctacttcaacgaggtgctgcagttcaagaccctcagcaccctgtcccccaccgagccgagccacgtgcgcctgcccacggccgagcccttcaagtcctacttcgccaaggggttcctcagcatcgactccggctacttcagcgccaagtgctacccccggtccagcacctccggcctgcagctgatcaacgtcacccagcacccggcccgcatcgcggagacccccgggcccaagacgaccagcctcaagaccatcaactgcatcaacctgcgggcctccgtgttcaaggagcaccgcgaggtggagatcaacgtcctgctcccccagatcgccgtgaacctgagcaactgccacgtggtcatcaactcccacgtgtgcgactacagcctggacaccgacggcccggtgcggctcccccgcatccaccacgaggggacgttcatccccggcacctacaagatcgtcatcgaccggaagaacaagctgaacgaccgctgctccctggtgaccaactgcgtgatcaaggggcgggaggtccgcaagggccagagcgtgctccggcagtacaagaccgagatcaagatcggcaaggccagcacggggtcccgcaagctgctgagcgaggagcccggcgacgactgcatctcccgcacccagctcctgaagaccgagaccgccgagatccacgacgacaactacgggggcccgggggacaagatcacgatctgcaacggcagcaccatcgtcgaccagcggctgggctccgagctcgggtgctacaccatcaaccgcgtgaagagcttcaagctgtgcgagaactccgcgaccggcaagacgtgcgagatcgacagcacccccgtgaagtgccggcaggggttctgcctgaagatcacccaggagggccgcgggcacgtcaagctgtcccggggcagcgaggtggtgctcgacgcctgcgactccagctgcgagatcatgatccccaagggcaccggggacatcctggtcgactgctccggcgggcagcagcacttcctgaaggacaacctcatcgacctgggctgcccccacatcccgctgctcggcaagatggccatctacatctgccgcatgagcaaccacccccggacgaccatggccttcctgttctggttctccttcgggtacgtgatcacctgcatcttctgcaaggccctgttctacagcctcatcatcatcggcaccctggggaagaagatcaagcagtaccgcgagctgaagccccagacctgcacgatctgcgagaccgcgcccgtgaacgccatcgacgccgagatgcacgacctcaactgctcctacaacatctgcccgtactgcgccagccggctgacctccgacggcctggcccgccacgtcacccagtgccccaagcggaaggagaaggtggaggagacggagctctacctgaacctggagcgcatcccctggatcgtgcggaagctcctgcaggtcagcgagagcaccggggtggcgctgaagcgctccagctggctcatcgtgctgctggtcctcctgaccgtgtccctgagccccgtgcagtccgccccggtcggccacggcaagaccatcgagacgtaccagacccgggaggggttcaccagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagacgggctccaacgtcatgctcgccgtgtgcaagcggatgtgcttcaaggcgaccatcgaggccagccgccgcgccctgctgatccggagcatcatcaacaccaccttcgtgatctgcatcctcacgctggccatctgcgtcgtgtccaccagcgccgtggagatggaggacctgccggcggggacctgggagcgcgaggaggacctcaccaacttctgccaccaggagtgccaggtcacggagaccgagtgcctgtgcccctacgaggccctggtgctccggaagcccctgttcctggactccatcgtgaagggcatgaagaacctcctgaacagcacctccctggagaccagcctctccatcgaggccccctggggggccatcaacgtccagagcacgttcaagccgaccgtgtccaccgccaacatcgcgctgagctggtccagcgtggagcaccgcggcaacaagatcctggtcaccgggcggtccgagagcatcatgaagctcgaggagcgcacgggcgtgtcctgggacctgggcgtggaggacgccagcgagtccaagctgctcaccgtcagcatcatggacctgtcccagatgtacagccccgtgttcgagtacctgagcggggaccggcaggtggaggagtggcccaaggccacctgcaccggcgactgccccgagcgctgcgggtgcacgtccagcacctgcctccacaaggagtggccgcactcccggaactggcgctgcaaccccacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctgaccagccaggagcggcagtgctccctcatcgaggccgggacccgcttcaacctgggccccgtcacgatcaccctgagcgagccccggaacatccagcagaagctcccgcccgagatcatcaccctgcaccccaagatcgaggaggggttcttcgacctgatgcacgtgcagaaggtgctctccgcgagcaccgtctgcaagctgcagtcctgcacgcacggcatccccggcgacctgcagatctaccacatcgggaacctcctgaagggcgaccgcgtgaacgggcacctgatccacaagatcgagccgcacttcaacaccagctggatgtcctgggacggctgcgacctcgactactactgcaacatgggggactggcccagctgcacctacaccggcgtcacgcagcacaaccacgccgccttcgtgaacctgctgaacatcgagaccgactacaccaagaccttccacttccactccaagcgggtgacggcccacggcgacaccccccagctcgacctgaaggcgcgccccacctacggggccggcgagatcaccgtcctggtggaggtggccgacatggagctccacacgaagaaggtcgagatcagcgggctgaagttcgcctccctgacctgcaccggctgctacgcctgcagctccgggatcagctgcaaggtgcggatccacgtggacgagccggacgagctcaccgtccacgtgaagtccagcgaccccgacgtggtcgcggccagcacgtccctgatggcccgcaagctggagttcggcaccgacagcaccttcaaggccttctccgccatgcccaagaccagcctctgcttctacatcgtggagcgggagtactgcaagtcctgcagcgaggacgacacgaagaagtgcgtggacaccaagctggagcagccccagtccatcctgatcgagcacaagggcaccatcatcgggaagcagaacgacacctgcacggcgaaggccagctgctggctcgagtccgtcaagagcttcttctacggcctgaagaacatgctggggtccgtgttcggcagcttcttcgtggggatcctcctgttcctgaccccgttcgtcctgctcgtgctgttcttcatgttcggctggaagatcctgttctgcttcaagtgctgccgccggacccgcggcctcttcaagtaccgccacctgaaggacgacgaggagaccgggtaccggcgcatcatcgagcggctgaactccaagaagggcaagaaccgcctcctggacggggagcggctggccgaccgcaagatcgccgagctcttcagcacgaagacccacatcggctga

SEQ ID NO: 12038 - RNA, 5052 nt, synthetic construct
  misc_feature 1..5052: note = derived and/or modified CDS sequence (opt1) from CCHFV(47-ST-2013)__KR814861.1__GP
  source 1..5052: mol_type = other RNA
atgcacaccctgctggcctgcttcatcctgtacctgcagctcagcggcctcggcggggcccacgggcagtccaacgcgaccgagcacaacgggaccaacaccaccaccgtgcccgggaccagccagtccccgaagccgcccgccagcaccaccctgccccacacccccgagtccagcaccgtgaagctcaccacccccacctccgagaccgagggcagcggcgagaccacgccgccgcccaacaccacccaggggctgcccccgcccggcaccacccccgagcgctccgccaccaccgccaccagcacctccagcaccgacaacatgaactccacgacccagatgaccgggaacacccccacgcccaccgtgaacatgagcccctccagctccccgagcatgccctccaccagccagggcatccactaccccgtgcggagcctgctctccgtccccagccccaagaccgccacgacccccacccccgtgtcccccggggagatgagccccgagacctccagccagcactccgcgacgagccgcatccccaccctgtacaccgccacccaggtgtccaccgagaacacgaaccggagcacgccccgccagtccaagagctccgtccagcccgccacccagagccccatcacgccgcccgcccagacgatcctgctcatgtccgcggccccgaaggccatccaggacatgcaccccagccccaccaaccggtccaagcgcaacctggaggtggagatcatcctgaccctcagccagggcctgaagaagtactacggcaagatcctgaagctcctgcacctgaccctcgaggaggacacggaggggctgctggagtggtgcaagcggaacctcggctccaactgcgacgacgacttcttccagaagcgcatcgaggagttcttcatcaccggggagggctacttcaacgaggtgctgcagttcaagaccctgagcaccctcagccccacggagccgtcccacgtccggctgcccaccgccgagcccttcaagagctactacgccaagggcttcctgtccctcgacagcgggtacttctccgcgaagtgctacccccgcagctccaccagcggcctgcagctgatcaacgtgacccagcacccggcccggatcgccgagacgcccgggcccaagaccacctccctcaagaccatcaactgcatcaacctgcgcgccagcgtgttcaaggagcaccgggaggtcgagatcaacgtgctgctcccccagatcgccgtgaacctgtccaactgccacgtcgtgatcaacagccacgtgtgcgactacccgctggacacggacggccccgtccgcctcccccggatccaccacgaggggaccttcatccccggcacctacaagatcgtgatcgacaagaagaacaagctgaacgaccgctgctccctggtgaccaactgcgtcatcaagggccgggaggtgcgcaaggggcagagcgtgctccggcagtacaagacggagatcaagatcggcaaggcgtccaccgggagccgcaagctgctgtccgaggagccgggcgacgactgcatcagccggacccagctcctgaagaccgagacggccgagatccacgacgacaactacgggggccccggcgacaagatcaccatctgcaacgggagcaccatcgtcgaccagcgcctgggctccgagctcgggtgctacaccatcaaccgcgtcaagtccttcaagctgtgcaagaactccgccacgggcaagacctgcgagatcgacagcacccccgtcaagtgccggcaggggttctgcctgaagatcacccaggagggccgcggccacgtgaagctgtcccgggggagcgaggtggtcctcgacgcctgcgactccagctgcgagatcatgatccccaagggcacgggggacatcctggtggactgctccggcggccagcagcacttcctgaaggacaacctcatcgacctggggtgcccgcacatccccctgctcggcaagatggccatctacatctgccgcatgagcaaccacccccggaccaccatggcgttcctgttctggttctccttcgggtacgtgatcacgtgcatcttctgcaaggccctgttctacagcctcatcatcatcggcaccctggggaagaagatcaagcagtaccgcgagctgaagccccagacgtgcaccatctgcgagaccgccccggtcaacgccatcgacgccgagatgcacgacctcaactgctcctacaacatctgcccctactgcgcgagccggctgacctccgacggcctggcccgccacgtgacgcagtgccccaagcggaaggagaaggtggaggagaccgagctctacctgaacctggagcgcatcccgtggatcgtccggaagctcctccaggtgagcgagtccaccggcgtggccctgaagcgcagctcctggctcatcgtcctgctggtgctcctgaccgtgagcctgagccccgtccagtccgcccccgtggggcacggcaagacgatcgagacctaccagacccgggaggggttcaccagcatctgcctcttcatgctgggctccatcctgttcatcgtgagctgcctcgtcaaggggctggtggactccgtgagcgactccttcttccccggcctgagcgtctgccgcacgtgctccatcggcagcatcaacgggttcgagatcgagtcccacaagtgctactgcagcctcttctgctgcccgtactgccggcactgctccgcggaccgcgagatccaccagctgcacctgagcatctgcaagaagcggaagaccggctccaacgtgatgctcgccgtgtgcaagcgcatgtgcttcaaggccaccatcgaggccagccggcgcgccctgttcatccgctccatcatcaacaccacgttcgtgacctgcatcctgaccctcgcgatctgcgtggtgagcacctccgccgtcgagatggaggacctgcccgccgggacgtgggagcgggaggaggacctgaccaacttctgccaccaggagtgccaggtgaccgagaccgagtgcctctgcccctacgaggccctggtgctgcgcaagcccctcttcctggacagcatcgtcaagggcatgaagaacctgctcaacagcacgtccctggagaccagcctgtccatcgaggccccgtggggcgcgatcaacgtgcagagcaccttcaagcccaccgtgtccacggccaacatcgccctcagctggtccagcgtcgagcaccggggcaacaagatcctggtgaccggccgctccgagagcatcatgaagctggaggagcggaccggggtgtcctgggacctcggcgtcgaggacgccagcgagtccaagctgctgaccgtgagcatcatggacctctcccagatgtacagccccgtgttcgagtacctgtccggggaccgccaggtcgaggagtggcccaaggccacgtgcaccggcgagtgcccggagcggtgcgggtgcaccagcagcacgtgcctgcacaaggagtggccccacagccgcaactggcggtgcaaccccacctggtgctggggcgtgggcaccgggtgcacgtgctgcggcgtggacgtcaaggacctcttcaccgaccacatgttcatcaagtggaaggtggagtacatcaagaccgaggcgatcgtgtgcgtcgagctgacgagccaggagcgccagtgctccctgatcgaggccgggacccggttcaacctcggccccgtgaccatcaccctgagcgagccgcgcaacatccagcagaagctgccgcccgagatcatcacgctccaccccaagatcgaggagggcttcttcgacctgatgcacgtgcagaaggtcctgtccgccagcaccgtgtgcaagctccagtcctgcacccacgggatcccgggcgacctgcagatctaccacatcgggaacctgctcaagggcgaccgggtgaacgggcacctgatccacaagatcgagccccacttcaacaccagctggatgtcctgggacggctgcgacctggactactactgcaacatgggcgactggcccagctgcacgtacaccggggtcacccagcacaaccacgccgcgttcgtgaacctcctgaacatcgagaccgactacacgaagaccttccacttccactccaagcgcgtcaccgcccacggcgacacgccccagctggacctcaaggcccggccgacgtacggggccggcgagatcaccgtgctggtggaggtcgccgacatggagctgcacaccaagaaggtggaggtgagcgggctcaagttcgcgtccctggcctgcaccggctgctacgcctgcagctccggcatcagctgcaaggtccgcatccacgtggacgagcccgacgagctgacggtgcacgtcaagtccagcgaccccgacgtggtggccgcctccaccagcctcatggcgcggaagctggagttcgggaccgactccaccttcaaggccttcagcgccatgcccaagacgagcctgtgcttctacatcgtcgagcgcgagtactgcaagtcctgcagcgaggacgacaccaagaagtgcgtggacaccaagctcgagcagccgcagtccatcctgatcgagcacaagggcaccatcatcgggaagcagaacgacacgtgcaccgccaaggccagctgctggctggagtccgtcaagagcttcttctacggcctcaagaacatgctggggtccgtcttcggcaacttcttcgtgggcatcctgctgttcctggcgcccttcgtgctgctggtcctcttcttcatgttcgggtggaagatcctgttctgcttcaagtgctgccggcgcacccggggcctgttcaagtaccgccacctcaaggacgacgaggagaccgggtaccgccggatcatcgagcgcctgaacagcaagaagggcaagaaccggctgctcgacggcgagcgcctggccgaccggaagatcgccgagctgttctccacgaagacccacatcgggtga

SEQ ID NO: 12039 - RNA, 5052 nt, synthetic construct
  misc_feature 1..5052: note = derived and/or modified CDS sequence (opt1) from CCHFV(1-CR/HU-2015)__KU161584.1__GP
  source 1..5052: mol_type = other RNA
atgcacaccctgctcgtgtgcttcatcctgtacctgcagctcctgggcctcggcggggcccacgagcagagcaacgccaccgaccacaaccgcaccaacaccatcaccgcgcccagcaccagccagaacccgaagccgcccgcctccacgacgccgccccacacccccgagagctccaccatcaagctcatcaccagcaccggggaggccgaggggtccggggagaccaccccgcccctgaacaccacccagggccccttcccgcccgagaccaccagcgagcaccccgcctccaccgccaccaacaccagctccaccaacagcatgaactccaccacccagatgaccgacaacaccctgacgagcaccgtgtccaccagcctctccatcagcccgtccacccccagcacgagccagggcatccactaccccgtgcggtccctgctgagcgtgtccagccccaagaccgcggccacccccacccccatgtccacgcgcgagatgagctccgagaccagctcccagcacagcgccatgtcccggacccccaccttccacacggccacccaggtcagcaccgagaacgcgaaccgctccacgccccgccagagcgagtccagcgcccagcccgccacccagtcccccatgacgagccccgcccagtccatcttcctcgtgagcgccgcgcccaccaccatccagaacatccacccgagccccaccaaccgctccaagcggaacctggagatggagatcatcctgacgctcccccaggggctgaagaagtactacggcaagatcctgaagctcctgcacctgaccctcgaggaggacaccgaggggctgctggagtggtgcaagcgcaacctcggcagcaactgcgacgacgagttcttccagaagcggatcgaggagttcttcatcaccggggagggctacttcaacgaggtgctgcagttcaagacgctgtccaccctcagccccaccgagccctcccacgcccggccgcccaccgccgagccgttcaagagctacttcgccaagggcttcctgtccatcgacagcgggtacttctccgccaagtgctacccccggagctccacgagcggcctgcagctcatcaacatcacccagcaccccgcgcgcatcgccgagacccccgggccgaagaccacgtccctgaagaccatcaactgcatcaacctgcgggccagcgtcttcaaggagcaccgcgaggtggagatcaacgtgctcctgccccagatcgccgtcaacctgtccaactgccacgtggtgatcaacagccacgtctgcgactactccctcgacaccgacggccccgtgcggctgccccgcatctaccacgagggcaccttcatcccggggacgtacaagatcgtgatcgacaagaagaacaagctgaacgaccggtgcaccctcgtcaccaactgcgtgatcaagggccgcgaggtgcggaaggggcagagcgtcctgcgccagtacaagaccgagatcaagatcggcaaggccagcacggggtcccggaagctgctcagcgaggagcccggcgacgactgcatctcccgcacccagctgctgcgcaccgagaccgcggagatccacgacgacaactacggcgggcccggcgacaagatcacgatctgcaacgggagcaccatcgtggaccagcggctcggctccgagctggggtgctacaccatcaaccgcgtcaagagcttcaagctgtgcgagaactccgccaccggcaagacgtgcgagatcgacagcacccccgtcaagtgccggcagggcttctgcctcaagatcacccaggaggggcgcggccacgtgaagctgtcccgggggagcgaggtggtcctggacgcctgcgactccagctgcgaggtgatgatccccaagggcaccggggacatcctggtcgactgctccggcggccagcagcacttcctcaaggacaacctgatcgacctggggtgcccccacatccccctcctgggcaagatggccatctacatctgccgcatgagcaaccacccccggacgaccatggccttcctgttctggttctccttcgggtacgtgatcacgtgcatcttctgcaaggccctgttctacagcctgatcatcatcggcaccctgggcaagaagatcaagcagtaccgcgagctcaagccgcagacctgcacgatctgcgagaccgcccccgtgaacgccatcgacgccgagatgcacgacctgaactgctcctacaacatctgcccctactgcgcgagccggctgacctccgacgggctcgcccgccacgtcacccagtgccccaagcggaaggagaaggtggaggagacggagctgtacctgaacctcgagcgcatcccgtggatcgtgcggaagctgctgcaggtcagcgagagcaccggcgtggccctcaagcgctccagctggctgatcgtgctgctcgtcctgctgaccgtgtccctcagccccgtgcagtccgcccccgtcgggcacggcaagaccatcgagacgtaccagacccgggaggggttcaccagcatctgcctgttcatgctgggctccatcctcttcatcgtgagctgcctggtgaagggcctggtcgactccgtgagcgactccttcttccccgggctcagcgtgtgccggacctgctccatcggcagcatcaacgggttcgagatcgagtcccacaagtgctactgcagcctgttctgctgcccgtactgccggcactgctccgccgaccgcgagatccaccagctgcacctcagcatctgcaagaagcggaagacgggctccaacgtcatgctggcggtgtgcaagcgcatgtgcttccgcgccaccatggaggccagccggcgcgccctgctcatccggagcatcatcaacaccaccttcgtgatctgcatcctgacgctgaccatctgcgtcgtgtccaccagcgccgtggagatggagaacctccccgcggggacctgggagcgcgaggaggacctgacgaacttctgccaccaggagtgccaggtcaccgagaccgagtgcctgtgcccctacgaggccctcgtgctgcggaagccgctgttcctcgactccatcgtgaagggcatgaagaacctgctgaacagcacctccctcgagacgagcctgtccatcgaggccccctggggcgccatcaacgtccagagcaccttcaagcccaccgtgtccaccgccaacatcgcgctgagctggtccagcgtggagcaccgcgggaacaagatcctcgtcacgggccggtccgagagcatcatgaagctggaggagcgcaccggggtgtcctgggacctgggcgtggaggacgccagcgagtccaagctcctgaccgtcagcatcatggacctgtcccagatgtacagccccgtgttcgagtacctcagcggggaccgccaggtggaggagtggccgaaggcgacctgcacgggcgactgccccgagcgctgcggctgcacctcctccacgtgcctgcacaaggagtggccccactcccggaactggcgctgcaaccccacctggtgctggggcgtgggcaccgggtgcacgtgctgcggcgtggacgtgaaggacctgttcaccgaccacatgttcgtcaagtggaaggtggagtacatcaagaccgaggccatcgtgtgcgtcgagctcaccagccaggagcggcagtgctccctgatcgaggcggggacgcgcttcaacctgggcccggtgaccatcaccctcagcgagccccggaacatccagcagaagctgccgcccgagatcatcaccctgcacccgaagatcgaggagggcttcttcgacctcatgcacgtgcagaaggtcctgtccgccagcacggtgtgcaagctgcagtcctgcacccacgggatccccggcgacctccaggtgtaccacatcgggaacctgctgaagggcgaccgcgtcaacggccacctcatccacaagatcgagccccacttcaacaccagctggatgtcctgggacgggtgcgacctggactactactgcaacatgggcgactggcccagctgcacctacacgggggtgacccagcacaaccacgccgccttcgtgaacctgctcaacatcgagaccgactacaccaagacgttccacttccactccaagcgggtcaccgcccacggcgacaccccgcagctggacctgaaggcgcgccccacctacggggccggcgagatcacggtgctcgtcgaggtggccgacatggagctgcacaccaagaaggtggagatcagcggcctgaagttcgcctccctcgcctgcaccgggtgctacgcgtgcagctccggcatcagctgcaaggtccggatccacgtggacgagcccgacgagctgaccgtgcacgtcaagtccagcgaccccgacgtggtggccgccagcacgtccctgatggcccgcaagctcgagttcgggaccgacagcaccttcaaggccttctccgcgatgccgaagaccagcctgtgcttctacatcgtcgagcgggagtactgcaagtcctgcagcgaggacgacacgaagaagtgcgtggacaccaagctggagcagccccagtccatcctcatcgagcacaagggcaccatcatcgggaagcagaacgacacgtgcacggccaaggccagctgctggctggagtccgtcaagagcttcttctacggcctgaagaacatgctcggctccgtcttcgggaacttcttcatcggcatcctgctgttcctcgcccccttcgtgctgctggtgctgttcttcatgttcgggtggaagatcctcttctgcttcaagtgctgccgccgcacccggggcctgttcaagtaccgccacctgaaggacgacgaggagaccgggtaccggcgcatcatcgagcggctcaacaacaagaagggcaagaaccgcctgctggacggcgagcggctcgcggaccgcaagatcgccgagctgttcagcaccaagacgcacatcgggtga

SEQ ID NO: 12040 - RNA, 5049 nt, synthetic construct
  misc_feature 1..5049: note = derived and/or modified CDS sequence (opt1) from CCHFV(3820-ST-2007)__KR814868.1__GP
  source 1..5049: mol_type = other RNA
atgcacaccctgctcgtgtgcttcatcctgtacctgcagctcagcggcctggggggcgcccacgggcagtccaacgccaccgagcacaacggcacgaacaccaccaccgtccccgggacgagccagtccccgaagccccccgcgagcaccaccctgccccacaccccggagtccagcacggtgaagctcaccacccccacctccgagacggagggcagcggcgagaccaccccccccaacaccacgcaggggctgccgctgcccggcaccacccccgagcgctccgccaccacggccaccagcacctccagcaccgacaacatgaactccacgacccaggtgaccgacaacacccccacgagcaccgtctccatcagcccgtccagctccagcagcatgccctccaccagccaggggatccaccaccccgtgcggtccctcctgagcgtgtccagccccaagaccgtcacgaccccgacccccatgtcccccggcgagatgagccccgagacctccagccagcactccgccatgagccgcgtgccgacgctgtacaccgccacccagatctccaccgagaacaccgaccggagcacgccccgccagtccgagagctccgtgcagcccgcgacccagagccccatcacctccccggcccagaccatcctcctgatgagcgccgcccccaaggcgatccaggacatgcaccccagccccacgaaccggtccaagcgcaacctggaggtcgagatcatcctcaccctgagccaggggctgaagaagtactacggcaagatcctcaagctgctgcacctcaccctggaggaggacaccgagggcctgctcgagtggtgcaagcggaacctggggtccaactgcgacgacgacttcttccagaagcgcatcgaggagttcttcatcacgggcgaggggtacttcaacgaggtgctgcagttcaagaccctcagcaccctgtccccgaccgagcccagccacgtgcggctgcccacggccgagccgttcaagtcctacttcgccaagggcttcctcagcatcgactccggctacttcagcgccaagtgctacccccgctccagcacctccgggctgcagctgatcaacgtcacccagcaccccgcccggatcgcggagacccccggcccgaagacgaccagcctcaagaccatcaactgcatcaacctgcgcgcctccgtgttcaaggagcaccgggaggtggagatcaacgtcctgctcccccagatcgccgtgaacctgagcaactgccacgtggtcatcaactcccacgtgtgcgactacagcctggacaccgacgggcccgtgcgcctcccccggatccaccacgagggcacgttcatcccggggacctacaagatcgtcatcgaccgcaagaacaagctgaacgaccggtgcagcctggtgaccaactgcgtgatcaagggccgcgaggtccggaagggccagtccgtgctccgccagtacaagaccgagatcaagatcgggaagacgagcaccggctcccggaagctgctgagcgaggagcccggggacgactgcatctcccgcacccagctcctgaagaccgagacggccgagatccacgacgacaactacggcagccccggggacaagatcaccatctgcaacggctccaccatcgtcgaccagcgcctgggcagcgagctcgggtgctacaccatcaaccgggtgaagtccttcaagctgtgcgagaacagcgccacgggcaagacctgcgagatcgactccacccccgtgaagtgccgccaggggttctgcctgaagatcacccaggagggccgggggcacgtcaagctgagccgcggctccgaggtggtgctcgacgcgtgcgacagctcctgcgagatcatgatcccgaagggcacgggggacatcctggtcgactgcagcggcgggcagcagcacttcctgaaggacaacctcatcgacctgggctgcccccacatccccctgctcggcaagatggccatctacatctgccggatgtccaaccacccccgcaccaccatggccttcctgttctggttcagcttcgggtacgtgatcacctgcatcttctgcaaggccctgttctactccctcatcatcatcggcaccctggggaagaagatcaagcagtaccgggagctgaagccgcagacgtgcaccatctgcgagaccgcccccgtgaacgcgatcgacgccgagatgcacgacctcaactgcagctacaacatctgcccctactgcgccagccgcctgacctccgacggcctggcccggcacgtcacgcagtgccccaagcgcaaggagaaggtggaggagaccgagctctacctgaacctggagcggatcccgtggatcgtgcgcaagctcctgcaggtcagcgagtccaccggggtggccctgaagcggagctcctggctcatcgtgctgctggtcctcctggcggtgagcctgtcccccgtgcagagcgcccccgtcggccacggcaagaccatcgagacgtaccagacccgcgaggggttcacctccatctgcctcttcatgctgggcagcatcctgttcatcgtgtcctgcctcgtgaaggggctggtcgacagcgtgtccgacagcttcttccccggcctgtccgtgtgcaagacctgcagcatcgggtccatcaacggcttcgagatcgagagccacaagtgctactgctccctcttctgctgcccgtactgccggcactgcagcgccgaccgcgagatccaccagctgcacctgagcatctgcaagaagcggaagacgggctccaacgtcatgctcgccgtgtgcaagcgcatgtgcttcaaggcgaccatcgaggccagccggcgcgccctgctgatccgctccatcatcaacaccaccttcgtgatgtgcatcctcacgctggccatctgcgtcgtgagcacctccgccgtggagatggaggacctgcccgcggggacctgggagcgggaggaggacctcaccaacttctgccaccaggagtgccaggtcacggagaccgagtgcctgtgcccctacgaggccctggtgctccgcaagccgctgttcctggacagcatcgtgaagggcatgaagaacctcctgaactccaccagcctggagacctccctcagcatcgaggccccctggggggccatcaacgtccagtccacgttcaagcccaccgtgagcaccgccaacatcgcgctgtcctggagctccgtggagcaccggggcaacaagatcctggtcaccgggcgcagcgagtccatcatgaagctcgaggagcggacgggcgtgagctgggacctgggcgtggaggacgcctccgagagcaagctgctcaccgtcagcatcatggacctgtcccagatgtacagccccgtgttcgagtacctgtccggggaccgccaggtggaggagtggccgaaggccacctgcaccggcgactgccccgagcggtgcgggtgcacgagctccacctgcctccacaaggagtggccccacagccgcaactggcggtgcaaccccacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctgacctcccaggagcgccagtgcagcctcatcgaggccgggacccggttcaacctgggcccggtcacgatcaccctgtccgagccccgcaacatccagcagaagctcccccccgagatcatcaccctgcacccgaagatcgaggaggggttcttcgacctgatgcacgtgcagaaggtgctcagcgcgtccaccgtctgcaagctgcagagctgcacgcacggcatccccggcgacctgcagatctaccacatcgggaacctcctgaagggcgaccgggtgaacgggcacctgatccacaagatcgagccccacttcaacacctcctggatgagctgggacggctgcgacctcgactactactgcaacatgggggactggccctcctgcacctacaccggcgtcacgcagcacaaccacgccgccttcgtgaacctgctgaacatcgagaccgactacaccaagaccttccacttccacagcaagcgcgtgacggcccacggcgacaccccgcagctcgacctgaaggcgcggcccacctacggggccggcgagatcaccgtcctggtggaggtggccgacatggagctccacacgaagaaggtcgagatctccgggctgaagttcgccagcctgacctgcaccggctgctacgcctgctccagcgggatcagctgcaaggtgcgcatccacgtggacgagcccgacgagctcaccgtccacgtgaagtccagcgaccccgacgtggtcgcggcctccacgagcctgatggcccggaagctggagttcggcaccgactccaccttcaaggccttcagcgccatgccgaagacctccctctgcttctacatcgtggagcgcgagtactgcaagagctgctccgaggacgacacgaagaagtgcgtggacaccaagctggagcagccccagagcatcctgatcgagcacaagggcaccatcatcgggaagcagaacgacacctgcacggcgaaggcctcctgctggctcgagagcgtcaagtccttcttctacggcctgaagaacatgctggggagcgtgttcggctccttcttcgtggggatcctcctgttcctggcccccttcgtcctgctcgtgctgttcttcatgttcggctggaagatcctgttctgcttcaagtgctgccggcgcacccggggcctcttcaagtaccgccacctgaaggacgacgaggagaccgggtaccgccggatcatcgagcgcctgaacagcaagaagggcaagaaccggctcctggacggggagcgcctggccgaccggaagatcgccgagctcttctccaccaagacgcacatcggctga

SEQ ID NO: 12041 - RNA, 5052 nt, synthetic construct
  misc_feature 1..5052: note = derived and/or modified CDS sequence (opt1) from CCHFV(Ast199)__KX056051.1__GP
  source 1..5052: mol_type = other RNA
atgcacaccctgctggtgtgcttcatcctgtacctgcagctctccggcctcggcggggcccacgtccagtccaacgccaccgagcacaacgggaccaacaccaccaccgtgcccgggaccagccagtccccgaagccgcccgcgagcaccaccctgccccacacccccgagtccagcaccgtgaagctcaccacccccacctccgagaccgaggggagcggcgagaccacgccgccgcccaacaccacccagggcctgcccccgcccgggaccacccccgagcggcccgccaccacggccaccaccacctccagcacggacaacatgaactccaccacccaggtcaccgacaacacgcccaccagcaccgtgtccatcagcccctccagcaacccgtccatgcccagcacctcccagggcatccactaccccgtgcggagcctgctcagcgtctccagccccaagacggtgaccacccccacccccatgtcccccggggagatgagccccgagacgtccagccagcactccgccatgagccgcatcccgaccctgtacaccgccgcccaggtgtccaccgagaacaccaaccggagcacgccccgccagtccgagagctccgcccagcccgccacccagagccccaccaccttcccggcccagacgatccccctgatgtccgcggcccccaaggccatccaggacatgcacccgagccccaccaaccggtccaagcgcaacctcgaggtcgagatcatcctgaccctgagccagggcctcaagaagtactacgggaagatcctgaagctgctccacctgaccctggaggaggacacggagggcctcctggagtggtgcaagcggaacctgggctccaactgcgacgacgacttcttccagaagcgcatcgaggagttcttcatcaccggggagggctacttcaacgaggtgctccagttcaagacccccagcaccctgagccccacggagccgtcccacgtgcggctgcccaccgccgagcccttcaagagctacttcgccaaggggttcctctccatcgacagcggctacttctccgcgaagtgctacccccgcagctccaccagcggcctgcagctgatcaacgtcacccagcacccggcccggatcgccgagacgcccgggcccaagaccacctccctcaagaccatcaactgcatcaacctgcgcgccagcgtgttcaaggagcaccgggaggtggagatcaacgtcctgctcccccagatcgccgtgaacctgtccaactgccacgtggtcatcaacagccacgtgtgcgactactccctggacacggacggcccggtgcgcctcccccggatccaccacgaggggaccttcatccccggcacctacaagatcgtcatcgacaagaagaacaagctgaacgaccgctgcagcctggtgaccaactgcgtgatcaaggggcgggaggtccgcaagggccagtccgtgctccggcagtacaagacggagatcaagatcggcaaggcgagcaccgggtcccgcaagctgctgagcgaggagcccggcgacgactgcatcagccggacccagctcctgaagaccgagacggccgagatccacgacgacaactacgggggcccgggggacaagatcaccatctgcaacggctccaccatcgtcgaccagcgcctgggcagcgagctcgggtgctacaccatcaaccgcgtgaagtccttcaagctgtgcgagaacagcgccacgggcaagacctgcgagatcgactccacccccgtgaagtgccggcaggggttctgcctgaagatcacccaggagggccgcgggcacgtcaagctcagccggggctccgaggtggtgctggacgcctgcgacagctcctgcgagatcatgatccccaagggcacgggggacatcctggtcgactgcagcggcgggcagcagcacttcctgaaggacaacctcatcgacctgggctgcccccacatcccgctgctcggcaagatggccatctacatctgccgcatgtccaaccacccccggaccaccatggcgttcctgttctggttcagcttcgggtacgtgatcacgtgcatcttctgcaaggccctgttctactccctcatcatcatcggcaccctggggaagaagatcaagcagtaccgcgagctgaagccccagacgtgcaccatctgcgagaccgcccccgtgaacgccatcgacgccgagatgcacgacctcaactgcagctacaacatctgcccgtactgcgcgtcccggctgaccagcgacggcctggcccgccacgtcacgcagtgccccaagcggaaggagaaggtggaggagaccgagctctacctgaacctggagcgcatcccctggatcgtgcggaagctcctgcaggtctccgagagcaccggggtggccctgaagcgctgctcctggctcatcgtgctgctggtcctcctgaccgtgagcctgagcccggtgcagtccgcccccgtcggccacggcaagacgatcgagacctaccagacccgggaggggttcaccaacatctgcctcttcatgctgggcagcatcctgttcatcgtgtcctgcctcgtgaaggggctggtcgacagcgtgtccgacagcttcttccccggcctgtccgtgtgcaagacgtgcagcatcgggtccatcaacggcttcgagatcgagagccacaagtgctactgctccctcttctgctgcccctactgccgccactgcagcgcggaccgggagatccaccagctgcacctgggcatctgcaagaagcgcaagaccgggtccaacgtcatgctcgccgtgtgcaagcggatgtgcttcaaggccaccatcgaggccagccgccgggccctgctgatccgctccatcatcaacaccacgttcgtgatctgcatcctcaccctggcgatctgcgtcgtgagcacctccgccgtggagatggagaacctgccggccggcacctgggagcgcgaggaggacctcacgaacttctgccaccaggagtgccaggtcaccgagaccgagtgcctgtgcccctacgaggccctggtgctccggaagcccctgttcctggacagcatcgtgaaggggatgaagaacctcctgaactccaccagcctggagacgagcctctccatcgaggccccctggggcgcgatcaacgtccagagcaccttcaagccgaccgtgtccaccgccaacatcgccctgagctggtccagcgtggagcaccgcgggaacaagatcctggtcacgggccggtccgagagcatcatgaagctcgaggagcgcaccggcgtgtcctgggacctgggggtggaggacgccagcgagtccaagctgctcaccgtcagcatcatggacctgtcccagatgtacagccccgtgttcgagtacctgtccggcgaccgccaggtggaggagtggcccaaggcgacctgcacgggggactgccccgagcgctgcggctgcaccagcagcacgtgcctccacaaggagtggccgcacagccggaactggcgctgcaaccccacctggtgctggggcgtcggcaccggctgcacgtgctgcggggtggacgtgaaggacctgttcaccgaccacatgttcatcaagtggaaggtcgagtacatcaagaccgaggcgatcgtgtgcgtggagctgacctcccaggagcggcagtgcagcctcatcgaggccggcacgcgcttcaacctggggcccgtcaccatcaccctgagcgagccccggaacatccagcagaagctcccgcccgagatcatcaccctgcaccccaagatcgaggagggcttcttcgacctgatgcacgtgcagaaggtgctctccgccagcacggtctgcaagctgcagtcctgcacccacggcatccccggggacctgcagatctaccacatcggcaacctcctgaagggggaccgcctgaacggccacctcatccacaagatcgagccgcacttcaacaccagctggatgtcctgggacgggtgcgacctggactactactgcaacatgggcgactggcccagctgcacctacacgggcgtgacccagcacaaccacgccgcgttcgtcaacctgctcaacatcgagaccgactacaccaagacgttccacttccactccaagcgggtgaccgcccacggggacacgccccagctggacctgaaggcccgccccacctacggcgccggggagatcacggtgctcgtcgaggtggccgacatggagctgcacaccaagaaggtggaggtcagcggcctgaagttcgcgtccctcgcctgcaccgggtgctacgcctgcagctccggcatcagctgcaaggtgcggatccacgtggacgagccggacgagctgaccgtccacgtgaagtccagcgaccccgacgtggtcgccgcctccacgagcctgatggcgcgcaagctcgagttcggcaccgactccaccttcaaggccttcagcgccatgcccaagacctccctgtgcttctacatcgtggagcgggagtactgcaagagctgcagcgaggacgacacgaagaagtgcgtggacaccaagctggagcagccccagtccatcctcatcgagcacaaggggaccatcatcggcaagcagaacgacacgtgcacggccaaggccagctgctggctggagtccgtcaagagcttcttctacgggctgaagaacatgctcggctccgtgttcgggaacttcttcgtgggcatcctgctgttcctcgcgccgttcgtcctgctggtgctgttcttcatcttcggctggaagatcctcttctgcttcaagtgctgccgccggacccgcgggctgttcaagtaccggcacctgaaggacgacgaggagaccggctaccgcaagatcatcgagcgcctcaacagcaagaaggggaagaaccggctgctggacggcgagcgcctcgccgaccggaagatcgccgagctgttctccaccaagacgcacatcggctga

SEQ ID NO: 12042 - RNA, 5052 nt, synthetic construct
  misc_feature 1..5052: note = derived and/or modified CDS sequence (opt1) from CCHFV(Turkey200310849)__DQ211636.1__GP
  source 1..5052: mol_type = other RNA
atgcacaccctgctcgtgtgcttcatcctgtacctgcagctcctgtgcctgggcggggcccacggccagctcaacaccacggagcacaacgggaccaacaacaccaccgcccccggcgcgagccagtccccgaagccccccatgagcacgacccccccgcacgcccccgagtccagcaccatcaagcccaccacgcccatctccgaggccgaggggagcggcgagaccacctccaccccgaacacgacccagggcctgagctcccccgagaccaccagcgagcgccccgccacgaccgccatctccaccagctccaccgacagcacgaaccccaccacccagatgaccgacaacacgccgaccctgaccgtctccaccagcccctccagctcccccagcacgcccagcaccccgcaggggatctaccaccccgcgcggtccctcctgagcgtgtccagccccaagaccgtgaccacgcccaccccgacctcccccggcgagatgagctccgagaccagctcccagcacagcgccatgtcccgcatccccacgccccacaccgccacccgggtcagcaccgagaacaccaaccactccacgccgcgccagagcgagtccagcgcccagcagaccaccccctcccccatgaccagccccgcgcagtccatcctgctcatgagcgccgccccgacggccgtgcaggacatccaccccagccccaccaaccggtccaagcgcaacctggagaccgagatcatcctgaccctcagccaggggctgaagaagtactacggcaagatcctgaagctcctgcacctgacgctcgaggaggacaccgaggggctgctggagtggtgcaagcggaacctcggctccaactgcgacgacgacttcttccagaagcgcatcgaggagttcttcatgaccggcgaggggtacttcaacgaggtgctgcagttcaagaccctgagcacgctctccccgaccgagcccagccacgcccggctgcccaccgcggagcccttcaagtcctacttcgccaagggcttcctgagcatcgactccgggtacttcagcgccaagtgctacccgcgctccagcgcctccggcctccagctgatcaacgtcacccagcaccccgcccggatcgcggagacgcccggccccaagaccaccagcctgaagaccatcaactgcatcaacctccgcgcctccgtgttcaaggagcaccgggagatcgagatcaacgtgctgctgccgcagatcgccgtcaacctcagcaactgccacgtggtgatcaactcccacgtctgcgactacagcctggacacggacgggcccgtgcgcctgccccggatctaccacgagggcaccttcatccccgggacctacaagatcgtgatcgacaagaagaacaagctcaacgaccgctgcaccctggtcacgaactgcgtgatcaagggccgggaggtgcgcaaggggcagagcgtcctgcggcagtacaagaccgagatcaagatcggcaaggcctccaccggcttccgcaagctcctgagcgaggagccgggggacgactgcatctcccggacccagctgctccgcacggagaccgccgagatccacgacgacaactacggcgggcccggcgacaagatcaccatctgcaacgggagcaccatcgtggaccagcgcctgggctccgagctgggctgctacacgatcaaccgggtgaagagcttcaagctctgcgagaactccgcgaccgggaagacctgcgaggtcgacagcacccccgtgaagtgccgccagggcttctgcctgaagatcacgcaggaggggcggggccacgtgaagctgtcccgcgggagcgaggtcgtgctggacgcctgcgactccagctgcgaggtcatgatccccaagggcaccggcgacatcctcgtggactgctccgggggccagcagcacttcctgaaggacaacctgatcgacctcgggtgcccgcacatccccctgctgggcaagatggccatctacatctgccggatgagcaaccacccccgcaccaccatggccttcctcttctggttctccttcggctacgtgatcacctgcatcagctgcaaggccctgttctactccctgatcatcatcgggacgctcggcaagaagatcaagcagtaccgggagctgaagccccagacctgcaccatctgcgagaccgcgccggtcaacgccatcgacgccgagatgcacgacctgaactgcagctacaacatctgcccctactgcgcctcccgcctcacgagcgacgggctggcgcggcacgtgacccagtgccccaagcgcaaggagaaggtggaggagaccgagctgtacctcaacctggagcggatcccctggatcgtccgcaagctgctccaggtgagcgagtccaccggcgtggccctgaagcggagctcctggctgatcgtcctcctggtgctgctcacggtgagcctgtccccggtccagagcgcccccgtggggcacggcaagaccatcgagatctaccagacccgcgagggcttcgcctccatctgcctgttcatgctcgggagcatcctgttcatcgtgtcctgcctggtcaagggcctcgtggacagcgtgtccgacagcttcttccccgggctgtccgtctgcaagacctgcagcatcggctccgtgaacgggttcgagatcgagagccacaagtgctactgctccctgttctgctgcccgtactgccggcactgcagcgccgaccgcgagatccaccagctccacctgtccatctgcaagaagcggaagacgggcagcaacgtgatgctggcggtctgcaagcgcatgtgcttccgggccaccatcgaggccagccgccgcgccctcctgatccggtccatcatcaacaccaccttcgtgatctgcatcctgacgctcaccatctgcgtggtcagcacctccgccgtggagatggagaacctgcccgcgggcacctgggagcgcgaggaggacctgacgaacttctgccaccaggagtgccaggtgaccgagaccgagtgcctctgcccctacgaggccctggtcctgcggaagcccctcttcctggacagcatcgtgaaggggatgaagaacctgctcaactccaccagcctggagacgtccctgagcatcgaggccccgtggggcgccatcaacgtgcagtccaccttcaagcccgccgtcagcaccgcgaacatcgccctctcctggagctccgtggagcaccgcgggaacaagatcctggtgaccggccggagcgagtccatcatgaagctggaggagcgcacgggggtcagctgggacctcggcgtggaggacgcctccgagagcaagctgctgaccgtgtccatcatggacctcagccagatgtacagccccgtcttcgagtacctgtccggcgaccggcaggtggaggagtggcccaaggccacctgcaccggggactgcccggagcgctgcggctgcacgagctccacctgcctgcacaaggagtggccccacagccggaactggcgctgcaaccccacctggtgctggggggtgggcaccgggtgcacgtgctgcggcgtcgacgtgaaggacctcttcaccgaccacatgttcgtgaagtggaaggtcgagtacatcaagaccgaggcgatcgtgtgcgtggagctgacctcccaggagcggcagtgcagcctgatcgaggccggcacccgcttcaacctcgggcccgtcacgatcaccctgtccgagccgcggaacatccagcagaagctgccccccgagatcatcaccctccaccccaagatcgaggagggcttcttcgacctgatgcacgtgcagaaggtgctgagcgcctccaccgtctgcaagctccagagctgcacgcacgggatcccgggcgacctgcaggtgtaccacatcggcaacctgctcaagggggaccgcgtgaacggccacctgatccacaagatcgagtcccacttcaacaccagctggatgtcctgggacgggtgcgacctggactactactgcaacatgggcgactggcccagctgcacctacaccggggtcacgcagcacaaccacgccgccttcgtgaacctcctgaacatcgagaccgactacaccaagaccttccacttccactccaagcgggtcacggcgcacggcgacaccccccagctggacctcaaggcccgccccacctacggcgccggggagatcaccgtgctggtggaggtcgccgacatggagctgcacacgaagaaggtggagatcagcggcctcaagttcgcctccctggcgtgcaccgggtgctacgcctgcagctccggcatcagctgcaaggtgcggatccacgtcgacgagccggacgagctgaccgtgcacgtgaagagctccgaccccgacgtcgtggccgccagcacctccctcatggcccgcaagctggagttcgggacggacagcaccttcaaggcgttctccgccatgcccaagaccagcctgtgcttctacatcgtggagcgggagtactgcaagtcctgcagcgaggacgacacccagaagtgcgtcgacacgcgcctcgagcagccccagtccatcctgatcgagcacaagggcaccatcatcggcaagcagaacgacacctgcaccgccaaggccagctgctggctggagtccgtgaagagcttcttctacgggctcaagaacatgctgggctccgtgttcgggaacctgttcatcggcatcctcctgttcctggcgccgttcgtcctgctcgtgctgttcttcatgttcgggtggaagatcctgttctgcttcaagtgctgccggcgcacgcgcggcctcttcaagtaccggcacctgaaggacgacgaggagaccggctaccgccggatcatcgagcgcctgaacagcaagaaggggaagaaccggctcctggacggcgaccgcctggccgaccggaagatcgccgagctcttctccaccaagacccacatcgggtga

SEQ ID NO: 12043 - RNA, 5052 nt, synthetic construct
  misc_feature 1..5052: note = derived and/or modified CDS sequence (opt1) from CCHFV(5170-R-2011)__KR814873.1__GP
  source 1..5052: mol_type = other RNA
atgcacaccctgctcgtgtgcttcatcctgtacctgcagctcagcggcctggggggcgcccacgggcagtccaacgagaccgagcacaacggcacgaacaccaccaccgtccccgggacgagccagtccccgaagccccccgccagcaccaccctgcagcacacccccgagtccagcacggtgaagctcaccaccccgacctccgagacggagggcagcggcgagaccacccccccccccaacaccacgcaggggctgccgccccccggcaccacccccgagcgctccgcgaccacggccaccagcacctccagcaccgacaacatgaactccacgacccaggtgaccgacaacaccccgacgagcaccgtctccatcagcccctccagctcccccagcatgcccagcacctcccaggggatccactacccgatccggagcctgctctccgtgagctcccccaagaccgtgacgacccccacccccatcagcccgggcgagatgtcccccgagaccagctcccagcacagcgccatgtcccgcatccccacgctgtacaccgccacccaggtcagcaccgagaacaccaaccggtccacgccccgccagagcgagtccagcgtgcagccggccacccagtcccccatcaccagccccgcgcagaccatcctgctcatgtccgccgcccccaaggccatccaggacatgcacccgagccccacgaaccggagcaagcgcaacctggaggtggagatcatcctgaccctctcccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagccccaccgagctgtcccacgtgcggctgccgacggcggagcccttcaagagctacttcgccaagggcttcctctccatcgacagcggctacttctccgccaagtgctacccccgcagctccaccagcgggctgcagctgatcaacgtgacccagcaccccgcccggatcgccgagaccccgggccccaagacgacctccctcaagaccatcaactgcatcaacctgcgcgcgagcgtcttcaaggagcaccgggaggtggagatcaacgtgctgctcccccagatcgccgtcaacctgtccaactgccacgtggtgatcaacagccacgtctgcgactactccctggacaccgacgggcccgtgcgcctcccgcggatccaccacgagggcacgttcatccccgggacctacaagatcgtgatcgacaagaagaacaagctgaacgaccgctgcagcctggtcaccaactgcgtgatcaagggccgggaggtgcgcaagggccagagcgtcctccggcagtacaagaccgagatcaagatcgggaaggcctccacgggcagccgcaagctgctgtccgaggagcccggggacgactgcatcagccggacccagctcctgaagaccgagaccgccgagatccacgacgacaactacggcgggcccggcgacaagatcacgatctgcaacggctccaccatcgtggaccagcgcctggggagcgagctcggctgctacaccatcaaccgcgtcaagtccttcaagctgtgcgagaacagcgccaccgggaagacgtgcgagatcgactccaccccggtgaagtgccggcagggcttctgcctgaagatcacccaggaggggcgcggccacgtgaagctgagccggggctccgaggtcgtgctcgacgtgtgcgacagctcctgcgagatcatgatccccaaggggaccggcgacatcctggtcgactgcagcgggggccagcagcacttcctgaaggacaacctcatcgacctgggctgcccccacatccccctgctcgggaagatggcgatctacatctgccgcatgtccaaccacccgcggacgaccatggccttcctgttctggttcagcttcggctacgtgatcacctgcatcttctgcaaggccctgttctactccctcatcatcatcgggaccctgggcaagaagatcaagcagtaccgcgagctgaagccccagacctgcacgatctgcgagaccgcccccgtgaacgccatcgacgcggagatgcacgacctcaactgcagctacaacatctgcccctactgcgcctcccggctgaccagcgaggggctggcccgccacgtcacccagtgcccgaagcggaaggagaaggtggaggagacggagctctacctgaacctggagcgcatcccctggatcgtgcggaagctcctgcaggtcagcgagtccaccggcgtggccctgaagcgcagctcctggctcatcgtgctgctggtcctcctgaccgtgagcctgtcccccgtgcagagcgcccccgtcggccacgggaagaccatcgagacgtaccagacccgggagggcttcacctccatctgcctcttcatgctggggagcatcctgttcatcgtgtcctgcctcgtgaagggcctggtcgacagcgtgtccgacagcttcttcccggggctgtccgtgtgcaagacctgcagcatcggctccatcaacggcttcgagatcgagagccacaagtgctactgctccctcttctgctgcccctactgccgccactgcagcgcggaccgggagatccaccagctgcacctgtccatctgcaagaagcgcaagacggggagcaacgtcatgctcgccgtgtgcaagcggatgtgcttcaaggccaccatcgaggccagccgccgggcgctgctgatccgctccatcatcaacaccaccttcgtgatctgcatcctcacgctggccatctgcgtcgtgagcacctccgccgtggagatggaggacctgcccgccggcacctgggagcgcgaggaggacctcaccaacttctgccaccaggagtgccaggtcacggagaccgagtgcctgtgcccgtacgaggccctggtgctccggaagcccctgttcctggacagcatcgtgaaggggatgaagaacctcctgaactccaccagcctggagacctccctcagcatcgaggcgccctggggcgccatcaacgtccagtccacgttcaagcccaccgtgagcaccgccaacatcgccctgtcctggagctccgtggagcaccgcgggaacaagatcctggtcaccggccggagcgagtccatcatgaagctcgaggagcgcacgggcgtgagctgggacctgggggtggaggacgcctccgagagcaagctgctcaccgtctccatcatggacctgagccagatgtacagcccggtgttcgagtacctgtccggcgaccggcaggtggaggagtggcccaaggcgacctgcaccggggactgccccgagcgctgcggctgcacgagctccacctgcctccacaaggagtggccccacagccggaactggcgctgcaacccgacctggtgctggggggtcggcaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggccggcacccgcttcaacctggggcccgtcacgatcaccctgtccgagccccggaacatccagcagaagctccccccggagatcatcaccctgcaccccaagatcgaggagggcttcttcgacctgatgcacgtgcagaaggtgctcagcgcctccaccgtctgcaagctgcagagctgcacgcacggcatccccggggacctgcagatctaccacatcggcaacctcctgaagggggaccgcgtgaacggccacctgatccacaagatcgagccccacttcaacacctcctggatgagctgggacgggtgcgacctcgactactactgcaacatgggcgactggccgtcctgcacctacaccggcgtcacgcagcacaaccacgccgcgttcgtgaacctgctgaacatcgagaccgactacaccaagaccttccacttccacagcaagcgggtgacggcccacggggacaccccccagctcgacctgaaggcccgccccacctacggcgccggggagatcaccgtcctggtggaggtggcggacatggagctccacacgaagaaggtcgagatctccggcctgaagttcgccagcctgacctgcaccgggtgctacgcctgctccagcggcatctcctgcaaggtgcggatccacgtggacgagcccgacgagctcaccgtccacgtgaagagcagcgacccggacgtggtcgccgcctccacgagcctgatggcgcgcaagctggagttcggcaccgactccaccttcaaggccttcagcgccatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacgggctgaagaacatgctgggcagcgtgttcgggtccttcttcgtgggcatcctcctgttcctggcgcccttcgtcctgctcgtgctgttcttcatgttcggctggaagatcctgttctgcttcaagtgctgccgccggacccgcgggctcttcaagtaccggcacctgaaggacgacgaggagaccggctaccgccgcatcatcgagcggctgaacagcaagaaggggaagaaccgcctcctggacggcgagcggctggccgaccgcaagatcgccgagctcttctccaccaagacgcacatcggctga

SEQ ID NO: 12044 - RNA, 5055 nt, synthetic construct
  misc_feature 1..5055: note = derived and/or modified CDS sequence (opt1) from CCHFV(SCT ex Afghanistan)__KC344856.1__GP
  source 1..5055: mol_type = other RNA
atgtacaccctgctcgtgtgcgccatcctgtgcccccagccgtggagcctggagggcacccacgtccccctcaacgggacgaagcacaacggcaccgggatcaccgccgcgcccggcgggtcccagggccccaccagcccggcctccacggccgtgagcctgacccccgaccccttcaccaccgagcccacggcctccgccgtggagctggagagctccggcgaggggcacaccagcctctccgtcaccacccagggcctgacgagcccggagaccacccccgggctgcccaccgtgacggacaccggcgtgtccagcacctccatcttcgggatcggcatccgcgtcgcgggcgacacccccacgagcaccacccacaccgggctcccgtccagcccctccatgcccagcacggcccagggcccccaccacgccgtgcgggggctgctgtccgtgagcagcacccgcccgggcgaggcctccaccatcaccgtccccggcgaggcggggacggaggccaacagctccagctccgccatcagcaagaagcccgccccctccccgaccgccgaggcgatcaccgaggccaacaacagctccaacccccggcagcccgagctcagcacccagcccgccatcccgggcctggtgacgtccagcgcccagcccatcctgctccagtccgccaccagcaccgcggcccaggacatctacccctcccccaccaaccgcagcaagcggaacctggagatggagatcatcctgacgctctcccaggggctgaagaagtactacggcaagatcctgcgcatcctcgacctgaccctggaggaggacaccgaggggctcctggagtggtgcaagcggaacctgggcctgacctgcaacgacaacttcttccaggagcgcatcgaggagttcttcctgaccggcgaggggcacttcaacgaggtgctgcagttcaagacgccgagcaccctctcccccaccgagcccacccacacgcggaccccgaccgtcaagcccttcaagagctacttcgcccgcggcttcctgagcatcgactccgggtacttcagcgccaagtgctactccaagaccagcaactccggcctgcagctcatcaacatcacgcagcaccccgcccggatcgcggacacccccgggccgaagatcaccaacctgaaggccatcaactgcatcaacctgaaggccagcgtgttcaaggagcaccgcgagatcgagatcaacgtgctcctgccccaggtcgccgtgaacctgtccaactgccacgtgctcatcaagagccacgtctgcgactactccctggacatcgacggcgccgtgcggctgccccacgtgcaccacaagggcaccttcatccccgggacgtacaagatcgtcatcgacaagcgcaacaagcagaacgaccggtgcaccctcgtgaccaactgcgtgatcaagggcaaggagatccgcaaggggcagagcgcgctgcggcagtaccgcaccgagatccggatcggcaaggcctccgccgggagccgccggctgctctccgaggagagcggcgacgactgcatctcccgcacgcagctgctgcgcaccgagaccgccgaggtccacaacgacaactacggcgggccgggcgacaagatcaccatctgcaacgggagcacgatcgtggaccagcggctcggctccgagctgggctgctacaccatcaaccgcgtcaagagcttcaagctgtgcgagaacagcgcgaccgggaagtcctgcaagatcgacagcacccccgtgaagtgccggcagggcttctgcctgaagatcacgcaggaggggcgcggccacgtgaagctctcccgggggagcgaggtcgtgctggacgcctgcgactccagctgcgagatcatgatccccaagggcaccggcgacatcctggtggactgctccgggggccagcagcacttcctcaaggacaacctgatcgacctggggtgccccaacatcccgctcctgggcaagatggccatctacatctgccgcatgagcaaccaccccaagaccaccatggccttcctgttctggttctccttcgggtacgtcatcacgtgcatcttctgcaaggtgatcttctacctcctgatcgtggtcggcaccctgggcaagaagttcaagcagtaccgggagctcaagccccagacctgcaccatctgcgagacgacccccaccaacgccatcgacgcggagatgcacgacctgaactgcagctacaacatctgcccgtactgcgcctcccgcctgaccagcgacgggctcgcccggcacgtgacgcagtgccccaagcgcaaggagaaggtggaggagaccgagctgtacctgaacctcgagcggatcccctggatcgtccgcaagctgctccaggtgtccgagagcaccggcgtggccctcaagcggtccagctggctgatcgtcctgctcgtgctgctgaccgtgtccctcagccccgtccagtccgccccgatcgggcacggcaagaccatcgagacgtaccagacccgcgaggggtacatcagcgtgtgcctgttcgtgctgggcggcatcctcttcgtcgtgagctgcctgatcaaggggctggtggactccgtcggcaacagcttcttccccgggctctccatctgcaagacctgcagcatcggctccgtgaacgggttcgagatcgagagccacaagtgctactgctccctgctgtgctgcccctactgccggcactgcagcaccgaccgcgagatccaccagctccacctgtccatctgcaagaagcggcgcacgggcggcaacgtgatgctggcggtctgcaagcggatgtgcttccgcgccaccatggaggtgagcaacaaggtcctcttcatccgcaacatcatcaacaccaccttcgtgatctgcatcctgatcctggccgtgtgcgtggtctccacgagcgccgtggagatggagtccctccccgccgggacctgggagcgggaggaggacctgaccaacttctgccaccaggagtgccaggtgaccgagacggagtgcctgtgcccgtacgaggcgctcgtcctgcgcaagcccctgttcctcaacagcatcgtgaagggcatgaagaacctgctgaactccaccaacctcgagaccagcctgtccatcgaggccccctggggcgccatcaacgtgcagagcaccttcaagccgacggtctccaccgccaacatcgcgctgagctggagctccgtggagcaccgggggaacaagatcctcgtgagcggccgctccgagagcatcatgaagctggaggagcggaccgggatctcctgggacctgggcgtcgaggacgccagcgagtccaagagcctcaccgtgtccgtgatggacctgagccagatgtactcccccgtcttcgagtacctgagcggggaccgccaggtggaggagtggcccaaggccacgtgcaccggcgactgccccgagcggtgcgggtgcacctccagcacgtgcctccacaaggagtggccgcactcccgcaactggcggtgcaaccccacctggtgctggggcgtgggcaccgggtgcacgtgctgcggcctggacgtcaaggacctgttcaccgactacatgttcgtgaagtggaaggtggagtacatcaagaccgaggccatcgtctgcgtggagctcaccagccaggagcgccagtgctccctgatcgaggccgggacccggttcaacctgggccccgtcaccatcacgctcagcgagccccgcaacatccagcagaagctgccgcccgagatcatcaccctgcacccccggatcgaggaggggttcttcgacctcatgcacgtgcagaaggtgctgtccgcgagcaccgtctgcaagctgcagagctgcacccacggcgtgcccggcgacctccaggtgtaccacatcgggaacctgctgaagggcgacaagctcaacgggcacatgatccacaagatcgagccgcacttcaacacgtcctggatgagctgggacggctgcgacctggactactactgcaacatgggggactggccctcctgcacctacaccggcgtcacccagcacaaccacgccgccttcgtgaacctgctcaacatcgagaccgactacacgaagaacttccacttccacagcaagcgcgtgaccgcccacggcgacacgccccagctggacctgaaggcccggcccacctacggggcgggcgagatcaccgtcctcgtggaggtggccgacatggagctgcacaccaagaagatcgacatctccgggctgaagttcgccagcctgacctgcgccggctgctacgcctgctccagcggcatctcctgcaaggtccgcatccacgtggacgagccggacgagctcaccgtgcacgtcaagagcgaggaccccgacatcgtggcggcctccacgagcctgatcgcccggaagctcgagctggggaccgactccaccttcaaggccttcagcgcgatgcccaagacctccctgtgcttctacatcgtggagcgcgagtactgcaagagctgctccaaggaggacacgcagaagtgcgtcaacaccaagctcgagcacccccagggcatcctgatcgagcacaaggggaccatcatcggcaagcagaacgacacgtgcaccgccaaggccgggtgctggctggagagcgtgaagtccttcttctacggcctcaagaacatgctgagcggcatcttcgggaacgtgttcatcggcatcttcctgttcctggccccgttcgtcctcctgatcctgttcttcatgttcgggtggcggctcctgttctgcttcaagtgctgccgccggacccgcggcctgttcaagtaccgccacctcaaggaggacgaggagagcgggtaccggcgcatcatcgagcggctgaacaacaagaagggcaagaacaagctgctcgacggcgagcgcctggccgaccggcgcatcgcggagctgttctccaccaagacccacatcgggtga

SEQ ID NO: 12045 - RNA, 5055 nt, synthetic construct
  misc_feature 1..5055: note = derived and/or modified CDS sequence (opt1) from CCHFV(SPU 44/08)__KJ682805.1__GP
  source 1..5055: mol_type = other RNA
atgtacacgcccctgctctgcgccatcctgtgcctgcagctctggagcctggagggcatctacgggctgtccaacaacacccagcacaacgacaccagcaccatcaaggtgccggaggagtcccagaagaccagcctccccgccaacaccgcgtcccccatcacgagcgacccgccgcccaccacccccaccgcctccgccagcggccccgaggggtccggcgacacgagcacctccccgcccgtcaccacccaggggcccacgcccccggagaccacccccgagccccacaccacgatcgacatcgacaagagctccaccgccatcgccgacatcagcacccagaccgtgaagaacatccccacgccgaccgcgcacacctccctgcccagcaccctgtccgcccccacgatgccccaggaggcccaccacaccgcccgcggcctcctgagcgtgacctccaccaagccgggcgaggcgagcacgcccaccagccccggggaggcctccaccgaggccagcagcccccagccgaccatccgggagacgccctccccgccgcccaccacccagacccccacggagatcaacaaccccaacacctcccgccagcccatgcccagcacccagcccgccgccccctccagcgtcacccaccccgcgcagcccaccccctcccagagcgacgtgcccacggccgcccaggacatccacccgtcccccaccaaccggagcaagcgcaacctggagatggagatcatcctcaccctgtcccagggcctgaagaagtactacgggaaggtgctcaagctgctggacctcaccctggaggaggacacggagggcctgctcgagtggtgcaagcggaacctggggctgacctgcgacgacaacttcttccagaagcgcatcgaggagttcttcctcaccggcgagggccacttcaacgaggtcctgcagttcaagacccccagcacgctgtcccccaccgagccggcccgggtggagagccccaccgtggagcccttcaagtcctacttcgccaaggggttcctcctgatggacagcggctacttctccgcgaagtgctaccccaagagcagcaactccgggctgcagctcatcaacgtcacccagcacctgatccgcatcacggacaccccgggccccaagatcaccaacctgaagaccatcaactgcatcaacctcaaggccctggtgttcaaggagcaccgggagatcgagatcaacgtgctgctcccccaggtcgccgtgaacctgagcaactgccacgtgctgatcaagtcccacgtctgcgactacagcatcgacatcgacggccccgtgcgcctcccgcggatccaccacgaggggacgttcatccccggcacctacaagatcgtgatcgacaagaagaacaagcagaacgaccgctgcaccctggtcaccaactgcgtgatcaaggggcgggagatccgcaagggccagtccgtgctgcggcagtaccgcacggagatcaagatcgggaaggccagctccggcagccggcgcctcctgtccgaggagagcaacgacgactgcctgtcccggacccagctcctgcgcaccgagaacgccgagatccacagcgacaactacggcgggcccggcgacaagatcaccatctgcaacgggtccacgatcgtcgaccagcggctgggcagcgagctcgggtgctacaccatcaaccgcgtgaagtccttcaagctgtgcgagaacagcgcgaccggcaagtcctgcgagatcgacagcacccccgtgcgctgccggcagggcttctgcctgaagatcacgcaggaggggcgcggccacgtcaagctgagccgggggtccgaggtggtcctcgacgcctgcgacagctcctgcgagatcatgatcccgaagggcaccggggacatcctggtggactgcagcggcggccagcagcacttcctgaaggacaacctcgtggacctggggtgccccaacatccccctgctcggcaagatggccatctacatctgccgcatgtccaaccacccgaagaccaccatggccttcctgttctggttcagcttcgggtacgtcatcacgtgcatcctgtgcaaggccatcttctacctcctgatcgtggtgggcaccctgggcaagaagttcaagcagtaccgggagctcaagccccagacctgcaccatctgcgagacgaaccccgtcaacgcgatcgacgccgagatgcacgacctgaactgctcctacaacatctgcccctactgcgccagccgcctgacctccgacgggctcgcccggcacgtgatgcagtgcccgaagcgcaaggagaagatcgaggagaccgagctgtacctgaacctcgagcggatcccctgggtggtccgcaagctgctccaggtgagcgagtccaccggcgtggcgctcaagcggagctcctggctggtcatcctgctcgtgctgctgaccgtgagcctctcccccgtccagagcgcccccatctcccacggggagacggtggaggtgtaccagacccgcgagggctacaccagcatctgcctgttcgtcctggggtccatcctcttcctggtgagctgcctgatgcggggcctcgtggacagcgtctccaacagcttcttcccgggcctgtccatctgcaagacctgcagcatcgggtccatcaacggcttcgagatcgagagccacaagtgctactgctccctgttctgctgcccctactgccgccactgcagcgccgacatcgagatccacaagctccacctgtccatctgcaagaagcggaagacggggagcaacgtgatgctggccgtgtgcaagcgcatgtgcttccgggccaccgtcgaggtgtccaacaaggcgctcctgatccgcaacatcatcaacaccaccttcgtggtctgcatcctgatcctcgccgtgtgcgtggtcagcacgtccgccgtggagatggagaacctgcccgccggcacctgggagaaggaggaggacctgaccaacttctgccaccaggagtgccaggtgaccgagacggagtgcctctgcccctacgaggccctggtcctgcggaagcccctcttcctggacagcatcgtgaaggggatgaagaacctgctcaactccaccagcctggagacctccctgagcatcgaggcgccgtggggcgccatcaacgtgcagtccaccttcaagcccacggtcagcgccgccaacatcgccctcagctggtccagcgtggagcaccgcggcaacaagatcctggtgtccgggcgcagcgagtccatcatgaagctggaggagcggaccggcatcagctgggacctcggggtcgaggacgcgtccgagagcaagctgctgaccgtgtccgtgatggacctcagccagatgtactcccccgtcttcgagtacctgagcggcgaccgccaggtggaggagtggccgaaggcgacctgcacgggggactgccccgagcggtgcggctgcacctcctccacgtgcctgcacaaggagtggccccacagccgcaactggcggtgcaaccccacctggtgctggggcgtggggaccggctgcacgtgctgcgggctcgacgtcaaggacctgttcaccgactacatgttcgtgaagtggaaggtggactacatcaagaccgaggccatcgtctgcgtggagctgaccagccaggagcgccagtgctccctcatcgaggccggcacccggttcaacctggggccggtgaccatcaccctgagcgagccccgcaacatccagcagaagctcccgcccgagatcgtcacgctgcacccccggatcgaggagggcttcttcgacctgatgcacatccagaaggtgctctccgccagcaccgtctgcaagctgcagagctgcacccacggcgtgcccggggacctgcagatctaccacatcggcaacctcctgaagggggacaaggtgaacggccacctgatccacaagatcgagccccacttcaacacctcctggatgagctgggacggctgcgacctcgactactactgcaacatgggggactggccctcctgcagctacacgggcgtcacccagcacaaccacgccgccttcgtgaacatgctgaacatcgagaccgactacaccaagaacttccacttccactccaagcgcgtgaccgcccacggggacacgccgcagctggacctcaaggcccggcccacctacggcgcgggggagatcaccgtcctggtggaggtggccgacatggagctgcacaccaagaagatcgagatcagcggcctcaagttcgcctccctgacgtgcaccggctgctacgcctgcagctccgggatcagctgcaaggtccgcatccacgtggacgagcccgacgagctgaccgtgcacgtcaagtccgaggacccggacatcgtggccgcgagctccagcctcatggcccggaagctggagttcggcaccgactccacgttcaaggccttcagcgccatgcccaagacctccctgtgcttctacatcgtggagcgcgagtactgcaagagctgctccaaggaggacacccagaagtgcgtcaacaccaagctcgagcagccccagagcatcctgatcgagcacaaggggacgatcatcggcaagcagaacgacacgtgcaccgccaaggcgagctgctggctggagtccatcaagagcttcttctacgggctcaagaacatgctgtccggcatcttcggcaacgtgttcatcgggatcttcctgttcctggcccccttcatcatgctcatcctgttcttcatgttcggctggcggatcctgttctgcttcaagtgctgccgccggacccgcggcctcttcaagtaccggcacctgaaggacgacgaggagatcgggtaccgcaagatcatcgagcggctgaacaacaagaaggggaagaacaagctcctggacggcgagcgcctggccgaccgcaagatcgccgagctgttcagcaccaagacccacatcggctga

SEQ ID NO: 12046 - RNA, 5052 nt, synthetic construct
  misc_feature 1..5052: note = derived and/or modified CDS sequence (opt1) from CCHFV(K323_27)__KX013472.1__GP
  source 1..5052: mol_type = other RNA
atgcacaccctgctcgtgtgcttcatcctgtacctgcagctcagcggcctcgggggcgcccacgggcagtccaacgccaccgagcacaacggcacgaacaccaccaccgtccccgggacgagccagtccccgaagccgcccgcgagcaccaccctgccccacacccccgagtccagcacggtgaagctcaccacccccacctccgagacggagggcagcggcgagaccaccccgccgcccaacaccacgcaggggctgcccctgcccggcaccacccccgagcgctccgccaccacggccaccagcacctccagcaccgacaacatgaactccacgacccaggtgaccgacaacacccccacgagcaccgtctccatcagcccctccagctcccccagcatgcccagcacctcccaggggatccaccacccggtgcggagcctcctgtccgtgagctcccccaagaccgtcacgacccccacccccatgagcccgggcgagatgtcccccgagaccagctcccagcacagcgccatgtcccgcatccccacgctgtacaccgccacccaggtgagcaccgagaacaccgaccggtccacgccccgccagagcgagtccagcgtgcagccggcgacccagtcccccatcaccagccccgcccagaccatcctcctgatgtccgccgcccccaaggcgatccaggacatgcacccgagccccacgaaccggagcaagcgcaacctggaggtcgagatcatcctcaccctgtcccaggggctgaagaagtactacggcaagatcctcaagctgctgcacctcaccctggaggaggacaccgagggcctgctcgagtggtgcaagcggaacctggggagcaactgcgacgacgacttcttccagaagcgcatcgaggagttcttcatcacgggcgaggggtacttcaacgaggtgctgcagttcaagaccctctccaccctgagccccaccgagtccagccacgtgcggctgccgacggccgagcccttcaagtcctacttcgccaagggcttcctcagcatcgactccggctacttcagcgccaagtgctacccccgctccagcacctccgggctgcagctgatcaacgtcacccagcaccccgcccggatcgcggagaccccgggccccaagacgaccagcctcaagaccatcaactgcatcaacctgcgcgcctccgtgttcaaggagcaccgggaggtggagatcaacgtcctgctcccccagatcgccgtgaacctgagcaactgccacgtggtcatctccagccacgtgtgcgactacagcctggacaccgacgggcccgtgcgcctcccgcggatccaccacgagggcacgttcatccccgggacctacaagatcgtcatcgaccgcaaggacaagctgaacgaccggtgctccctggtgaccaactgcgtgatcaagggccgcgaggtccggaagggccagagcgtgctccgccagtacaagaccgagatcaagatcgggaaggcctccacgggcagccggaagctgctgtccgaggagcccggggacgactgcatcagccgcacccagctcctgaagaccgagaccgccgagatccacgacgacaactacggcgggcccggcgacaagatcacgatctgcaacggctccaccatcgtcgaccagcgcctggggagcgagctcggctgctacaccatcaaccgggtgaagtccttcaagctgtgcgagaacagcgcgaccgggaagacgtgcgagatcgactccaccccggtgaagtgccgccagggcttctgcctgaagatcacccaggaggggcggggccacgtcaagctgagccgcggctccgaggtggtgctcgacgcctgcgacagctcctgcgagatcatgatccccaaggggaccggcgacatcctggtcgactgcagcgggggccagcagcacttcctgaaggacaacctcatcgacctgggctgcccccacatccccctgctcgggaagatggccatctacatctgccggatgtccaaccacccgcgcacgaccatggccttcctgttctggttcagcttcggctacgtgatcacgtgcatcttctgcaaggccctgttctacctcctgatcatcatcgggaccctgggcaagaagatcaagcagtaccgggagctcaagccccagacctgcaccatctgcgagaccgcgcccgtgaacgccatcgacgccgagatgcacgacctgaactgctcctacaacatctgcccctactgcgccagccgcctgaccagcgacgggctcgcccggcacgtcacccagtgcccgaagcgcaaggagaaggtggaggagacggagctgtacctgaacctcgagcggatcccctggatcgtgcgcaagctgctgcaggtctccgagagcaccggcgtggcgctcaagcggtccagctggctgaccgtgctgctcgtcctgctgaccgtgtccctcagccccgtgcagtccgcccccgtcggccacgggaacacgatcgagacctaccagacccgcgagggcttcaccagcatctgcctgttcatgctggggtccatcctcttcatcgtgagctgcctggtgaagggcctggtcgactccgtgagcgactccttcttcccggggctcagcgtgtgcaagacgtgctccatcggcagcatcaacggcttcgagatcgagtcccacaagtgctactgcagcctgttctgctgcccccactgccggcaccgctccgccgaccgggagatccaccagctgcacctcagcatctgcaagaagcgcaagaccgggagcaacgtcatgctggccgtgtgcaagcggatgtgccccaaggcgaccatcgaggcctcccgccgcgccctgccgatccggagcatcatcaacaccacgctcgtgatgtgcatcctgaccctggccatctgcgtcgtgtccaccagcgccgtggagatggaggacctccccgcgggcacctgggagcgcgaggaggacctgacgaacttctgccaccaggagtgccaggtcaccgagaccgagtgcctgtgcccctacgaggccctcgtgctgcggaagcccctgttcctcgactccatcgccaaggggatgaagaacctgctgaacagcacctccctcgagacgagcctgtccatcgaggccccgtggggcgccatcaacgtgcagagcaccttcaagcccaccgtctccaccgcgaacatcgccctgagctggtccagcgtggagcaccgcgggaacaagatcctcgtgacgggccggtccgagagcatcatgaagctggaggagcgcaccggcgtctcctgggacctgggggtggaggacgccagcgagtccaagctcctgaccgtgagcatcatggacctgagccagatgtactcccccgtcttcgagtacctcagcggcgaccgccaggtggaggagtggcccaaggcgacctgcacgggggactgcccggagcggtgcggctgcacctccagcacgtgcctgcacaaggagtggccccactcccggaactggcgctgcaaccccacctggtgctggggcgtggggaccggctgcacgtgctgcggggtcgacgtgaaggacctgttcaccgaccacatgttcatcaagtggaaggtggagtacatcaagaccgaggccatcgtctgcgtggagctcaccggccaggagcggcagtgcagcctgatcgaggccgggacccgcttcaacctgggccccgtgaccatcaccctctccgagccgcggaacatccagcagaagctgccgcccgagatcatcaccctgcaccccaagatcgaggagggcttcttcgacctcatgcacgtccagaaggtgctgagcgcctccacggtgtgcaagctgcagagctgcacccacgggatccccggcgacctccagatctaccacatcgggaacctgctgaagggcgaccgcgtcaacgggcacctcatccacaagatcgagccccacttcaacacctcctggatgagctgggacggctgcgacctggactactactgcaacatgggcgactggccctcctgcacctacacgggggtgacccagcacaaccacgccgccttcgtcaacctgctcaacatcgagaccgactacaccaagacgttccacttccacagcaagcgggtgaccgcgcacggcgacacgccccagctggacctgaaggcccgcccgacctacggggccggcgagatcaccgtgctcgtcgaggtggccgacatggagctgcacaccaagaaggtggagatctccgggctgaagttcgccagcctgacctgcaccggctgctacgcgtgctccagcggcatctcctgcaaggtccggatccacgtggacgagcccgacgagctgacggtgcacgtcaagagcagcgaccccgacgtggtggccgcctccaccagcctgatggcccgcaagctcgagttcgggaccgactccaccttcaaggccttcagcgcgatgcccaagacgtccctgtgcttctacatcgtcgagcgggagtactgcaagagctgctccgaggacgacaccaagaagtgcgtggacaccaagctggagcagccgcagagcatcctcatcgagcacaagggcaccatcatcgggaagcagaacgacacgtgcaccgccaaggcctcctgctggctggagagcgtgaagtccttcttctacggcctgaagaacatgctcgggagcgtcttcggctccttcttcgtgggcatcctgctgttcctggcccccttcgtgctcctggtcctgttcttcatgttcgggtggaagatcctcttctgcttcaagtgctgccgccggacccgcggcctgttcaagtaccgccacctgaacgacgacgaggagaccgggtaccggcgcatcatcgagcggctcaacagcaagaagggcaagaaccgcctgctggacggcgagcggctcgccgaccgcaagatcgcggagctgttctccacgaagacccacatcgggtga

SEQ ID NO: 12047 - RNA, 5052 nt, synthetic construct
  misc_feature 1..5052: note = derived and/or modified CDS sequence (opt1) from CCHFV(1231-CR/TI-2015)__KU161585.1__GP
  source 1..5052: mol_type = other RNA
atgcacaccctgctcgtgtgcttcatcctgtacctgcagctcctgggcctggggggcgcccacgagcagagcaacgccaccgaccacaaccgcacgaacaccatcaccgcgccctccaccagccagaacccgaagccccccgcctccacgacccccccgcacacccccgagagctccaccatcaagctcatcacgagcaccggggaggccgagggctccggggagaccaccccccccctgaacacgacccagggcccgttcccccccgagaccaccagcgagcaccccgcctccacggccaccaacaccagctccaccaacagcatgaactccacgacccagatgaccgacaagaccctgacgagcaccgtctccaccagcctctccatcagcccgtccacccccagcacgagccagggcatccactaccccatccggtccctgctgagcgtgtccagcccccgcaccgcggccaccccgacccccatgtccacgcgggagatgagctccgagaccaacagccagcactccgccgtgagccgcacccccaccttccacacggccacccaggtctccaccgagaacgacaaccggagcaccccccgccagtccgagagctccgcgcagccggccacccagagccccatgacgtcccccgcccagagcatcctcctggtgtccgccgcccccaccaccatccagaacatccacccgagccccaccaaccggagcaagcgcaacctggagatggagatcatcctcacgctgccccaggggctgaagaagtactacggcaagatcctcaagctgctgcacctcaccctggaggaggacaccgaggggctgctcgagtggtgcaagcggaacctgggctccaactgcgacgacgagttcttccagaagcgcatcgaggagttcttcatcaccggggagggctacttcaacgaggtgctgcagttcaagacgctcagcaccctgtcccccatggagccgagccacgcgcggccccccaccgccgagccgttcaagtcctacttcgccaagggcttcctgagcatcgactccgggtacttcagcgccaagtgctacccccgctccagctccagcggcctccagctgatcaacatcacccagcaccccgcccggatcgcggagacgcccgggccgaagaccacctccctgaagaccatcaactgcatcaacctccgcgccagcgtcttcaaggagcaccgggaggtggagatcaacgtgctgctgccccagatcgccgtcaacctctccaactgccacgtggtgatcaacagccacgtctgcgactactccctggacacggacggccccgtgcgcctgccccggatctaccacgagggcaccttcatcccggggacctacaagatcgtgatcgacaagaagaacaagctcaacgaccgctgcaccctggtcacgaactgcgtgaccaagggccgggaggtgcgcaaggggcagagcgtcctgcggcagtacaagaccgagatcaagatcggcaaggccagcaccgggtcccgcaagctcctgagcgaggagcccggcgacgactgcatctcccgcacgcagctgctccggaccgagaccgccgagatccacgacgacaactacggcgggcccggcgacaagatcaccatctgcaacgggagcacgatcgtggaccagcgcctgggctccgagctggggtgctacaccatcaaccgggtgaagagcttcaagctctgcgagaactccgcgaccggcaagacctgcgagatcgacagcacgcccgtcaagtgccgccagggcttctgcctgaagatcacccaggaggggcggggccacgtgaagctgtcccgcgggagcgaggtggtcctggacgcctgcgactccagctgcgaggtgatgatcccgaagggcaccggggacatcctcgtcgactgctccggcggccagcagcacttcctgaaggacaacctgatcgacctcgggtgcccccacatccccctgctgggcaagatggccatctacatctgccggatgagcaaccacccccgcaccacgatggccttcctcttctggttctccttcgggtacgtgatcacctgcatcttctgcaaggccctgttctacagcctgatcatcatcggcaccctcggcaagaagatcaagcagtaccgggagctgaagccgcagacctgcaccatctgcgagacggcgcccgtgaacgccatcgacgccgagatgcacgacctgaactgctcctacaacatctgcccctactgcgccagccgcctcacctccgacgggctggcgcggcacgtcacccagtgccccaagcgcaaggagaaggtggaggagaccgagctgtacctcaacctggagcggatcccgtggatcgtgcgcaagctgctccaggtcagcgagagcacgggcgtggccctgaagcggtccagctggctgatcgtgctcctggtcctgctcaccgtgtccctgagccccgtgcagtccgcccccgtcgggcacggcaagaccatcgagacctaccagacgcgcgaggggttcaccagcatctgcctgttcatgctcggctccatcctgttcatcgtgagctgcctggtgaagggcctcgtcgagtccgtgagcgactccttcttccccgggctgagcgtgtgccggacctgctccatcggcagcatcaacgggttcgagatcgagtcccacaagtgctactgcagcctgttctgctgcccgtactgccgccactgctccgccgaccgggagatccaccagctccacctgagcatctgcaagaagcgcaagaccggctccaacgtcatgctggccgtgtgcaagcgcatgtgcttccgggcgacgatggaggccagccgccgggccctcctgatccgcagcatcatcaacaccaccttcgtgatctgcatcctgaccctcacgatctgcgtcgtgtccaccagcgccgtggagatggagaacctgcccgccgggacctgggagcgggaggaggacctgaccaacttctgccaccaggagtgccaggtcacggagaccgagtgcctctgcccctacgaggcgctggtgctgcgcaagccgctcttcctggactccatcgtgaagggcatgaagaacctgctcaacagcacctccctggagaccagcctgtccatcgaggccccctggggcgccatcaacgtccagagcacgttcaagcccaccgtgtccaccgccaacatcgccctcagctggtccagcgtggagcaccgggggaacaagatcctggtcaccggccgctccgagagcatcatgaagctggaggagcggacgggggtgtcctgggacctcggcgtggaggacgcgagcgagtccaagctgctgaccgtcagcatcatggacctctcccagatgtacagccccgtgttcgagtacctgagcggggaccgccaggtggaggagtggccgaaggccacctgcaccggcgactgccccgagcggtgcggctgcacgtccagcacctgcctgcacaaggagtggccccactcccgcaactggcggtgcaaccccacctggtgctggggggtcggcaccgggtgcacgtgctgcggcgtggacgtgaaggacctcttcaccgaccacatgttcgtcaagtggaaggtggagtacatcaagaccgaggccatcgtgtgcgtcgagctgaccagccaggagcgccagtgctccctgatcgaggccgggacccggttcaacctcggcccggtgacgatcaccctgagcgagccccgcaacatccagcagaagctgccccccgagatcatcaccctccacccgaagatcgaggagggcttcttcgacctgatgcacgtgcagaaggtcctgtccgcgagcaccgtgtgcaagctccagtcctgcacgcacgggatccccggcgacctgcaggtgtaccacatcgggaacctgctcaagggcgaccgggtcaacggccacctgatccacaagatcgagccccacttcaacaccagctggatgtcctgggacgggtgcgacctggactactactgcaacatgggcgactggcccagctgcacctacaccggggtgacgcagcacaaccacgccgccttcgtgaacctcctgaacatcgagaccgactacaccaagaccttccacttccactccaagcgcgtcacggcccacggcgacaccccgcagctggacctcaaggcccggcccacctacggggcgggcgagatcaccgtgctggtcgaggtggccgacatggagctgcacacgaagaaggtggagatcagcggcctcaagttcgcctccctggcctgcaccgggtgctacgcctgcagctccggcatcagctgcaaggtccgcatccacgtggacgagcccgacgagctgaccgtgcacgtcaagtccagcgaccccgacgtggtggcggccagcacctccctcatggcccggaagctggagttcgggacggacagcaccttcaaggccttctccgccatgccgaagaccagcctgtgcttctacatcgtcgagcgcgagtactgcaagtcctgcagcgaggacgacaccaagaagtgcgtggacacgaagctcgagcagccccagtccatcctgatcgagcacaagggcaccatcatcgggaagcagaacgacacctgcaccgcgaaggccagctgctggctggagtccgtgaagagcttcttctacggcctcaagaacatgctgggctccgtcttcgggaacttcttcatcggcatcctgctcttcctggcccccttcgtgctgctggtgctcttcttcatgttcgggtggaagatcctgttctgcttcaagtgctgccgccggacgcgcggcctgttcaagtaccggcacctcaaggacgacgaggagaccgggtaccgccggatcatcgagcgcctgaacaacaagaagggcaagaaccggctgctcgacggcgagcgcctggccgaccggaagatcgcggagctgttcagcaccaagacccacatcgggtga

SEQ ID NO: 12048 - RNA, 5052 nt, synthetic construct
  misc_feature 1..5052: note = derived and/or modified CDS sequence (opt1) from CCHFV(K229_194)__KX013463.1__GP
  source 1..5052: mol_type = other RNA
atgcacaccctcctcgtgtgcttcatcctgtacctgcagctcagcggcctcggcggggcccacgggcagagcaacgccaccgagcacaacgggaccaacaccaccaccgtccccgggaccagccagtccccgaagccgcccgcgagcaccaccctgccccacacccccgagtccagcaccgtgaagctcaccacccccacctccgagaccgagggcagcggcgagaccacgccgccgcccaacaccacccaggggctgcccccgcccggcaccacccccgagcgccccgccaccacggccacctccaccagctccaccgacaacatgaacagcacgacccaggtgaccgacaacacccccatctccacggtcagcatctcccccagctccagcccgtccatgcccagcaccagccaggggatccactaccccgtgcggtccctgctcagcgtgtccagccccaagaccgtcaccacgcccacccccatgtcccccggcgagatgagccccgagacctccagccagcactccgccatgagccgcatcccgaccctgtacacggccacccaggtgtccaccgagaacaccaaccggagcacgccccggcagtccgagagctccgcccagcccgccacgcagagccccaccacctccccgacccagacgatcctgctcatgagcgccgcccccaaggcgatccaggacatgcacccctccccgaccaaccggagcaagcgcaacctggaggtggagatcatcctgaccctcagccaggggctgaagaagtactacggcaagatcctgaagctcctgcacctgaccctcgaggaggacacggagggcctgctggagtggtgcaagcggaacctcgggtccaactgcgacgacgacttcttccagaagcgcatcgaggagttcttcatcaccggcgaggggtacttcaacgaggtcctgcagttcaagaccctgaacaccctcagccccacggagccctcccacgtgcggctgcccaccgccgagccgttcaagagctacttcgccaagggcttcctgtccgtggacagcggctacttctccgccaagtgctacccccgcagctccaccagcgggctccagctgatcaacgtcacccagcaccccgcccggatcgcggagacgcccggcccgaagaccacctccctgaagaccatcaactgcatcaacctccgcgccagcgtgttcaaggagcaccgggaggtggagatcaacgtcctgctgccccagatcgccgtgaacctctccaactgccacgtggtcatcaacagccacgtgtgcgactactccctggacacggacgggcccgtgcgcctgccccggatccaccacgagggcaccttcatcccggggacctacaagatcgtcatcgacaagaagaacaagctcaacgaccgctgcagcctggtgaccaactgcgtgatcaagggccgggaggtccgcaagggccagtccgtgctgcggcagtacaagacggagatcaagatcgggaaggccagcaccggcagccgcaagctcctgtccgaggagcccggggacgactgcatcagccggacccagctgctcaagaccgagacggccgagatccacgacgacaactacggcgggcccggcgacaagatcaccatctgcaacggctccaccatcgtcgaccagcgcctggggagcgagctgggctgctacaccatcaaccgcgtgaagtccttcaagctctgcgagaacagcgcgacggggaagacctgcgagatcgactccacccccgtgaagtgccggcagggcttctgcctgaagatcacccaggaggggcgcggccacgtcaagctgagccggggctccgaggtggtgctggacgcctgcgacagctcctgcgagatcatgatcccgaaggggacgggcgacatcctcgtcgactgcagcgggggccagcagcacttcctgaagggcaacctgatcgacctcgggtgcccccacatccccctgctgggcaagatggccatctacatctgccgcatgtccaaccacccccggaccaccatggccttcctcttctggttcagcttcgggtacgtgatcacgtgcatcttctgcaaggccctgttctactccctgatcatcatcggcaccctcgggaagaagatcaagcagtaccgcgagctgaagccgcagacgtgcaccatctgcgagaccgcgcccgtgaacgccatcgacgccgagatgcacgacctgaactgcagctacaacatctgcccctactgcgcctcccggctcaccagcgacggcctggcccgccacgtcacgcagtgccccaagcggaaggagaaggtggaggagaccgagctgtacctcaacctggagcgcatcccgtggatcgtgcggaagctgctccaggtctccgagagcaccggcgtggcgctgaagcgcagctcctggctgatcgtgctcctggtcctgctcaccgtgagcctgtcccccgtgcagagcgcccccgtcgggcacggcaagacgatcgagacctaccagacccgggaggggttcaccaacatctgcctgttcatgctcggctccatcctgttcatcgtgagctgcctggtgaaggggctcgtcgactccgtgagcgactccttcttcccgggcctgagcgtgtgcaagacgtgctccatcggcagcatcaacgggttcgagatcgagtcccacaagtgctactgcagcctgttctgctgcccctactgccgccactgctccgccgaccgggagatccaccagctccacctgggcatctgcaagaagcgcaagaccgggagcaacgtcatgctggccgtgtgcaagcggatgtgcttcaaggcgaccatcgaggcctcccgccgggccctcctgatccgcagcatcatcaacaccacgttcgtgatctgcatcctgaccctcgccatctgcgtcgtgtccaccagcgccgtggagatggagaacctgcccgcgggcacctgggagcgcgaggaggacctgacgagcttctgccaccaggagtgccaggtcaccgagaccgagtgcctctgcccctacgaggccctggtgctgcggaagcccctgttcctggactccatcgtgaaggggaagaagaacctgctcaacagcacctccctggagacgagcctgtccatcgaggccccctggggcgccatcaacgtccagagcaccttcaagcccaccgtgtccaccgccaacatcgcgctcagctggtccagcgtggagcaccgcggcaacaagatcctggtcacggggcggtccgagagcatcatgaagctggaggagcgcaccggcgtgtcctgggacctcggggtggaggacgccagcgagtccaagctgctgaccgtcagcatcatggacctctcccagatgtacagccccgtgttcgagtacctgtccggcgaccgccaggtggaggagtggccgaaggcgacctgcacgggggactgccccgagcgctgcggctgcaccagctccacgtgcctgcacaaggagtggccccactcccggaactggcgctgcaaccccacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgaccagccaggagcggcagtgctccctgatcgaggccggcacgcgcttcaacctcggcccggtcaccatcaccctgagcgagccccggaacatccagcagaagctgccgcccgagatcatcaccctccacccgaagatcgaggaggggttcttcgacctgatgcacgtgcagaaggtgctgtccgcgagcacggtctgcaagctccagtcctgcacccacggcatccccggggacctgcagatctaccacatcggcaacctgctcaagggggaccgcctgaacggccacctgatccacaagatcgagccccacttcaacaccagctggatgtcctgggacggctgcgacctcgactactactgcaacatgggggactggcccagctgcacctacacgggcgtgacccagcacaaccacgccgccttcgtcaacctgctgaacatcgagaccgactacaccaagacgttccacttccactccaagcgggtgaccgcccacggggacaccccgcagctcgacctgaaggcgcgccccacctacggcgccggggagatcacggtgctggtcgaggtggccgacatggagctccacaccaagaaggtggagatcagcggcctgaagttcgcctccctggcctgcaccggctgctacagctgctccagcgggatctcctgcaaggtccggatccacgtggacgagcccgacgagctcaccgtgcacgtcaagagctccgaccccgacgtggtggcggccagcacgagcctgatggcccgcaagctggagttcggcaccgactccaccttcaaggccttcagcgccatgccgaagacctccctctgcttctacatcgtcgagcgggagtactgcaagagctgctccgaggacgacacgaagaagtgcgtggacaccaagctggagcagccccagagcatcctgatcgagcacaaggggaccatcatcggcaagcagaacgacacgtgcacggcgaaggcctcctgctggctcgagagcgtgaagtccttcttctacgggctgaagaacatgctgggcagcgtcttcggcaacttcttcgtggggatcctcctgttcctggcccccttcgtgctgctcgtcctgttcttcatgttcggctggaagatcctgttctgcttcaagtgctgccgccggacccgcggcctcttcaagtaccggcacctgaaggacgacgaggagaccggctaccgcaagatcatcgagcgcctgaactccaagaagggcaagaaccggctcctggacggggagcgcctggccgaccggaagatcgccgagctgttcagcaccaagacgcacatcggctga

SEQ ID NO: 12049 - RNA, 5052 nt, synthetic construct
  misc_feature 1..5052: note = derived and/or modified CDS sequence (opt1) from CCHFV(K315_14)__KX013469.1__GP
  source 1..5052: mol_type = other RNA
atgcacaccctgctcgtgtgcttcatcctgtacctgcagctcagcggcctggggggcgcccacgggcagtccaacgagaccgagcacaacggcacgaacaccaccaccgtccccgggacgagccagtccccgaagccccccgccagcaccaccctgcagcacacccccgagtccagcacggtgaagctcaccaccccgacctccgagacggagggcagcggcgagaccacccccccccccaacaccacgcaggggctgccgccccccggcaccacccccgagcgctccgcgaccacggccaccagcacctccagcaccgacaacatgaactccacgacccaggtgaccgacaacaccccgacgagcaccgtctccatcagcccctccagctcccccagcatgcccagcacctcccaggggatccactacccgatccggagcctgctctccgtgagctcccccaagaccgtgacgacccccacccccatcagcccgggcgagatgtcccccgagaccagctcccagcacagcgccatgtcccgcatccccacgctgtacaccgccacccaggtcagcaccgagaacaccaaccggtccacgccccgccagagcgagtccagcgtgcagccggccacccagtcccccatcaccagccccgcgcagaccatcctgctcatgtccgccgcccccaaggccatccaggacatgcacccgagccccacgaaccggagcaagcgcaacctggaggtggagatcatcctgaccctctcccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagccccaccgagccgtcccacgtgcggctgcccacggcggagcccttcaagagctacttcgccaagggcttcctgtccatcgacagcggctacttctccgccaagtgctacccccgcagctccaccagcgggctccagctgatcaacgtgacccagcacccggcccggatcgccgagacccccggccccaagacgacctccctgaagaccatcaactgcatcaacctccgcgcgagcgtcttcaaggagcaccgggaggtggagatcaacgtgctgctgccccagatcgccgtcaacctctccaactgccacgtggtgatcaacagccacgtctgcgactactccctggacaccgacgggccggtgcgcctgccccggatccaccacgagggcacgttcatccccgggacctacaagatcgtgatcgacaagaagaacaagctcaacgaccgctgcagcctggtcaccaactgcgtgatcaagggccgggaggtgcgcaagggccagagcgtcctgcggcagtacaagaccgagatccgcatcgggaaggcctccacgggcagccggaagctcctgtccgaggagcccggggacgactgcatcagccgcacccagctgctcaagaccgagaccgccgagatccacgacgacaactacggcgggccgggcgacaagatcacgatctgcaacggctccaccgtggtcgaccagcgcctggggagcgagctgggctgctacaccatcaaccgggtgaagtccttcaagctctgcaagaacagcgccaccgggaagacgtgcgagatcgactccacccccgtgaagtgccgccagggcttctgcctgaagatcacccaggaggggcggggccacgtcaagctgagccgcggctccgaggtggtgctggacgtctgcgacagctcctgcgagatcatgatccccaaggggaccggcgacatcctcgtggactgcagcgggggccagcagcacttcctgaaggacaacctgatcgacctcggctgcccccacatcccgctgctggggaagatggcgatctacatctgccggatgtccaaccacccccgcacgaccatggccttcctcttctggttcagcttcggctacgtgatcacctgcatcttctgcaaggccctgttctactccctgatcatcatcgggaccctcggcaagaagatcaagcagtaccgggagctgaagccccagacctgcacgatctgcgagaccgcccccgtcaacgccatcgacgcggagatgcacgacctgaactgcagctacaacatctgcccgtactgcgcctcccgcctcaccagcgaggggctggcccggcacgtgacccagtgccccaagcgcaaggagaaggtggaggagacggagctgtacctcaacctggagcggatcccctggatcgtccgcaagctgctccaggtgagcgagtccaccggcgtggccctgaagcggagctcctggctgatcgtcctcctggtgctgctcaccgtgagcctgtcccccgtccagagcgccccggtgggccacgggaagaccatcgagacgtaccagacccgcgagggcttcacctccatctgcctgttcatgctcgggagcatcctgttcatcgtgtcctgcctggtcaagggcctcgtgtacagcgtgtccgacagcttcttccccgggctgtccgtctgcaagacctgcagcatcggctccatcaacggcttcgagatcgagagccacaagtgctactgctccctgttctgctgcccctactgccggcactgcagcgcggaccgcgagatccaccagctccacctgtccatctgcaagaagcggaagacggggagcaacgtgatgctggccgtgtgcaagcgcatgtgcttcaaggccaccatcgaggccagccggcgcgcgctcctgatccgctccatcatcaacaccaccttcgtcatctgcatcctgacgctcgccatctgcgtggtgagcacctccgccgtcgagatggaggacctgccggccggcacctgggagcgggaggaggacctgaccaacttctgccaccaggagtgccaggtgacggagaccgagtgcctctgcccctacgaggccctggtgctgcgcaagcccctcttcctggacagcatcgtcaaggggatgaagaagctgctcaactccaccagcctggagacctccctgagcatcgaggcgccctggggcgccatcaacgtgcagtccacgttcaagccgaccgtgagcaccgccaacatcgccctctcctggagctccgtcgagcaccgggggaacaagatcctggtgaccggccgcagcgagtccatcatgaagctggaggagcggacgggcgtgagctgggacctcggggtcgaggacgcctccgagagcaagctgctgaccgtgtccatcatggacctcagccagatgtacagccccgtgttcgagtacctgtccggcgaccgccaggtcgaggagtggcccaaggcgacctgcaccggggactgccccgagcggtgcggctgcacgagctccacctgcctgcacaaggagtggccgcacagccgcaactggcggtgcaaccccacctggtgctggggggtgggcaccggctgcacgtgctgcggggtggacgtcaaggacctcttcaccgaccacatgttcatcaagtggaaggtggagtacatcaagaccgaggccatcgtgtgcgtcgagctgacctcccaggagcgccagtgcagcctgatcgaggccggcacccggttcaacctcgggcccgtgacgatcaccctgtccgagccccgcaacatccagcagaagctgccgcccgagatcatcaccctccaccccaagatcgaggagggcttcttcgacctgatgcacgtgcagaaggtcctgagcgcctccaccgtgtgcaagctccagagctgcacgcacggcatccccggggacctgcagatctaccacatcggcaacctgctcaagggggaccgggtcaacggccacctgatccacaagatcgagccgcacttcaacacctcctggatgagctgggacgggtgcgacctggactactactgcaacatgggcgactggccctcctgcacctacaccggcgtgacgcagcacaaccacgccgcgttcgtgaacctcctgaacatcgagaccgactacaccaagaccttccacttccacagcaagcgcgtcacggcccacggggacaccccccagctggacctcaaggcccggcccacctacggcgccggggagatcaccgtgctggtggaggtcgcggacatggagctgcacacgaagaaggtggagatctccggcctcaagttcgccagcctgacctgcaccgggtgctacgcctgctccagcggcatctcctgcaaggtgcgcatccacgtcgacgagccggacgagctgaccgtgcacgtgaagagcagcgaccccgacgtcgtggccgcctccacgagcctcatggcgcggaagctggagttcggcaccgactccaccttcaaggccttcagcgccatgcccaagacctccctgtgcttctacatcgtggagcgcgagtactgcaagagctgctccgaggacgacacgaagaagtgcgtcgacaccaagctcgagcagccccagagcatcctgatcgagcacaaggggaccatcatcggcaagcagaacgacacctgcacggccaaggcctcctgctggctggagagcgtgaagtccttcttctacgggctcaagaacatgctgggcagcgtgttcgggtccttcttcgtcggcatcctgctcttcctggcgccgttcgtgctgctggtgctcttcttcatgttcggctggaagatcctgttctgcttcaagtgctgccggcgcacccgggggctgttcaagtaccgccacctcaaggacgacgaggagaccggctaccgccggatcatcgagcgcctgaacagcaagaaggggaagaaccggctgctcgacggcgagcgcctggccgaccggaagatcgccgagctgttctccaccaagacgcacatcggctga

SEQ ID NO: 12050 - RNA, 5055 nt, synthetic construct
  misc_feature 1..5055: note = derived and/or modified CDS sequence (opt1) from CCHFV(BA8402)__AF350449.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtctcccaggagctcggcctgcccgtgagcaccgtgtccacgatcaccagcgagccgccctccatcaccagcgcggtctccgtgagcgggtccgagggcagcggggacaccaacacgtccccgagcgtgaccacccagggccccaccctgcccgagacgaccctcgagcccctgaccaccacggacaccgacgcctccagcaccgtcgtggtggacgtctccacccagacggtgaaggacaccccgatcagcaccacctacacgagcctgccctccacccccagcgagcccaccaccccgcagggcacgcaccacaccgcccgcgggctcctgtccgtgaccagcaccaagcccgaggaggccagcccccaggccaaccccggcaagatcagcatggagacgaacgggccgcggctggcgatctccgagacccccagcttctcccccaccacccaggcccccacggagaacagcaacccgatcacctccaagcagctcatgctgagcgcccagcccgtcacccccaaccccatgacctccccggtgcagcccgccctgagccagtccgacaccagcacggcgatccaggacgtgcacccctcccccaccggccgcagcaagcggaacctcgagatggagatcatcctgaccctgtcccaggggctcaagaagtactacggcaagatcctgaagctgctcgacctgaccctggaggaggacacggagggcctcctggagtggtgcaagcgcaacctggggctcgtctgcgacgacaacttcttccagaagcggatcgaggagttcttcctgaccggcaaggggcacttcaacgaggtgctgcagttcaagaccccgagcaccctcagccccacgggccccgcccgcaccggctccccgaccgtggagcccttcaagagctacttcgccaaggggttcctgtccatggacagcggctacttctccgccaagtgctacccccgggccagcaactccgggctgcagctcatcaacgtcacccagcacagcacgcgcatcaccgacacccccggcccgaagatcaccaacctgaagacgatcaactgcatcaacctgaaggcgtccgtgttcaaggagcaccgggagatcgagatcaacgtgctcctgccccaggtcgccgtgaacctgagctcctgccacgtgctcatcaagagccacgtctgcgactactccctggacatcgacgggcccgtgcgcctgccccggatccaccacgagggcaccttcatcccgggcacctacaagatcgtcatcgacaagaagaacaagcagaacgaccgctgcaccctcgtgacgaactgcgtgatcaaggggcgggagatccgcaagggccagagcgtcctgcggcagtaccgcaccgagatcaagatcgggaaggcctccagcggctcccggcgcctgctcagcgaggagagcggggacgactgcatctcccggacccagctgctgcgcaccgagacggccgagatccacaacgacaactacggcggccccggggacaagatcaccatctgcaacggcagcaccgtggtggaccagcggctggggtccgagctcggctgctacaccatcaaccgcgtcaacagcttcaacctgtgcgagaacacggccaccgggaagtcctgcgagatcgacagcacccccgtgaagtgccgccagggcttctgcctgaagatcacccaggagggccgggggcacgtgaagctctcccgcggcagcgaggtcgtgctggacgcgtgcgagtccagctgcgagatcatgatccccaaggggacgggcgacatcctggtggactgctccggcgggcagcagcacttcctcaaggacaacctgatcgacctgggctgcccgaacatccccctcctggggaagatggccatctacatctgccggatgagcaaccaccccaagaccaccatggccttcctgttctggttctccttcggctacgtcgtgacctgcatcctctgcaaggtgatcttctacctgctgatcgtcgtggggacgctcggcaagaagttcaagcagtaccgcgagctgaagccccagacctgcaccatctgcgagaccaccccggtgaacgccatcgacgccgagatgcacgacctgaactgcagctacaacatctgcccctactgcgcgtcccggcccacgagcgacggcctcgcccgccacgtcatgcagtgccccaagcggaaggagaagatcgaggagaccgccctgtacctgaacctcgagcgcatcccgtgggtggtgcggaagctgctgcaggtctccgagagcaccggggtggccctcaagcgctccagctggctggtggtcctgctcgtgctgctgaccgtgagcctctcccccgtccagagcgcccccatcggccacgggaagacggtggagacctaccagacccgggagggctacacctccatctgcctgttcgtgctggggagcatcctcttcatcgtctcctgcctgatgaagggcctggtggacagcgtgggcaactccttcttccccgggctcagcatctgcaagacgtgctccatcggcagcgtcaacgggttcgagatcgagtcccacaagtgctactgcagcctgttctgctgcccgtactgccgccactgctccgcggaccgggagatccaccgcctgcacctcagcatctgcaagaagcggaagaccggctccaacgtgatgctggccgtgtgcaagcgcatgtgcttccgggccaccgtcgaggtgagcaacaaggccctgctcatccgcaacatcatcaacaccacgttcgtgctgtgcatcctgatcctcgcggtctgcgtggtgtccaccagcgccgtcgagatggagtccctgcccgccgggacctgggagcgggaggaggacctgaccaacttctgccaccaggagtgccaggtgacggagaccgagtgcctctgcccctacgaggccctggtgctgcgcaagcccctcttcagcgacagcatcgtcaagggcatgaagaacctgctgaactccaccagcctcgagacctccctgagcatcgaggccccctggggcgcgatcaacgtgcagtccacgttcaagcccaccgtgagcgccgccaacatcgccctgtcctggagctccgtcgagcaccgcgggaacaagatcctcgtgagcggccggtccgagagcatcatgaagctggaggagcgcaccgggatctcctgggacctgggcgtggaggacgccagcgagtccaagctcctgaccgtcagcgtgatggacctgtcccagatgtacagccccgtcttcgagtacctctccggggaccgccaggtggaggagtggccgaaggcgacgtgcaccggcgactgccccgagcggtgcggctgcaccagcagcacgtgcctgcacaaggagtggccccactcccggaactggcgctgcaaccccacctggtgctggggcgtggggaccgggtgcacgtgctgcggcctggacgtcaaggacctcttcaccgactacatgttcatcaagtggaaggtggagtacatcaagaccgaggccatcgtgtgcgtcgagctgaccagccaggagcggcagtgcaccctgatcgaggccggcacccgcttcaacctcgggccggtgacgatcaccctgtccgagccccggaacatccagcagaagctgccgcccgagatcgtgaccctccacccccgcatcgaggagggcttcttcgacctgatgcacgtccagaaggtgctgagcgcctccaccgtgtgcaagctccagagctgcacccacggggtccccggcgacctccaggtgtaccacatcgggaacctgctcaagggcgacaaggtgaacggccacctgatccacaagatcgagccccacttcaacacgtcctggatgagctgggacgggtgcgacctgcactactactgcaacatgggcgactggccctcctgcacctacaccggggtcacccagcacaaccacgccgcgttcgtgaacatgctcaacatcgagacggactacaccaagaacttccacttccacagcaagcgggtgaccgcccacggcgacaccccgcagctggacctgaaggcccgccccacgtacggggccggcgagatcaccgtcctcgtggaggtggcggacatggagctgcacaccaagaagatcgagatctccggcctgaagttcgccagcctgacctgcacggggtgctacgcctgctccagcggcatctcctgcaaggtccggatccacgtggacgagcccgacgagctgaccgtgcacgtcaagagcgaggaccccgacatcgtggccgcctccagctccctgatggcgcgcaagctcgagttcgggaccgacagcaccttcaaggccttcagcgccatgccgaagacgtccctgtgcttctacatcgtggagcgggagtactgcgagagctgctccaaggaggacacccagaagtgcgtcaacaccaagctggagcagccccagagcatcctcatcgagcacaagggcaccatcatcgggaagcagtccaacacgtgcaccgccaaggccagctgctggctggagtccgtgaagtccttcttctacggcctgaagaacatgctgtccggcatcttcgggaacgtgttcatcggcgtcttcctcttcttcgcgcccttcatcctgctgatcctcttcttcatgttcgggtggcgcatcctgttctgcttcaagtgctgccggcgcacccggggcctgttcaagtaccgccacctcaaggacgacgaggagaccggctaccggaagatcatcgagcgcctgaacaacaagaaggggaagaacaagctgctcgacggcgagcgcctggccgaccggaagatcgccgagctgttcagcacgaagacccacatcgggtga

SEQ ID NO: 12051 - RNA, 5055 nt, synthetic construct
  misc_feature 1..5055: note = derived and/or modified CDS sequence (opt1) from CCHFV(UCCR4459)__KY484032.1__GP
  source 1..5055: mol_type = other RNA
atgtacacgcccctcctctgcgccgtgctgtgcctgcagctctggagcctggagggctcccacgggctgagcaacaagacccagcactccaacaccagcaccaccaaggccccggaggtctcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtctccacccagacggtgaaggacacccccatcagcaccacccacacgagcctcccctccaccccgagcgccaccaccacgccccagggcacccaccacaccgcccgcgggctgctgtccgtgaccagcacgaagcccgagggcgcctccacccaggcgaaccccgagaagatcagcatggagaccaactccccgcggctcgccatcagcgagaccccctccttcagccccacgacccaggcccccaccgagaactccaacccgatcaccagcaagcagctgatcttctccgcccagcccgtcacccccaaccccgtgacgccgcccgtgcagcccgcgctgagccagtccgacaccagcaccgccatccaggacatccacccctccccgaccagccgctccaagcggaacctcgagatggagatcatcctgacgctgagccaggggctcaagaagtactacggcaagatcctgaagctgctcgacctgaccctggaggaggacaccgaggggctcctggagtggtgcaagcgcaacctgggcctcgtctgcgacgacgacttcttccagaagcggatcgaggagttcttcctgaccggcgaggggcacttcaacgaggtgctgcagttcaagacgcccagcaccctctcccccaccggccccgcccgcaccgggagcccgacggtggagcccttcaagtcctacttcgccaagggcttcctgagcatggactccggctacttcagcgccaagtgctacccccgggcgtccaacagcgggctgcagctcatcaacgtcacccagcactccacccgcatcaccgacacgccgggccccaaggtgaccaacctgaagaccatcaactgcatcaacctgaaggccagcgtgttcaaggagcaccgggagatcgagatcaacgtcctcctgccccaggtggccgtgaacctgtccagctgccacgtcctcatcaagtcccacgtgtgcgactacagcctggacatcgacgggcccgtccgcctgccgcggatccaccacgagggcaccttcatccccgggacgtacaagctcgtgatcgacaagaagaacaagcagaacgaccgctgcaccctgatcaccaactgcgtgatcaagggccgggagatccgcaagggccagtccgtcctgcggcagtaccgcaccgagatcaagatcgggaaggccagctccggcagccggcgcctcctgagcgaggagtccggggacgactgcatcagccggacgcagctgtcccgcaccgagaccgccgagatccacagcgacaactacggcgggcccggcgacaagatcaccatctgcaacggctccacgatcgtggaccagcggctggggagcgagctcggctgctacaccatcaaccgcgtgaagtccttcaagctgtgcgagaacagcgcgaccgggaagtcctgcgagatcgacagcacccccatcaagtgccgccagggcttctgcctgaagatcacgcaggaggggcggggccacgtcaagctctcccgcggcagcgaggtggtgctggacgcctgcgactccagctgcgagatcatgatcccgaaggggaccggcgacatcctggtcgactgctccgggggccagcagcacttcctcaaggacaacctgatcgacctgggctgccccaacatccccctcctggggaagatggccatctacatctgccggatgagcaaccaccccaagaccaccatggccttcctgttctggttctccttcggctacgtgatcacgtgcatcctctgcaaggtgatcttctacctgctgatcgtcgtggggaccctcggcaagaagttcaagcagtaccgcgagctgaagccgcagacctgcaccatctgcgagaccacgcccgtgaacgccatcgacgcggagatgcacgacctgaactgcagctacaacatctgcccctactgcgcctcccggctcaccagcgacgggctggcccgccacgtcatgcagtgccccaagcggaaggagaaggtggaggagaccgagctgtacctcaacctggagcgcatcccgtgggtggtccggaagctgctccaggtgagcgagtccaccggcgtggccctgaagcgcagctcctggctggtcgtgctcctggtgctgctcacggtcagcctgtcccccgtgcagagcgcccccatcggccacgggaagaccgtggagacctaccagacccgggagggctacacgtccatctgcctgttcgtcctcgggagcatcctgttcatcgtgtcctgcctgatgaagggcctcgtggacagcgtcgggaactccttcttccccggcctgagcatctgcaagacctgctccatcggcagcatcaacgggttcgagatcgagtcccacaagtgctactgcagcctgttctgctgcccgtactgccgccactgctccgcggaccgggagatccacaagctccacctgagcatctgcaagaagcgcaagaccggctccaacgtgatgctggccgtgtgcaagcggatgtgcttccgcgccaccgtcgaggtgagcaacaaggccctcctgatccggaacatcatcaacacgaccttcgtggtctgcatcctgatcctcgcggtgtgcgtggtcagcacctccgccgtggagatggagagcctgcccgccgggacctgggagcgcgaggaggacctgacgaacttctgccaccaggagtgccaggtgaccgagaccgagtgcctctgcccctacgaggccctggtcctgcggaagcccctcttctccgacagcatcgtgaagggcatgaagaacctgctgaactccaccagcctcgagacgtccctgagcatcgaggccccgtggggcgcgatcaacgtgcagtccaccttcaagcccaccgtcagcgccgccaacatcgccctgtcctggagctccgtggagcaccgcgggaacaagatcctcgtgagcggccgctccgagagcatcatgaagctggaggagcggaccgggatctcctgggacctgggcgtcgaggacgccagcgagtccaagctcctgacggtgagcatcatggacctgagccagatgtactcccccgtgttcgagtacctcagcggggaccgccaggtcgaggagtggccgaaggcgacctgcaccggcgactgccccgagcggtgcgggtgcacctccagcacgtgcctgcacaaggagtggccccactcccgcaactggcggtgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggcccggtgacgatcaccctgagcgagccccgcaacatccagcagaagctgccgcccgagatcgtcaccctccacccccggatcgaggagggcttcttcgacctgatgcacgtgaagaaggtgctgtccgccagcaccgtctgcaagctccagtcctgcacccacggggtgcccggcgacctccaggtgtaccacatcgggaacctgctcaagggcgacaaggtcaacgggcacctgatccacaagatcgagccccacttcaacacgagctggatgtcctgggacggctgcgacctggactactactgcaacatgggcgactggcccagctgctcctacaccggggtgacccagcacaaccacgccgcgttcgtgaacatgctcaacatcgagaccgactacacgaagatcttccacttccacagcaagcgcgtcaccgcccacggcgacaccccgcagctggacctgaaggcccggcccacctacggggccggcgagatcacggtgctcgtggaggtcgcggacatggagctgcacaccaagaagatcgagatctccgggctgaagttcgccagcctgacctgcaccggctgctacgcctgctccagcggcatcagctgcaaggtgcgcatccacgtggacgagcccgacgagctgacggtccacgtgaagtccgaggaccccgacatcgtggccgccagctccagcctgatggcgcggaagctcgagttcgggaccgactccaccttcaaggccttcagcgccatgccgaagacctccctgtgcttctacatcgtcgagcgcgagtactgcaagagctgctccaaggaggacacgcagaagtgcgtgaacaccaagctggagcagccccagagcatcctcatcgagcacaagggcaccatcatcgggaagcagaacgacacgtgcacctccaaggccggctgctggctggagagcgtgaagtccttcttctacgggctgaagaacatgctgagcggcatcttcggcaacgtcttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggggagcgcctggcggaccgcaagatcgccgagctgttctccaccaagacgcacatcggctga

SEQ ID NO: 12052 - RNA, 5052 nt, synthetic construct
  misc_feature 1..5052: note = derived and/or modified CDS sequence (opt1) from CCHFV(Ast149)__KX056054.1__GP
  source 1..5052: mol_type = other RNA
atgcacaccctgctcgtgtgcttcatcctgtacctgcagctcagcggcctggggggcgcccacgggcagtccaacgccaccgagcacaacggcacgaacaccaccaccgcgcccgggacgagccagtccccgaagccccccgccagcaccacccccccgcacacccccgagtccagcacggtcaagctgaccacccccacctccgagacggagggcagcggcgagaccacccccccgcccaacaccacgcaggggctcccccccccgggcaccacccccgagcgccccgccaccacggccacctccaccagctccaccgacaacatgaacagcacgacccaggtgaccgacaacacccccacgtccaccgtgagcacctccccgagctccagcccctccatgcccagcaccagccaggggatccactaccccgtccggtccctgctgagcgtgtccagcccgaagacggtgaccacccccacccccatgtcccccggcgagatgagcccggagacgtccagccagcactccgccatgagccgcatccccaccctctacaccgcggcccaggtctccaccgagaacgccaaccggagcaccccccgccagtccgagagctccgcccagcccgcgacgcagagcccgaccaccttccccgcccagaccatcctgctgatgtccgccgcccccaaggccatccaggacatgcacccgagccccacgaaccggtccaagcgcaacctcgaggtggagatcatcctgaccctgagccaggggctcaagaagtactacggcaagatcctgaagctgctccacctgaccctggaggaggacaccgagggcctcctggagtggtgcaagcggaacctggggagcaactgcgacgacgacttcttccagaagcgcatcgaggagttcttcatcacgggcgaggggtacttcaacgaggtgctccagttcaagaccctgtccaccctgagccccaccgagccctcccacgtccggctcccgacggcggagcccttcaagagctacttcgccaagggcttcctgtccatcgacagcggctacttctccgccaagtgctacccccgcagctccaccagcgggctgcagctcatcaacgtgacccagcaccccgcccggatcgccgagaccccgggccccaagacgacctccctgaagaccatcaactgcatcaacctgcgcgcgagcgtgttcaaggagcaccgggaggtcgagatcaacgtgctcctgccccagatcgccgtgaacctgtccaactgccacgtcgtgatctacagccacgtgtgcgactactccctcgacaccgacgggcccgtccgcctgccgcggatccaccacgagggcacgttcatccccgggacctacaagatcgtgatcgacaagaagaacaagctgaacgaccgctgcagcctcgtgaccaactgcgtcatcaagggccgggaggtgcgcaagggccagtccgtgctgcggcagtacaagaccgagatcaagatcgggaaggccagcacgggcagccgcaagctgctctccgaggagcccggggacgactgcatcagccggacccagctgctgaagaccgagaccgccgagatccacgacgacaactacggcgggcccggcgacaagatcacgatctgcaacggctccaccatcgtcgaccagcgcctcgggagcgagctgggctgctacaccatcaaccgcgtgaagtccttcaagctgtgcgagaacagcgccaccgggaagacgtgcgagatcgactccaccccggtcaagtgccggcagggcttctgcctcaagatcacccaggaggggcgcggccacgtgaagctgagccggggctccgaggtggtcctggacgcgtgcgacagctcctgcgagatcatgatccccaaggggaccggcgacatcctggtggactgcagcgggggccagcagcacttcctcaaggacaacctgatcgacctgggctgcccccacatccccctcctggggaagatggccatctacatctgccgcatgtccaaccacccgcggacgaccatggccttcctgttctggttcagcttcggctacgtgatcacctgcatcttctgcaaggccctcttctactccctgatcatcatcgggaccctgggcaagaagatcaagcagtaccgcgagctcaagccccagacctgcacgatctgcgagaccgcccccgtcaacgcgatcgacgccgagatgcacgacctgaactgcagctacaacatctgcccctactgcgcctcccggctgaccagcgacgggctcgcccgccacgtgacccagtgcccgaagcggaaggagaaggtggaggagacggagctgtacctgaacctcgagcgcatcccctggatcgtccggaagctgctgcaggtgtccgagagcaccggcgtggcgctcaagcgcagctcctggctgatcgtcctgctcgtgctgctgaccgtgagcctctcccccgtccagagcgccccggtgggccacgggaagaccatcgagacgtaccagacccgggagggcttcaccaacatctgcctgttcatgctggggtccatcctcttcatcgtgagctgcctggtcaagggcctggtggactccgtgagcgactccttcttccccgggctcagcgtctgcaagacctgctccatcggcagcatcaacggcttcgagatcgagtcccacaagtgctactgcagcctgttctgctgcccctactgccgccactgctccgccgaccgggagatccaccagctgcacctcgggatctgcaagaagcgcaagacgggcagcaacgtgatgctggccgtgtgcaagcggatgtgcttcaaggccaccatcgaggcgtcccgccgggccctgcccatccgcagcatcatcaacaccaccttcgtcatctgcatcctcacgctggccatctgcgtggtgtccaccagcgccgtcgagatggagaacctgccggccgggacctgggagcgcgaggaggacctcaccaacttctgccaccaggagtgccaggtgacggagaccgagtgcctgtgcccctacgaggcgctggtgctccggaagcccctgttcctggacagcatcgtcaagggcatgaagaacctcctgaactccaccagcctggagacctccctcagcatcgaggccccctggggggccatcaacgtgcagtccacgttcaagccgaccgtgagcaccgccaacatcgccctgtcctggagctccgtcgagcaccgcggcaacaagatcctggtgaccggccggagcgagtccatcatgaagctcgaggagcgcacgggggtgagctgggacctgggcgtcgaggacgcgtccgagagcaagctgctcaccgtgtccatcatggacctgagccagatgtactcccccgtgttcgagtacctgagcggggaccggcaggtcgaggagtggcccaaggccacctgcaccggcgactgccccgagcgctgcgggtgcacgtccagcacctgcctccacaaggagtggccgcacagccggaactggcgctgcaaccccacctggtgctggggcgtgggcaccgggtgcacgtgctgcggcgtggacgtcaaggacctgttcaccgaccacatgttcatcaagtggaaggtggagtacatcaagaccgaggccatcgtgtgcgtcgagctgacctcccaggagcggcagtgcagcctcatcgaggccgggacccgcttcaacctgggccccgtgacgatcaccctgtccgagccccggaacatccagcagaagctcccgcccgagatcatcaccctgcaccccaagatcgaggagggcttcttcgacctgatgcacgtgcagaaggtcctcagcgcgtccaccgtgtgcaagctgcagagctgcacgcacgggatccccggcgacctgcagatctaccacatcgggaacctcctgaagggcgaccgcctgaacgggcacctcatccacaagatcgagccgcacttcaacacctcctggatgagctgggacggctgcgacctggactactactgcaacatgggcgactggccctcctgcacctacaccggggtgacgcagcacaaccacgccgccttcgtcaacctgctcaacatcgagaccgactacaccaagaccttccacttccacagcaagcgggtgacggcccacggcgacaccccccagctggacctgaaggcccgccccacctacggggcgggcgagatcaccgtcctcgtggaggtggccgacatggagctgcacacgaagaaggtcgaggtgtccgggctgaagttcgccagcctcgcctgcaccggctgctacgcctgctccagcggcatctcctgcaaggtgcggatccacgtcgacgagccggacgagctgaccgtgcacgtgaagagctccgaccccgacgtcgtggcggccagcacctccctgatggcccgcaagctcgagttcgggacggacagcaccttcaaggccttcagcgccatgcccaagacctccctgtgcttctacatcgtggagcgggagtactgcaagagctgctccgaggacgacaccaagaagtgcgtcgacacgaagctggagcagccccagagcatcctcatcgagcacaagggcaccatcatcgggaagcagaacgacacctgcaccgcgaaggcctcctgctggctggagagcgtgaagtccttcttctacggcctgaagaacatgctcgggagcgtgttcggcaacttcttcgtcggcatcctgctgttcctcgccccgttcgtgctgctggccctgttcttcatcttcgggtggaagatcctcttctgcttcaagtgctgccgccggacgcgcggcctgttcaagtaccggcacctgaaggacgacgaggagaccgggtaccgcaagatcatcgagcgcctcaactccaagaagggcaagaaccggctgctggacggcgagcgcctcgcggaccggaagatcgccgagctgttcagcaccaagacccacatcgggtga

SEQ ID NO: 12053 - RNA, 5052 nt, synthetic construct
  misc_feature 1..5052: note = derived and/or modified CDS sequence (opt1) from CCHFV(Ast137)__KX056057.1__GP
  source 1..5052: mol_type = other RNA
atgcacaccctcctcgtgtgcttcatcctgtacctgcagctcagcggcctcggcggggcccacgggcagagcaacgccaccgagcacaacgggaccaacaccaccaccgtccccgggaccagccagtccccgaagccgcccgcgagcaccaccctgccccacacccccgagtccagcaccgtgaagctcaccacccccacctccgagaccgagggcagcggcgagaccacgccgccgcccaacaccacccaggggctgcccccgcccggcaccacccccgagcgccccgccaccacggccacctccaccagctccaccgacaacatgaacagcacgacccaggtgaccgacaacacccccacgtccaccgtcagcatctcccccagctccagcccgtccatgcccagcaccagccaggggatccactaccccgtgcggtccctgctcagcgtgtccagccccaagaccgtcacgacccccacccccatgtcccccggcgagatgagccccgagacctccagccagcactccgccatgagccgcatcccgacgctgtacaccgccgcccaggtgtccaccgagaacaccaaccggagcacgccccggcagtccgagagctccgcccagcccgccacgcagagccccaccaccttcccggcccagaccatcctgctcatgtccgcggcccccaaggccatccaggacatgcaccccagcccgacgaaccggtccaagcgcaacctggaggtggagatcatcctgaccctcagccaggggctgaagaagtactacggcaagatcctgaagctcctgcacctgaccctcgaggaggacaccgagggcctgctggagtggtgcaagcggaacctcgggagcaactgcgacgacgacttcttccagaagcgcatcgaggagttcttcatcacgggcgaggggtacttcaacgaggtcctgcagttcaagaccctgtccaccctcagccccaccgagccctcccacgtgcggctgcccacggccgagccgttcaagagctacttcgccaagggcttcctgtccatcgacagcggctacttctccgcgaagtgctacccccgcagctccaccagcgggctccagctgatcaacgtgacccagcaccccgcccggatcgccgagacccccggcccgaagacgacctccctgaagaccatcaactgcatcaacctccgcgccagcgtcttcaaggagcaccgggaggtggagatcaacgtgctgctgccccagatcgccgtcaacctctccaactgccacgtggtgatcaacagccacgtctgcgactactccctggacaccgacgggcccgtgcgcctgccccggatccaccacgagggcacgttcatcccggggacctacaagatcgtgatcgacaagaagaacaagctcaacgaccgctgcagcctggtcaccaactgcgtgatcaagggccgggaggtgcgcaagggccagtccgtcctgcggcagtacaagaccgagatcaagatcgggaaggcgagcacgggcagccgcaagctcctgtccgaggagcccggggacgactgcatcagccggacccagctgctcaagaccgagaccgccgagatccacgacgacaactacggcgggcccggcgacaagatcacgatctgcaacggctccaccatcgtggaccagcgcctggggagcgagctgggctgctacaccatcaaccgcgtcaagtccttcaagctctgcgagaacagcgccaccgggaagacgtgcgagatcgactccacccccgtgaagtgccggcagggcttctgcctgaagatcacccaggaggggcgcggccacgtgaagctgagccggggctccgaggtcgtgctggacgcctgcgacagctcctgcgagatcatgatcccgaaggggaccggcgacatcctcgtggactgcagcgggggccagcagcacttcctgaaggacaacctgatcgacctcggctgcccccacatccccctgctggggaagatggccatccacatctgccgcatgtccaaccacccccggacgaccatggcgttcctcttctggttcagcttcggctacgtcatcacgtgcatcttctgcaaggccctgttctactccctgatcatcatcgggaccctcggcaagaagatcaagcagtaccgcgagctgaagccgcagacctgcacgatctgcgagaccgcccccgtgaacgccatcgacgccgagatgcacgacctgaactgcagctacaacatctgcccctactgcgcgtcccggctcaccagcgacgggctggcccgccacgtgacccagtgccccaagcggaaggagaaggtcgaggagacggagctgtacctcaacctggagcgcatcccgtggatcgtgcggaagctgctccaggtgtccgagagcaccggcgtcgccctgaagcgcagctcctggctgatcgtgctcctggtgctgctcaccgtcagcctgtcccccgtgcagagcgcccccgtgggccacgggaagaccatcgagacgtaccagacccgggagggcttcaccaacatctgcctgttcatgctcgggtccatcctgttcatcgtcagctacctggtgaagggcctcgtggactccgtcagcgactccttcttcccggggctgagcgtgtgcaagacctgctccatcggcagcatcaacggcttcgagatcgagtcccacaagtgctactgcagcctgttctgctgcccctactgccgccactgctccgcggaccgggagatccaccagctccacctggggatctgcaagaagcgcaagacgggcagcaacgtgatgctggccgtctgcaagcggatgtgcttcaaggccaccatcgaggcctcccgccgggccctcctgatccgcagcatcatcaacaccaccttcgtgatctgcatcctgacgctcgcgatctgcgtggtctccaccagcgccgtggagatggagaacctgcccgccgggacctgggagcgcgaggaggacctgaccaacttctgccaccaggagtgccaggtgacggagaccgagtgcctctgcccctacgaggccctggtcctgcggaagcccctgttcctggacagcatcgtgaagggcaccaagaacctgctcaactccaccagcctggagacgtccctgagcatcgaggccccctggggcgcgatcaacgtgcagtccaccttcaagcccaccgtcagcaccgccaacatcgccctctcctggagctccgtggagcaccgcggcaacaagatcctggtgacgggccggagcgagtccatcatgaagctggaggagcgcaccggggtcagctgggacctcggcgtggaggacgcctccgagagcaagctgctgaccgtgtccatcatggacctcagccagatgtactcccccgtcttcgagtacctgagcggggaccgccaggtggaggagtggccgaaggcgacctgcacgggcgactgccccgagcgctgcgggtgcacctcctccacgtgcctgcacaaggagtggccccacagccggaactggcgctgcaaccccacctggtgctggggcgtgggcaccgggtgcacgtgctgcggcgtcgacgtgaaggacctcttcaccgaccacatgttcatcaagtggaaggtggagtacatcaagaccgaggcgatcgtctgcgtggagctgacctcccaggagcggcagtgcagcctgatcgaggccgggacgcgcttcaacctcggcccggtgaccatcaccctgtccgagccccggaacatccagcagaagctgccgcccgagatcatcaccctccacccgaagatcgaggagggcttcttcgacctgatgcacgtccagaaggtgctgagcgcctccacggtgtgcaagctccagagctgcacccacgggatccccggcgacctgcagatctaccacatcgggaacctgctcaagggcgaccgcctgaacgggcacctgatccacaagatcgagccccacttcaacacctcctggatgagctgggacggctgcgacctcgactactactgcaacatgggcgactggccctcctgcacctacacgggggtcacccagcacaaccacgccgcgttcgtgaacctgctgaacatcgagaccgactacaccaagacgttccacttccacagcaagcgggtcaccgcccacggcgacaccccgcagctcgacctgaaggcccgccccacctacggggccggcgagatcacggtgctggtggaggtcgccgacatggagctccacaccaagaaggtggaggtgtccgggctgaagttcgcgagcctggcctgcaccggctgctacgcctgctccagcggcatctcctgcaaggtccggatccacgtggacgagcccgacgagctcaccgtgcacgtcaagagctccgaccccgacgtggtggccgccagcacgtccctgatggcgcgcaagctggagttcgggaccgacagcaccttcaaggccttcagcgccatgccgaagacctccctctgcttctacatcgtcgagcgggagtactgcaagagctgctccgaggacgacacgaagaagtgcgtggacaccaagctggagcagccccagagcatcctgatcgagcacaagggcaccatcatcgggaagcagaacgacacgtgcacggccaaggcctcctgctggctcgagagcgtgaagtccttcttctacggcctgaagaacatgctggggagcgtcttcggcaacttcttcgtgggcatcctcctgttcctggcgcccttcgtgctgctcgtcctgttcttcatcttcgggtggaagatcctgttctgcttcaagtgctgccgccggacccgcggcctcttcaagtaccggcacctgaaggacgacgaggagaccgggtaccgcaagatcatcgagcgcctgaactccaagaagggcaagaaccggctcctggacggcgagcgcctggccgaccggaagatcgccgagctgttcagcaccaagacgcacatcgggtga

SEQ ID NO: 12054 - RNA, 5055 nt, synthetic construct
  misc_feature 1..5055: note = derived and/or modified CDS sequence (opt1) from CCHFV(C-68031)__DQ211629.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtctcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtctccacccagacggtgaaggacacccccatcagcaccacccacacgagcctcccctccaccccgagcgcccccaccacgccccagggcacccaccacaccgcccgcgggctgctgtccgtgaccagcaccaagcccgagggcgcctccacgcaggcgaacccggagaagatcagcatggagaccaacagcccccggctcgccatctccgagaccccctccttcagccccaccacgcaggccccgaccgagaactccaaccccatcaccagcaagcagctgatcctgtccgcccagcccgtcacccccaacccggtgaccccgcccgtgcagcccgcgctcagccagtccgacacgagcaccgccatccaggacatccacccctcccccaccagccgctccaagcggaacctggagatggagatcatcctgaccctcagccaggggctgaagaagtactacggcaagatcctgaagctcctggacctgacgctcgaggaggacaccgaggggctgctggagtggtgcaagcgcaacctcggcctggtctgcgacgacgacttcttccagaagcggatcgaggagttcttcctgaccggcgaggggcacttcaacgaggtgctccagttcaagacccccagcacgctgtcccccaccggcccggcccgcaccgggagccccaccgtggagcccttcaagtcctacttcgccaagggcttcctgagcatggactccggctacttcagcgccaagtgctacccgcgggcgtccaacagcgggctccagctgatcaacgtcacgcagcactccacccgcatcaccgacacccccggccccaaggtgacgaacctgaagaccatcaactgcatcaacctcaaggccagcgtgttcaaggagcaccgggagatcgagatcaacgtcctgctgccccaggtggccgtgaacctctccagctgccacgtcctgatcaagtcccacgtgtgcgactacagcctggacatcgacgggccggtccgcctcccccggatccaccacgagggcaccttcatccccgggacctacaagctggtgatcgacaagaagaacaagcagaacgaccgctgcacgctgatcaccaactgcgtgatcaagggccgggagatccgcaagggccagtccgtcctccggcagtaccgcaccgagatcaagatcgggaaggccagctccggcagccggcgcctgctgagcgaggagtccggggacgactgcatcagccggacccagctgtcccgcacggagaccgccgagatccacagcgacaactacggcgggcccggcgacaagatcaccatctgcaacggctccaccatcgtggaccagcggctcgggagcgagctgggctgctacacgatcaaccgcgtgaagtccttcaagctgtgcgagaacagcgcgaccgggaagtcctgcgagatcgacagcaccccgatcaagtgccgccagggcttctgcctcaagatcacccaggaggggcggggccacgtcaagctgtcccgcggcagcgaggtggtgctggacgcctgcgactccagctgcgagatcatgatccccaaggggacgggcgacatcctcgtcgactgctccgggggccagcagcacttcctgaaggacaacctgatcgacctcggctgccccaacatccccctgctggggaagatggccatctacatctgccggatgagcaaccacccgaagaccaccatggccttcctcttctggttctccttcggctacgtgatcacgtgcatcctgtgcaaggtgatcttctacctgctcatcgtcgtggggaccctgggcaagaagttcaagcagtaccgcgagctgaagccccagacctgcaccatctgcgagaccacccccgtgaacgccatcgacgcggagatgcacgacctcaactgcagctacaacatctgcccctactgcgcctcccggctgacgagcgacgggctggcccgccacgtcatgcagtgcccgaagcggaaggagaaggtggaggagaccgagctctacctgaacctggagcgcatcccctgggtggtccggaagctcctccaggtgagcgagtccaccggcgtggccctgaagcgcagctcctggctcgtcgtgctgctggtgctcctgaccgtcagcctgtcccccgtgcagagcgcccccatcggccacgggaagacggtggagacctaccagacccgggagggctacacctccatctgcctcttcgtcctggggagcatcctgttcatcgtgtcctgcctcatgaagggcctggtggacagcgtcgggaactccttcttcccgggcctgagcatctgcaagacgtgctccatcggcagcatcaacgggttcgagaccgagtcccacaagtgctactgcagcctcttctgctgcccctactgccgccactgctccgcggaccgggagatccacaagctgcacctgagcatctgcaagaagcgcaagaccggctccaacgtgatgctcgccgtgtgcaagcggatgtgcttccgcgccaccgtcgaggtgagcaacaaggccctgctgatccggaacatcatcaacacgaccttcgtggtctgcatcctcatcctggcggtgtgcgtggtcagcacctccgccgtggagatggagagcctgcccgccgggacctgggagcgcgaggaggacctcacgaacttctgccaccaggagtgccaggtgaccgagaccgagtgcctgtgcccctacgaggccctggtcctccggaagccgctgttctccgacagcatcgtgaagggcatgaagaacctgctcaactccaccagcctggagacgtccctgagcatcgaggccccctggggcgcgatcaacgtgcagtccaccttcaagcccaccgtcagcgccgccaacatcgccctctcctggagctccgtggagcaccgcgggaacaagatcctggtgagcggccgctccgagagcatcatgaagctggaggagcggaccgggatctcctgggacctcggcgtcgaggacgccagcgagtccaagctgctgacggtgagcatcatggacctcagccagatgtactccccggtgttcgagtacctgagcggggaccgccaggtcgaggagtggcccaaggcgacctgcaccggcgactgccccgagcggtgcgggtgcacctccagcacgtgcctgcacaaggagtggccccactcccgcaactggcggtgcaacccgacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgaccagccaggagcgccagtgctccctcatcgaggccgggacccggttcaacctgggccccgtgacgatcaccctgagcgagccccgcaacatccagcagaagctgcccccggagatcgtcaccctgcacccccggatcgaggagggcttcttcgacctgatgcacgtgaagaaggtgctctccgccagcaccgtctgcaagctgcagtcctgcacccacggggtgcccggcgacctccaggtgtaccacatcgggaacctgctgaagggcgacaaggtcaacgggcacctgatccacaagatcgagccccacttcaacacgagctggatgtcctgggacggctgcgacctcgactactactgcaacatgggcgactggccgagctgctcctacaccggggtgacccagcacaaccacgccgcgttcgtgaacatgctgaacatcgagaccgactacacgaagatcttccacttccacagcaagcgcgtcaccgcccacggcgacacgccccagctggacctcaaggcccggcccacctacggggccggcgagatcaccgtgctggtggaggtcgcggacatggagctgcacaccaagaagatcgagatctccgggctcaagttcgccagcctgacctgcaccggctgctacgcctgctccagcggcatcagctgcaaggtgcgcatccacgtggacgagcccgacgagctgacggtccacgtgaagtccgaggacccggacatcgtggccgccagctccagcctcatggcgcggaagctggagttcgggaccgactccaccttcaaggccttcagcgccatgcccaagacctccctgtgcttctacatcgtcgagcgcgagtactgcaagagctgctccaaggaggacacgcagaagtgcgtgaacaccaagctcgagcagccccagagcatcctgatcgagcacaagggcaccatcatcgggaagcagaacgacacgtgcacctccaaggccggctgctggctggagagcgtgaagtccttcttctacgggctgaagaacatgctcagcggcatcttcggcaacgtcttcatcgggatcttcctgttcctggcccccttcatcctcctgatcctgttcttcatgttcggctggcggatcctcttctgcttcaagtgctgccgccggacccgcgggctgttcaagtaccggcacctgaaggacgacgaggagaccggctaccgcaagatcatcgagcggctcaacaacaagaagggcaagaacaagctgctggacggggagcgcctcgcggaccgcaagatcgccgagctgttctccaccaagacgcacatcggctga

SEQ ID NO: 12055 - RNA, 5052 nt, synthetic construct
  misc_feature 1..5052: note = derived and/or modified CDS sequence (opt1) from CCHFV(K340_6)__KX013475.1__GP
  source 1..5052: mol_type = other RNA
atgcacaccctgctcgtgtgcttcatcctgtacctgcagctcagcggcctcgggggcgcccacgtccagtccaacgccaccgagcacaacgggacgaacaccaccaccgcgcccggcacgagccagtccccgaagccgcccgccagcaccaccctgccccacacccccgagtccagcacggtgaagcccaccacccccacctccgagacggaggggagcggcgagaccacgcccccgcccaacaccacccagggcctgccgcccaccgggaccacccccgagcgctccgccacgaccgccaccagcacctccagcacggacaacatgaactccaccacccaggtgaccgacagcacgcccacctccaccgtcagcacctcccccagctccagcagctccatgcccagcacgtcccagggcatccaccacccggtgcggagcctgctgtccgtgagctcccccaagaccgtcaccacccccacgcccatgagcccgggggagatgtcccccgagaccagctcccagcacagcgccatgtcccgcgtgcccaccctctacaccgcgacccaggtgagcacggagaacaccgaccggtccacgccccgccagagcgagtccagcgtccagccggccacccagtcccccatcaccagccccgcccagaccatcctgctgatgagcgccgcgcccaaggccatccaggacatgcacccgtcccccaccaaccggagcaagcgcaacctcgaggtggagatcatcctgaccctgtcccagggcctcaagaagtactacgggaagatcctgaagctgctccacctgacgctggaggaggacaccgagggcctcctggagtggtgcaagcggaacctgggcagcaactgcgacgacgacttcttccagaagcgcatcgaggagttcttcatcaccggggagggctacttcaacgaggtgctccagttcaagaccctgtccacgctgagccccaccgagccgtcccacgtccggctccccaccgccgagcccttcaagagctacttcgccaaggggttcctgtccatcgacagcggctacttctccgccaagtgctacccccgcagctccaccagcggcctgcagctcatcaacgtgacgcagcacccggcgcggatcgccgagacccccgggcccaagaccacctccctgaagacgatcaactgcatcaacctgcgcgccagcgtgttcaaggagcaccgggaggtcgagatcaacgtgctcctgccccagatcgccgtgaacctgtccaactgccacgtcgtgatcaacagccacgtgtgcgactacagcctcgacaccgacggcccggtccgcctgccccggatccaccacgaggggaccttcatccccggcacctacaagatcgtgatcgaccgcaagaacaagctgaacgaccggtgctccctcgtgacgaactgcgtcatcaaggggcgcgaggtgcggaagggccagagcgtcctgcgccagtacaagaccgagatcaagatcggcaaggcctccaccgggagccggaagctgctctccgaggagcccggcgacgactgcatcagccgcacccagctgctgaagacggagaccgcggagatccacgacgacaactacgggggcccgggggacaagatcaccatctgcaacggctccaccatcgtggaccagcgcctcggcagcgagctggggtgctacacgatcaaccgggtgaagtccttcaagctgtgcgagaacagcaccaccggcaagacctgcgagatcgactccacgcccgtcaagtgccgccaggggttctgcctcaagatcacccaggagggccgggggcacgtgaagctgagccgcggctccgaggtggtcctggacgcctgcgacagctcctgcgagatcatgatccccaagggcaccggggacatcctggtggactgcagcggcgggcagcagcacttcctcaaggacaacctgatcgacctgggctgcccccacatcccgcccctcggcaagatggccatctacatctgccggatgtccaaccacccccgcaccaccatggccttcctgttctggttcagcttcgggtacgtgatcacgtgcatcttctgcaaggccctgttctactccctcatcatcatcggcaccctggggaagaagatcaagcagtaccgggagctgaagccccagacctgcaccatctgcgagacggcgccggtcaacgccatcgacgccgagatgcacgacctcaactgcagctacaacatctgcccctactgcgccagccgcctgacctccgacggcctggcccggcacgtgacccagtgccccaagcgcaaggagaaggtggaggagaccgagctctacctgaacctggagcggatcccctggatcgtccgcaagctcctccaggtgagcgagtccacgggggtggcgctgaagcggagctcctggctgatcgtcctgctggtgctcctgaccgtgagcctgtccccggtccagagcgcccccgtgggccacggcaagaccatcgagacctaccagacgcgcgaggggttcacctccatctgcctcttcatgctgggcagcatcctgttcatcgtgtcctgcctcgtcaaggggctggtggacagcgtgtccgacagcttcttccccggcctgtccgtctgcaagacctgcagcatcgggtccatcaacggcttcgagatcgagagccacaagtgctactgctccctcttctgctgcccgtactgccggcactgcagcgccgaccgcgagatccaccagctgcacctgagcatctgcaagaagcggaagaccggctccaacgtgatgctcgccgtgtgcaagcgcatgtgcttcaaggcgacgatcgaggccagccggcgcgccctgctgatccgctccatcatcaacaccaccttcgtcatgtgcatcctcaccctggccatctgcgtggtgagcacgtccgccgtcgagatggaggacctgcccgcggggacctgggagcgggaggaggacctcaccaacttctgccaccaggagtgccaggtgaccgagacggagtgcctgtgcccctacgaggccctggtgctccgcaagcccctgagcctggactccatcgtcaagggcatgaagaacctcctgaacagcacctccctggagaccagcctctccatcgaggccccgtggggcgccatcaacgtgcagagcaccttcaagcccacggtgtccaccgccaacatcgcgctgagctggtccagcgtcgagcaccgggggaacaagatcctggtgaccgggcgctccgagagcatcatgaagctcgaggagcggaccggcgtgtcctgggacctgggcgtcgaggacgccagcgagagcaagctgctcacggtgtccatcatggacctgagccagatgtactcccccgtgttcgagtacctgagcggggaccgccaggtcgaggagtggcccaaggcgacctgcaccggcgactgcccggagcggtgcgggtgcacctccagcacgtgcctccacaaggagtggccccactcccgcaactggcggtgcaaccccacctggtgctggggcgtggggaccggctgcacgtgctgcggcgtggacgtcaaggacctgttcaccgaccacatgttcatcaagtggaaggtggagtacatcaagaccgaggccatcgtgtgcgtcgagctgaccagccaggagcgccagtgctccctcatcgaggccgggacccggttcaacctgggccccgtgaccatcacgctgagcgagccgcgcaacatccagcagaagctcccgcccgagatcatcaccctgcaccccaagatcgaggaggggttcttcgacctgatgcacgtgcagaaggtcctctccgccagcaccgtgtgcaagctgcagtcctgcacccacggcatccccggcgacctgcagatctaccacatcgggaacctcctgaagggcgaccgggtcaacgggcacctgatccacaagatcgagccccacttcaacacgagctggatgtcctgggacggctgcgacctcgactactactgcaacatgggggactggcccagctgcacctacaccggcgtgacccagcacaaccacgccgccttcgtgaacctgctgaacatcgagacggactacaccaagaccttccacttccactccaagcgcgtcaccgcccacggcgacacgccccagctcgacctgaaggcgcggccgacctacggggccggcgagatcaccgtgctggtggaggtcaccgacatggagctccacacgaagaaggtggagatcagcgggctgaagttcgcctccctgacctgcaccggctgctacgcctgcagcagcgggatctcctgcaaggtgcgcatccacgtcgacgagcccgacgagctcaccgtgcacgtcaagagctccgaccccgacgtggtggccgcgagcacgtccctgatggcccggaagctggagttcggcaccgacagcaccttcaaggccttctccgccatgcccaagaccagcctctgcttctacatcgtggagcgcgagtactgcaagtcctgcagcgaggacgacacgaagaagtgcgtcgacaccaagctggagcagccgcagtccatcctgatcgagcacaagggcaccatcatcgggaagcagaacgacacgtgcaccgccaaggcgagctgctggctcgagtccgtcaagagcttcttctacggcctgaagaacatgctggggtccgtgttcggcagcttcttcgtggggatcctcctgttcctggcccccttcgtgctcctggtgctgttcttcatgttcggctggaagatcctgttctgcttcaagtgctgccggcgcacccggggcctcttcaagtaccgccacttcaaggacgacgaggagaccgggtaccgccggatcatcgagcgcctgaactccaagaagggcaagaaccggctgctcgacggggagcgcctggccgaccggaagatcgccgagctgttcagcaccaagacgcacatcggctga

SEQ ID NO: 12056 - RNA, 5055 nt, synthetic construct
  misc_feature 1..5055: note = derived and/or modified CDS sequence (opt1) from CCHFV(Hy13)__AY900145.1__GP
  source 1..5055: mol_type = other RNA
atgtacacgcccctgctctgcgccgtgctgtgcctgcagctctggagcctggagggctcccacgggctgagcaacaagacccagcactccaacaccagcaccaccaaggccccggaggtgtcccaggagttcggcctccccgtgagcaccgtgtccacgatcaccagcgacccgccctccatcaccagcgcggtctccgtgagcgggtccgagggcagcggggacaccaacacgtcccccagcgtgaccacccagggcctgaccctgcccgagacgaccctcgagctgctgaccaccacggacaccgacgcctccagcaccgtcgtggtggacgtctccacccagacggtgaaggacacccccatcagcaccacccacacgagcctcccctccaccccgagcgccaccaccacgccccagggcacccaccacaccgcccgcgggctgctgtccgtgaccagcacgaagcccgagggcgcctccacccaggcgaaccccgagaagatcagcatggagaccaactccccgcggctcgccatcagcgagaccccctccttcagccccacgacccaggcccccaccgagaactccaacccgatcaccagcaagcagctgatcttctccgcccagcccgtcacccccaaccccgtgacgccgcccgtgcagcccgcgctgagccagtccgacaccagcaccgccatccaggacatccacccctccccgaccagccgctccaagcggaacctcgagatggagatcatcctgacgctgagccaggggctcaagaagtactacggcaagatcctgaagctgctcgacctgaccctggaggaggacaccgaggggctcctggagtggtgcaagcgcaacctgggcctcgtctgcgacgccgacttcttccagaagcggatcgaggagttcttcctgaccggcgaggggcacttcaacgaggtgctgcagttcaagacgcccagcaccctctcccccaccggccccgcccgcaccgggagcccgacggtggagcccttcaagtcctacttcgccaagggcttcctgagcatggactccggctacttcagcgcgaagtgctacccccgggcctccaacagcgggctgcagctcatcaacgtcacccagcactccacccgcatcaccgacacgccgggccccaaggtgaccaacctgaagaccatcaactgcatcaacctgaaggccagcgtgttcaaggagcaccgggagatcgagatcaacgtcctcctgccccaggtggccgtgaacctgtccagctgccacgtcctcatcaagtcccacgtgtgcgactacagcctggacatcgacgggcccgtccgcctgccgcggatccaccacgagggcaccttcatccccgggacgtacaagctcgtgatcgacaagaagaacaagcagaacgaccgctgcaccctgatcaccaactgcgtgatcaagggccgggagatccgcaagggccagtccgtcctgcggcagtaccgcaccgagatcaagatcgggaaggccagctccggcagccggcgcctcctgagcgaggagtccggggacgactgcatcagccggacgcagctgtcccgcaccgagaccgcggagatccacagcgacaactacggcgggcccggcgacaagatcaccatctgcaacggctccacgatcgtggaccagcggctggggagcgagctcggctgctacaccatcaaccgcgtgaagtccttcaagctgtgcgagaacagcgccaccgggaagtcctgcgagatcgacagcacccccatcaagtgccgccagggcttctgcctgaagatcacgcaggaggggcggggccacgtcaagctctcccgcggcagcgaggtggtgctggacgcctgcgactccagctgcgagatcatgatcccgaaggggaccggcgacatcctggtcgactgctccgggggccagcagcacttcctcaaggacaacctgatcgacctgggctgccccaacatccccctcctggggaagatggccatctacatctgccggatgagcaaccaccccaagaccaccatggccttcctgttctggttctccttcggctacgtgatcacgtgcatcctctgcaaggtgatcttctacctgctgatcgtcgtggggaccctcggcaagaagttcaagcagtaccgcgagctgaagccgcagacctgcaccatctgcgagaccacgcccgtgaacgcgatcgacgccgagatgcacgacctgaactgcagctacaacatctgcccctactgcgcctcccggctcaccagcgacgggctggcccgccacgtcatgcagtgccccaagcggaaggagaaggtggaggagaccgagctgtacctcaacctggagcgcatcccgtgggtggtccggaagctgctccaggtgagcgagtccaccggcgtggccctgaagcgcagctcctggctggtcgtgctcctggtgctgctcacggtcagcctgtcccccgtgcagagcgcgcccatcggccacgggaagaccgtggagacctaccagacccgggagggctacacgtccatctgcctgttcgtcctcgggagcatcctgttcatcgtgtcctgcctgatgaagggcctcgtggacagcgtcgggaactccttcttccccggcagctccatctgcaagacctgcagcatcggctccatcaacgggttcgagatcgagagccacaagtgctactgctccctgttctgctgcccgtactgccgccactgcagcgccgaccgggagatccacaagctgcacctctccatctgcaagaagcgcaagaccggcagcaacgtgatgctggccgtgtgcaagcggatgtgcttccgcgccaccgtcgaggtgagcaacaaggcgctgctcatccggaacatcatcaacacgaccttcgtggtctgcatcctgatcctggccgtgtgcgtggtctccaccagcgccgtggagatggagtccctccccgccgggacctgggagcgcgaggaggacctgacgaacttctgccaccaggagtgccaggccaccgagaccgagtgcctgtgcccctacgaggcgctcgtgctgcggaagcccctgttcagcgactccatcgtcaagggcatgaagaacctcctgaacagcacctccctggagacgagcctctccatcgaggccccgtggggcgccatcaacgtgcagagcaccttcaagcccaccgtgtccgccgccaacatcgcgctgagctggtccagcgtcgagcaccgcgggaacaagatcctggtgtccggccgcagcgagtccatcatgaagctcgaggagcggaccgggatcagctgggacctgggcgtggaggacgcctccgagagcaagctgctcacggtcagcatcatggacctgtcccagatgtacagccccgtgttcgagtacctgtccggggaccgccaggtggaggagtggccgaaggcgacctgcaccggcgactgccccgagcggtgcgggtgcaccagctccacgtgcctccacaaggagtggccccacagccgcaactggcggtgcaaccccacctggtgctggggcgtcggcaccgggtgcacgtgctgcggcctggacgtgaaggacctgttcaccgaccacatgttcgtcaagtggaaggtggagtacatcaagaccgaggccatcgtgtgcgtcgagctcacctcccaggagcgccagtgcagcctgatcgaggccgggacccggttcaacctgggcccggtgacgatcaccctctccgagccccgcaacatccagcagaagctgccgcccgagatcgtgaccctgcacccccggatcgaggagggcttcttcgacctcatgcacgtcaagaaggtgctgagcgcctccaccgtgtgcaagctgcagagctgcacccacggggtccccggcgacctccaggtgtaccacatcgggaacctgctgaagggcgacaaggtgaacgggcacctcatccacaagatcgagccccacttcaacacgtcctggatgagctgggacggctgcgacctggactactactgcaacatgggcgactggccctcctgcagctacaccggggtcacccagcacaaccacgccgccttcgtgaacatgctgaacatcgagaccgactacacgaagatcttccacttccactccaagcgcgtgaccgcccacggcgacaccccgcagctcgacctgaaggcgcggcccacctacggggccggcgagatcacggtcctggtggaggtggccgacatggagctccacaccaagaagatcgagatcagcgggctgaagttcgcctccctgacctgcaccggctgctacgcctgcagcagcggcatctcctgcaaggtccgcatccacgtggacgagcccgacgagctcacggtgcacgtcaagagcgaggaccccgacatcgtggcggcctccagctccctgatggcccggaagctggagttcgggaccgacagcaccttcaaggccttctccgccatgccgaagaccagcctctgcttctacatcgtggagcgcgagtactgcaagtcctgcagcaaggaggacacgcagaagtgcgtcaacaccaagctggagcagccccagtccatcctgatcgagcacaagggcaccatcatcgggaagcagaacgacacgtgcaccagcaaggcgggctgctggctcgagtccgtcaagagcttcttctacgggctgaagaacatgctgtccggcatcttcggcaacgtgttcatcgggatcttcctgttcctcgcccccttcatcctgctgatcctcttcttcatgttcggctggcggatcctgttctgcttcaagtgctgccgccggacccgcgggctgttcaagtaccggcacctcaaggacgacgaggagaccggctaccgcaagatcatcgagcggctgaacaacaagaagggcaagaacaagctgctcgacggggagcgcctggccgaccgcaagatcgccgagctgttcagcaccaagacgcacatcggctga

SEQ ID NO: 12057 - RNA, 5052 nt, synthetic construct
  misc_feature 1..5052: note = derived and/or modified CDS sequence (opt1) from CCHFV(4574-ST-2008)__KR814870.1__GP
  source 1..5052: mol_type = other RNA
atgcacaccctgctcgtgtgcttcatcctgtacctgcagctcctgggccccgggggcgcccacgggcagccgaacgccaccgagcacaaccgcacgaacaccaccaccgcgcccagcacgtcccagagccccaagcccccggtctccaccgccccgccccacgccctggagagccccaccatcaagtccaccacgcccaccagcgagaccgagggctccggggagaccacgagcccgcccaacaccacccagggcccctccctccccgagaccacgcccaagcggcccgccaccaccgccaccagcacgccctccaccgacaacaccaacagcaccacgcacgtgaccgacaacaacccgacctccaccatcagcacgtcccccagctccagcccctccacccccagcaccccgcgcggcatccaccaccccgcgcggaacctgctgagcgtgtccagccccaagaccgccacgacccccaccccgacctcccccggggagatcagctccgagacgagctccctccacagcgccatgtcccgcaccagcaccctgtacaccgccacccaggcgtccacggagaacgccaaccacagcgcgccccggcagtccgagagccccgcccagccgaccaccacctccctgatgacgagccccgcccagtccatcctcgtcatgagcgccgcccccaccgccatccagaacatccacccgtcccccaccaaccgcagcaagcggaacctggagatggagatcatcctgaccctcagccagggcctgaagaagtactacgggaagatcctgaagctcctgcacctgacgctcgaggaggacaccgagggcctgctggagtggtgcaagcgcaacctcgggtccaactgcgaggacgacttcttccagaagcggatcgaggagttcttcatgaccggcgagggctacttcaacgaggtgctgcagttcaagaccctgagcacgctctcccccaccgagcccagccacgcccgcccgcccaccgtggagcccttcaagtcctacttcgccaaggggttcctgagcatcgactccggctacttcagcgcgaagtgctacccccggtccagcacctccgggctgcagctcatcaacgtcacgcagcacccggcccgcatcgccgagacccccggccccaagaccaccagcctgaagacgatcaactgcatcaacctgcgggcctccgtgttcaaggagcaccgcgagatcgagatcaacgtgctcctgccccagatcgccgtcaacctgagcaactgccacgtggtgatcaactcccacgtctgcgactacagcctcgacaccgacggcccggtgcggctgccccacatctaccacgaggggaccttcatccccggcacctacaagatcgtgatcgacaagaagaacaagctgaacgaccgctgcacgctcgtcaccaactgcgtgatcaaggggcgggaggtgcgcaagggccagtccgtcctgcggcagtacaagaccgagatcaagatcgggaaggtgagcaccggcagccgcaagctgctctccgaggagagcggcgacgactgcatctcccggacgcagctgctgcgcaccgagaccgcggagatccacgacgacaactacgggggccccggggacaagatcaccatctgcaacggcagcacgatcgtggaccagcgcctcgggtccgagctgggctgctacaccatcaaccgggtcaagagcttcaagctgtgcgagaactccgccaccggcaagacctgcgagatcgacagcacgccggtgaagtgccgccaggggttctgcctcaagatcacccaggagggccgggggcacgtgaagctgtcccgcggcagcgaggtcgtgctggacgcctgcgactccagctgcgaggtcatgatccccaaggggaccggcgacatcctggtggactgctccggcgggcagcagcacttcctcaaggacaacctgatcgacctgggctgcccccacatccccctcctggggaagatggccatctacatctgccggatgagcaaccacccgcgcaccaccatggccttcctgttctggttctccttcggctacgtgatcacgtgcctcttctgcaaggcgctgttctacagcctgatcatcatcggcaccctcgggaagaagatcaagcagtaccgggagctgcgcccccagacctgcaccatctgcgagacggcccccgtcaacgccatcgacgccgagatgcacgacctgaactgctcctacaacatctgcccctactgcgcgagccggctcacctccgacggcctggcccgccacgtgccgcagtgccccaagcggaaggagaaggtggaggagaccgagctgtacctcaacctggagcgcatcccctggatcgtccggaagctgctccaggtgagcgagagcaccggggtggccctgaagcgctccagctggctgatcgtcctcctggtgctgctcacggtgtccctgagcccggtccagtccgcccccgtgggccacgggaagaccatcgagacctaccagacccgggagggcttcacgagcatctgcctgttcatgctcggctccatcctgttcctggtgagctgcctcgtcaaggggctggtggactccgtgagcgactccttcttccccggcctgagcgtctgcaagacctgctccatcgggagcatcaacggcttcgagatcgagtcccacaagtgctactgcagcctcctgtgctgcccctactgccgccactgctccgccgaccgggagatccaccagctgcacctcagcatctgcaagaagcgcaagaccgggtccaacgtgatgctggcggtgtgcaagcggatgtgcttccgcgccaccatcgaggccagccgccgggccctgctcatccgcagcatcatcaacacgaccttcgtcatctgcatcctgaccctgaccatctgcgtggtgtccacgagcgccgtcgagatggagaacctcccgtccggcacctgggagaaggaggaggacctgaccaacttctgccaccaggagtgccaggtgaccgagacggagtgcctgtgcccctacgaggcgctcgtgctgcggaagcccctgttcctcgacagcatcgtcaagggcatgaagaacctgctgaactccaccagcctcgagacctccctgagcatcgaggccccctggggcgccatcaacgtgcagtccaccttcaagccgacggtgagcaccgccaacatcgccctgtcctggagctccgtcgagcaccgcgggaacaagatcctcgtgaccgggcggagcgagtccatcatgaagctggaggagcgcaccggcgtgagctgggacctgggggtcgaggacgcgtccgagagcaagctcctgacggtgtccatcatggacctgagccagatgtacagccccgtgttcgagtacctctccggcgaccggcaggtcgaggagtggcccaaggcgacctgcaccggcgactgccccgagcgctgcgggtgcaccagctccacgtgcctgcacaaggagtggccgcacagccggaactggcgctgcaaccccacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcacctcccaggagcggcagtgcagcctgatcgaggccggcacccgcttcaacctgggccccgtgaccatcacgctctccgagccccggaacatccagcagaagctgccgcccgagatcatcaccctgcaccccaaggtcgaggaggggttcttcgacctcatgcacgtgcagaaggtgctgagcgcctccaccgtctgcaagctgcagagctgcacccacggcatccccggggacctccaggtgtaccacatcggcaacctgctgaagggcgaccgcgtgaacgggcacctcatccacaagatcgagccgcacttcaacacgtcctggatgagctgggacggctgcgacctggactactactgcaacatgggggactggccctcctgcacctacaccggcgtcacccagcacaaccacgccgccttcgtgaacctgctcaacatcgagacggactacaccaagaccttccacttccacagcaagcgggtcaccgcccacggggacacgccccagctggacctgaaggcccgccccacctacggcgcgggcgagatcaccgtgctcgtggaggtcgccgacatggagctgcacaccaagaaggtggagatctccgggctgaagttcgccagcctcgcctgcacgggctgctacgcctgctccagcgggatctcctgcaaggtgcggatccacgtcgacgagccggacgagctgaccgtgcacgtcaagagcagcgaccccgacgtggtggcggcctccaccagcctgatggcccgcaagctcgagttcggcaccgactccacgttcaaggccttcagcgccatgcccaagacctccctgtgcttctacatcgtggagcgggagtactgcaagagctgctccgaggaggacacccagaagtgcgtcgacaccaagctggagcagccccagagcatcctcatcgagcacaaggggacgatcatcggcaagcagaacgacacgtgcaccgcgaaggcctcctgctggctggagagcgtgaagtccttcttctacggcctgaagaacatgctcgggagcgtgttcggcaacttcttcatcgggatcctgctgttcctggccccgttcgtcctcctggtgctgttcttcatgttcggctggaagatcctcttctgcttcaagtgctgccgccgggcccgcgggctgctgaagtaccgccacctcaaggacgacgaggagaccggctaccggaagatcatcgagcgcctgaacaacaagaagggcaagaaccggctgctcgacggggagcgcctggcggaccggaagatcgccgagctgttctccaccaagacccacatcggctga

SEQ ID NO: 12058 - RNA, 5052 nt, synthetic construct
  misc_feature 1..5052: note = derived and/or modified CDS sequence (opt1) from CCHFV(75-ST-2010)__KR814864.1__GP
  source 1..5052: mol_type = other RNA
atgcacaccctgctcgtgtgcttcatcctgtacctgcagctcctgggccccgggggcgcccacgggcagccgaacgccaccgagcacaaccgcacgaacaccaccaccgcgcccagcacgtcccagagccccaagcccccggtctccaccgccccgccccacgccctggagagccccaccatcaagtccaccacgcccaccagcgagaccgagggctccggggagaccacgcccccgcccaacaccacccagggccccagcctccccgagaccacgcccgagcggcccgccaccaccgccacctccacgccgagcaccgacaacaccaactccaccacgcacgtgaccgacaacaaccccaccagcaccatctccacgagcccctccagctcccccagcaccccgtccacgccccgcggcatccaccaccccgcgcggaacctgctgagcgtgagctcccccaagaccgccaccaccccgacccccaccagccccggggagatctccagcgagacgtccagcctccactccgccatgagccgcacctccaccctgtacaccgccacccaggcgagcacggagaacgccaaccactccgcgccccggcagagcgagtccccggcccagcccaccaccaccagcctgatgacgtcccccgcccagagcatcctcgtcatgtccgccgccccgaccgccatccagaacatccaccccagccccaccaaccgctccaagcggaacctggagatggagatcatcctgaccctcagccagggcctgaagaagtactacgggaagatcctgaagctcctgcacctgacgctcgaggaggacaccgagggcctgctggagtggtgcaagcgcaacctcgggagcaactgcgacgacgacttcttccagaagcggatcgaggagttcttcatgaccggcgagggctacttcaacgaggtgctgcagttcaagaccctgtccacgctcagccccaccgagccgtcccacgcccgcccgcccaccgtggagcccttcaagagctacttcgccaaggggttcctgtccatcgacagcggctacttctccgcgaagtgctacccccggagctccaccagcgggctgcagctcatcaacgtcacgcagcaccccgcccgcatcgccgagacccccggccccaagaccacctccctgaagacgatcaactgcatcaacctgcgggccagcgtgttcaaggagcaccgcgagatcgagatcaacgtgctcctgccgcagatcgccgtcaacctgtccaactgccacgtggtgatcaacagccacgtctgcgactactccctcgacaccgacggccccgtgcggctgccccacatctaccacgaggggaccttcatccccggcacctacaagatcgtgatcgacaagaagaacaagctgaacgaccgctgcacgctcgtcaccaactgcgtgatcaaggggcgggaggtgcgcaagggccagagcgtcctgcggcagtacaagaccgagatcaagatcgggaaggtgtccaccggcagccgcaagctgctcagcgaggagtccggcgacgactgcatcagccggacgcagctgctgcgcaccgagaccgcggagatccacgacgacaactacgggggcccgggggacaagatcaccatctgcaacggctccacgatcgtggaccagcgcctcgggagcgagctgggctgctacaccatcaaccgggtcaagtccttcaagctgtgcgagaacagcgccaccggcaagacctgcgagatcgactccacgcccgtgaagtgccgccaggggttctgcctcaagatcacccaggagggccgggggcacgtgaagctgagccgcggctccgaggtcgtgctggacgcctgcgacagctcctgcgaggtcatgatccccaaggggaccggcgacatcctggtggactgcagcggcgggcagcagcacttcctcaaggacaacctgatcgacctgggctgcccccacatcccgctcctggggaagatggccatctacatctgccggatgtccaaccacccccgcaccaccatggccttcctgttctggttcagcttcggctacgtgatcacgtgcctcttctgcaaggcgctgttctactccctgatcatcatcggcaccctcgggaagaagatcaagcagtaccgggagctgcgcccccagacctgcaccatctgcgagacggcccccgtcaacgccatcgacgccgagatgcacgacctgaactgcagctacaacatctgcccgtactgcgcgtcccggctcaccagcgacggcctggcccgccacgtgccccagtgccccaagcggaaggagaaggtggaggagaccgagctgtacctcaacctggagcgcatcccgtggatcgtccggaagctgctccaggtgtccgagagcaccggggtggccctgaagcgcagctcctggctgatcgtcctcctggtgctgctcacggtgagcctgtcccccgtccagagcgcccccgtgggccacgggaagaccatcgagacctaccagacccgggagggcttcacgtccatctgcctgttcatgctcggcagcatcctgttcctggtgtcctgcctcgtcaaggggctggtggacagcgtgtccgacagcttcttccccggcctgtccgtctgcaagacctgcagcatcgggtccatcaacggcttcgagatcgagagccacaagtgctactgctccctcctgtgctgcccgtactgccgccactgcagcgccgaccgggagatccaccagctgcacctctccatctgcaagaagcgcaagaccgggagcaacgtgatgctggcggtgtgcaagcggatgtgcttccgcgccaccatcgaggcctcccgccgggccctgctcatccgcagcatcatcaacacgaccttcgtcatctgcatcctgaccctgaccatctgcgtggtgagcacgtccgccgtcgagatggagaacctccccagcggcacctgggagaaggaggaggacctgaccaacttctgccaccaggagtgccaggtgaccgagacggagtgcctgtgcccctacgaggcgctcgtgctgcggaagcccctgttcctcgactccatcgtcaagggcatgaagaacctgctgaacagcacctccctcgagaccagcctgtccatcgaggccccgtggggcgccatcaacgtgcagagcaccttcaagcccacggtgtccaccgccaacatcgccctgagctggtccagcgtcgagcaccgcgggaacaagatcctcgtgaccgggcggtccgagagcatcatgaagctggaggagcgcaccggcgtgtcctgggacctgggggtcgaggacgcgagcgagtccaagctcctgacggtgagcatcatggacctgtcccagatgtacagccccgtgttcgagtacctcagcggcgaccggcaggtcgaggagtggcccaaggcgacctgcaccggcgactgcccggagcgctgcgggtgcacctccagcacgtgcctgcacaaggagtggccccactcccggaactggcgctgcaaccccacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcaccagccaggagcggcagtgctccctgatcgaggccggcacccgcttcaacctgggccccgtgaccatcacgctcagcgagccgcggaacatccagcagaagctgccgcccgagatcatcaccctgcaccccaaggtcgaggaggggttcttcgacctcatgcacgtgcagaaggtgctgtccgccagcaccgtctgcaagctgcagtcctgcacccacggcatccccggggacctccaggtgtaccacatcggcaacctgctgaagggcgaccgcgtgaacgggcacctcatccacaagatcgagccccacttcaacacgagctggatgtcctgggacggctgcgacctggactactactgcaacatgggggactggcccagctgcacctacaccggcgtcacccagcacaaccacgccgccttcgtgaacctgctcaacatcgagacggactacaccaagaccttccacttccactccaagcgggtcaccgcccacggggacacgccccagctggacctgaaggcccgcccgacctacggcgcgggcgagatcaccgtgctcgtggaggtcgccgacatggagctgcacaccaagaaggtggagatcagcgggctgaagttcgcctccctcgcctgcacgggctgctacgcctgcagctccgggatcagctgcaaggtgcggatccacgtcgacgagcccgacgagctgaccgtgcacgtgaagtccagcgaccccgacgtcgtggcggccagcacctccctgatggcccgcaagctcgagttcggcaccgacagcacgttcaaggccttctccgccatgcccaagaccagcctgtgcttctacatcgtggagcgggagtactgcaagtcctgcagcgaggaggacacccagaagtgcgtcgacaccaagctggagcagccgcagtccatcctcatcgagcacaaggggacgatcatcggcaagcagaacgacacgtgcaccgcgaaggccagctgctggctggagtccgtcaagagcttcttctacggcctgaagaacatgctcgggtccgtgttcggcaacttcttcatcgggatcctgctgttcctggcccccttcgtgctcctggtgctgttcttcatgttcggctggaagatcctcttctgcttcaagtgctgccgccgggcccgcgggctgctgaagtaccgccacctcaaggacgacgaggagaccggctaccggaagatcatcgagcgcctgaacaacaagaagggcaagaaccggctgctcgacggggagcgcctggcggaccggaagatcgccgagctgttcagcaccaagacccacatcggctga

SEQ ID NO: 12059 - RNA, 5052 nt, synthetic construct
  misc_feature 1..5052: note = derived and/or modified CDS sequence (opt1) from CCHFV(37-R-2013)__KR814858.1__GP
  source 1..5052: mol_type = other RNA
atgcacaccctgctcgtgtgcttcatcctgtacctgcagctcctgggcctcgggggcgcccaccgccagagcaacgccaccgagcacaacgggacgaacaccaccaccgcgccctccacgagccagtccccgaagccgcccgtcagcaccgcgccgccccacgcccccgagacctccaccatcaagcccacgacccccgccagcgagaccgagggctccggggagaccacgcccccgcccaacaccacccagggccccagcccgcccgaggccacccccgagcggcccgccacgaccgtgacctccacccccagcacggacaacaccaactccaccacccacgccacggacaacaaccccaccagcaccatctccaccagcccctccagctcccccagcacgccgtccacgccccagggcatccaccaccccgcccgcaacctcctgagcgtgagctcccccaagaccgccaccaccccgacccccaccagccccggggacatctccagcgagacctccagcctgcactccgcgatgagccggacgcccaccctccacaccgccacccaggcctccaccgagaacgccaaccacagcgccccgcgccagtccgagagctccgcgcagcagacgaccaccagccccatgacctcccccgcccagccgatcctggtcatgagcgccgcccccacggccatccagaacatccacccctcccccaccaaccggagcaagcgcaacctggagatggagatcatcctcaccctgtcccagggcctgaagaagtactacgggaagatcctcaagctgctgcacctcaccctggaggaggacacggagggcctgctcgagtggtgcaagcggaacctggggagcaactgcgacgacgacttcttccagaagcgcatcgaggagttcttcatgaccggcgagggctacttcaacgaggtgctgcagttcaagaccctcagcaccctgtccccgacggagcccagccacgcgcggccgcccaccgtggagcccttcaagtcctacttcgccaaggggttcctgagcatcgactccggctacttcagcgccaagtgctacccccgcctcaccacctccgggctgcagctgatcaacgtcacgcagcaccccgcccggatcgccgagacccccggcccgaagaccaccagcctcaagacgatcaactgcatcaacctgcgcgcgtccgtgttcaaggagcaccgggagatcgagatcaacgtgctgctcccccagatcgccgtcaacctgagcaactgccacgtggtgatcaactcccacgtctgcgactacagcctggacaccgacggccccgtgcgcctcccccacatctaccacgaggggaccttcatcccgggcacctacaagatcgtgatcgacaagaagaacaagctgaacgaccggtgcacgctggtcaccaactgcgtgatcaaggggcgcgaggtgcggaagggccagtccgtcctccgccagtacaagaccgagatcaagatcgggaaggccagcaccggctcccggaagctgctgagcgaggagcccggcgacgactgcatctcccgcacgcagctcctgcggaccgagaccgccgagatccacgacgacaactacgggggccccggggacaagatcaccatctgcaacggcagcacgatcgtggaccagcgcctggggagcgagctcggctgctacaccatcaaccgcgtgaagtccttcaagctgtgcgagaacagcgccaccggcaagacctgcgagatcgactccacgcccgtcaagtgccggcaggggttctgcctgaagatcacccaggagggccgcgggcacgtgaagctcagccggggctccgaggtggtcctggacgcgtgcgacaccagctgcgaggtgatgatcccgaaggggaccggcgacatcctggtcgactgctccggcgggcagcagcacttcctgaaggacaacctcatcgacctgggctgcccccacatccccctgctcgggaagatggccatctacatctgccgcatgagcaaccacccccggaccacgatggccttcctgttctggttctccttcggctacgtgatcacgtgcatcttctgcaaggccctgttctacagcctcatcatcatcggcaccctggggaagaagatcaagcagtaccgcgagctgaagccgcagacctgcaccatctgcgagaccgcgcccgtgaacgccatcgacgccgagatgcacgacctcaactgctcctacaacatctgcccctactgcgccagccggctgacctccgacggcctggcccgccacgtcccgcagtgccccaagcggaaggagaaggtggaggagaccgagctctacctgaacctggagcgcatcccctggatcgtgcggaagctcctgcaggtcagcgagtccacgggggtggcgctgaagcgcagctcctggctcatcgtgctgctggtcctcctgaccgtgagcctgtcccccgtgcagagcgccccggtcggccacgggaagaccatcgagacctaccagacgcgggagggcttcaccagcgtgtgcctcttcatgctgggctccatcctgttcctcgtgagctgcctggtcaaggggctggtggactccgtgagcgactccttcttccccggcctcagcgtctgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtgtgcaagcggatgtgcttccgcgccaccatcgaggcgagccggcgcgccctgctcatccgctccatcatcaacacgaccttcgtcatctgcatcctgaccctgaccatctgcgtggtgagcacgtccgccgtcgagatggagaacctccccagcggcacctgggagcgggaggaggacctgaccaacttctgccaccaggagtgccaggtgaccgagacggagtgcctgtgcccgtacgaggccctcgtgctgcgcaagcccctgttcctcgactccatcgtcaagggcatgaagaacctgctgaacagcaccagcctcgagacctccctgagcatcgaggccccctggggcgcgatcaacgtgcagtccaccttcaagcccacggtgagcaccgccaacatcgccctgtcctggagctccgtcgagcaccgggggaacaagatcctcgtgaccgggcgcagcgagtccatcatgaagctggaggagcggaccggcgtgagctgggacctgggggtcgacgacgcctccgagagcaagctcctgacggtgtccatcatggacctgagccagatgtactccccggtgttcgagtacctcagcggcgaccgccaggtcgaggagtggcccaaggcgacctgcaccggcgactgccccgagcggtgcgggtgcacctccagcacgtgcctgcacaaggagtggccccactcccgcaactggcggtgcaacccgacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcaccagccaggagcgccagtgcagcctgatcgaggccggcacccggttcaacctgggccccgtgaccatcacgctctccgagccccgcaacatccagcagaagctgcccccggagatcatcaccctgcaccccaaggtcgaggaggggttcttcgacctcatgcacgtgcagaaggtgctgagcgcctccaccgtctgcaagctgcagagctgcacccacggcatccccggggacctccaggtgtaccacatcggcaacctgctgaagggcgaccgggtgaacgggcacctcatccacaagatcgagccccacttcaacacgtcctggatgagctgggacggctgcgacctggactactactgcaacatgggggactggccgtcctgcacctacaccggcgtcacccagcacaaccacgccgcgttcgtgaacctgctcaacatcgagacggactacaccaagaccttccacttccacagcaagcgcgtcaccgcccacggggacacgccccagctggacctgaaggcccggcccacctacggcgccggcgagatcaccgtgctcgtggaggtcgccgacatggagctgcacaccaagaaggtggagatctccgggctgaagttcgcgagcctcgcctgcacgggctgctacgcctgctccagcgggatctcctgcaaggtgcgcatccacgtcgacgagcccgacgagctgaccgtgcacgtcaagagcaacgacccggacgtggtggccgcctccaccagcctgatggcgcggaagctcgagttcggcaccgactccacgttcaaggccttcagcgccatgcccaagacctccctgtgcttctacatcgtggagcgcgagtactgcaagagctgcagcgaggaggacacccagaagtgcgtcgacaccaagctggagcagccccagtccatcctcatcgagcacaaggggacgatcatcggcaagcagaacgtgacctgcaccgccaaggcgagctgctggctggagtccgtcaagagcttcttctacggcctgaagaacatgctcgggtccgtgttcggcaacttcttcatcgggatcctgctgttcctcgccccgttcgtgctgctggtgctgttcttcatgttcggctggaagatcctcttctgcttcaagtgctgccggcgcacccgggggctgctgaagtaccgcctcctgaaggacgacgaggagacgggctaccgccggatcatcgagcgcctgaacaacaagaagggcaagaaccggctcctggacggggagcgcctggccgaccggaagatcgccgagctgttcagcaccaagacccacatcggctga

SEQ ID NO: 12060 - RNA, 5052 nt, synthetic construct
  misc_feature 1..5052: note = derived and/or modified CDS sequence (opt1) from CCHFV(Kashmanov)__DQ211631.1__GP
  source 1..5052: mol_type = other RNA
atgcacaccctgctggtgtgcttcatcctgtacctgcagctgctgggcctcggcggggcccacgggcagtccaacgccaccgagcacaacgggaccaacaccaccaccgccccctccaccagccagtccccgaagcccctcgtcagcaccgccccgccccacgccctggagtccagcaccatcaagcccaccacccccgcctccgagaccgaggggagcggcgagaccacgccgccgcccaacaccacccagggccccagcccgcccgagaccacccccgagcgccccgccaccaccgccaccagcaccccctccaccgacaacaccaacagcaccacccacgtgacggacaacaaccccacctccaccatcagcacctccccgagctccagcccctccacgcccagcacgccccaggggatccaccacccggcccggaacctgctcagcgtgtccagccccaagaccgccaccacgcccacccccacctccccgggcgagatcagctccgaggccagctccctgcacagcgcgatgtcccgcaccagcacgctgtacaccgccacccaggtctccaccgagaacgccaaccacagcgcgccccggcagtccgagagctccgcccagcccaccacgaccagccccatgacctccccggcgcagagcatcctcgtgatgtccgccgcccccatcgccatccagaacatccaccccagcccgaccaaccgcagcaagcggaacctggagatggagatcatcctgacgctctcccaggggctgaagaagtactacggcaagatcctgaagctcctgcacctgaccctcgaggaggacaccgaggggctgctggagtggtgcaagcgcaacctcggcagcaactgcgacgacgacttcttccagaagcggatcgaggagttcttcatgaccggcgaggggtacttcaacgaggtgctgcagttcaagacgctgtccaccctcagccccaccgagccctcccacgccggcccgcccaccgtcgagcccttcaagagctacttcgcgaaggggttcctgtccatcgacagcggctacttctccgccaagtgctacccccgcagctccacgagcggcctgcagctcatcaacgtgacccagcaccccgcccggatcgccgagacccccgggcccaagaccacgtccctgaagaccatcaactgcatcaacctgcgcgccagcgtgttcaaggagcaccgggagatcgagatcaacgtcctcctgccccagatcgcggtgaacctgtccaactgccacgtggtcatcaacagccacgtgtgcgactactccctcgacaccgacggccccgtgcgcctgccgcacatctaccacgaggggaccttcatccccggcacgtacaagatcgtcatcgacaagaagaacaagctgaacgaccggtgcaccctcgtgaccaactgcgtgatcaaggggcgcgaggtccggaagggccagagcgtgctgcgccagtacaagaccgagatcaagatcggcaaggccagcacggggtcccggaagctgctcagcgaggagcccggcgacgactgcatctcccgcacccagctgctgcggaccgagaccgccgagatccacgacgacaactacgggggccccggggacaagatcacgatctgcaacggcagcaccatcgtggaccagcgcctcggctccgagctggggtgctacaccatcaaccgggtcaagagcttcaagctgtgcgagaactccgccaccggcaagacgtgcgagatcgacagcaccccggtgaagtgccgccaggggttctgcctcaagatcacccaggagggccgcgggcacgtgaagctgtcccggggcagcgaggtcgtgctggacgcctgcgactccagctgcgaggtcatgatccccaagggcaccggggacatcctggtggactgctccggcgggcagcagcacttcctcaaggacaacctgatcgacctgggctgcccccacatccccctcctgggcaagatggcgatctacatctgccgcatgagcaaccacccgcggacgaccatggccttcctgttctggttctccttcgggtacgtgatcacgtgcatcttctgcaaggccctcttctacagcctgatcatcatcggcaccctggggaagaagatcaagcagtaccgcgagctcaagccccagacctgcacgatctgcgagaccgcccccgtcaacgcgatcgacgccgagatgcacgacctgaactgctcctacaacatctgcccctactgcgccagccggctgacctccgacggcctcgcccgccacgtgccgcagtgccccaagcggaaggagaaggtggaggagaccgagctgtacctgaacctcgagcgcatcccctggatcgtccggaagctgctccaggtgagcgagagcacgggggtggccctcaagcgctccagctggctgatcgtcctgctcgtgctgctgaccgtgtccctcagcccggtccagtccgcgcccgtgggccacggcaagaccatcgagacctaccagacgcgggaggggttcaccagcatctgcctgttcatgctgggctccatcctcttcctggtgagctgcctggtcaaggggctcgtggactccgtgagcgactccttcttccccggcctgagcgtctgcaagacctgcaccatcgggtccatcaacggcttcgagatcgagagccacaagtgctactgctccctgttctgctgcccctactgccgccactgcagcgccgaccgggagatccaccagctccacctgtccatctgcaagaagcgcaagacgggcagcaacgtgatgctggccgtgtgcaagcggatgtgcttccgcgccaccatcgaggcctcccggcgcgcgctcctgatccggagcatcatcaacaccaccttcgtcatctgcatcctgacgctcaccatctgcgtggtgagcacctccgccgtcgagatggagaacctgccgagcgggacctgggagcgcgaggaggacctgacgaacttctgccaccaggagtgccaggtgaccgagaccgagtgcctctgcccctacgaggccctggtgctgcgcaagcccctcttcctggactccatcgtcaagggcatgaagaacagcctgaactccaccagcctcgagacgtccctgagcatcgaggccccctggggcgccatcaacgtgcagtccaccttcaagccgaccgtgagcaccgcgaacatcgccctgtcctggagctccgtcgagcaccggggcaacaagatcctcgtgacggggcgcagcgagtccatcatgaagctggaggagcggaccggcgtgagctgggacctgggcgtcgaggacgcctccgagagcaagctcctgaccgtgtccatcatggacctgagccagatgtacagccccgtgttcgagtacctctccggggaccgccaggtcgaggagtggcccaaggcgacctgcacgggcgactgccccgagcggtgcgggtgcaccagcagcacgtgcctgcacaaggagtggccgcacagccgcaactggcggtgcaaccccacctggtgctggggcgtggggaccggctgcacgtgctgcggcgtggacgtcaaggacctgttcaccgaccacatgttcgtgaagtggaaggtggagtacatcaagaccgaggcgatcgtctgcgtggagctcacctcccaggagcgccagtgcagcctgatcgaggccgggacgcggttcaacctgggccccgtgaccatcaccctctccgagccccgcaacatccagcagaagctgccgcccgagatcatcaccctgcaccccaaggtcgaggaggggttcttcgacctcatgcacgtgcagaaggtgctgagcgcctccacggtctgcaagctgcagagctgcacccacggcatccccggcgacctccaggtgtaccacatcgggaacctgctgaagggcgaccggatcaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtcaacctgctcaacatcgagaccgactacaccaagacgttccacttccacagcaagcgcgtgaccgcgcacggcgacacgccccagctggacctgaaggcccggcccacctacggggccggcgagatcacggtcctcgtggaggtggccgacatggagctgcacaccaagaaggtcgagatctccgggctgaagttcgccagcctcgcgtgcaccggctgctacgcctgctccagcgggatctcctgcaaggtgcgcatccacgtggacgagccggacgagctgaccgtccacgtgaagtccagcgaccccgacgtggtcgccgcctccacgagcctgatggcccggaagctcgagttcggcaccgactccaccttcaaggcgttcagcgccatgcccaagacctccctgtgcttctacatcgtggagcgcgagtactgcaagagctgctccgaggaggacacgcagaagtgcgtggacaccaagctggagcagccccagagcatcctcatcgagcacaagggcaccatcatcgggaagcagaacgacacgtgcacggccaaggcctcctgctggctggagagcgtcaagtccttcttctacggcctgaagaacatgctcgggagcgtgttcggcaacttcttcatcgggatcctgctgttcctcgcgccgttcgtgctgctggtcctgttcttcatgttcggctggaagatcctcttctgcttcaagtgctgccggcgcacccggggcctgctgaagtaccgccacctcaaggacgacgaggagaccgggtaccggcgcatcatcgagcgcctgaacaacaagaagggcaagaaccggctgctcgacggggagcgcctggccgaccggaagatcgccgagctgttctccaccaagacgcacatcggctga

SEQ ID NO: 12061 - RNA, 5052 nt, synthetic construct
  misc_feature 1..5052: note = derived and/or modified CDS sequence (opt1) from CCHFV(Haskovo-V46/13)__KR092379.1__GP
  source 1..5052: mol_type = other RNA
atgcacaccctgctggtgtgcttcatcctgtacctgcagctcctgggcctcggcggggcccacgggcagtccaacaccaccgagcacaacgggaccaacaacaccaccgcccccgggacctcccagagcccgaagccccacatgtccaccaccccgccccacgcgcccgagagctccaccatcaagcccaccacccccaccagcgagaccgagggctccggcgagaccacgccgcccagcaacaccacccaggggcccagcccgcccgagaccaccagcgagcggcccgccaccaccgccatctccacgagctccaccgacaacatgaaccccaccagccagatgaccgacaacacgcccacctccaccgtcagcatctcccccagctccagccccagcaccccctccacgccccagggcatgcaccaccccgcccggagcctcctgtccgtgagctccccgaagaccgccaccacccccacgcccaccagccccgtggaggtcgggtccgagaccagctcccagcacagcgcgatgtccagcaccccgacgccccacaccgccacccaggtgtccaccgagaacaccaaccacagcacgccccgccagtccgagcccagcgcccagcagaccaccccgtcccccatgcccagcccggcccagtccaccctgctcatgagcgcggcccccacggccgtgcagaacacccaccccagccccaccaaccggtccaagcgcaacctggagatggagatcatcctgaccctcagccagggcctgaagaagtactacgggaagatcctgaagctcctgcacctgacgctcgaggaggacaccgagggcctgctggagtggtgcaagcggaacctcggctccaactgcgacgacgacttcttccagaagcgcatcgaggagttcttcatgaccggggagggctacttcaacgaggtcctgcagttcaagaccctgagcacgctctccccgatggagcccagccacgccgagctgcccaccgccgagcccttcaagtcctacttcgcgaaggggttcctgagcatcgactccggctacttcagcgccaagtgctacccgcggtccagcacctccggcctccagctgatcaacgtgacccagcaccccgcccgcatcgccgagacgcccgggcccaagaccaccagcctgaaggccatcaactgcatcaacctccgggcgtccgtgttcaaggagcaccgcgagatcgagatcaacgtcctgctgccgcagatcgccgtgaacctcagcaactgccacgtggtcatcaactcccacgtgtgcgactacagcctggacaccgacggccccgtgcggctgccccacatctaccacgaggggacgttcatccccggcacctacaagatcgtcatcgacaagaagaacaagctcaacgaccgctgcaccctggtgaccaactgcgtgatcaaggggcgggaggtccgcaagggccagagcgtgctgcggcagtacaagacggagatcaagatcggcaaggcctccaccgggagccgcaagctcctgtccgaggagctgggcgacgactgcatcagccggacccagctcctgcgcaccgagacggccgagatccacgacgacaactacgggggcccgggggacaagatcaccatctgcaacggctccaccatcgtggaccagcggctgggcagcgagctcgggtgctacaccatcaaccgcggcaagtccttcaagctgtgcgagaacagcgccacggggaagacctgcgagatcgactccacccccgtcaagtgccggcagggcttctgcctgaagatcacccaggaggggcgcggccacgtgaagctcagccgcggctccgaggtggtcctggacgcgtgcgacagctcctgcgaggtgatgatccccaaggggacgggcgacatcctggtcgactgcagcgggggccagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcgggaccctgggcaagaagatcaagcagtaccgggagctgaagccccagacgtgcaccatctgcgagaccacccccgtgaacgccatcgacgcggagatgcacgacctcaactgcagctacaacatctgcccgtactgcgcctcccgcctgacgagcgacgggctggcccggcacgtcacccagtgccccaagcgcaaggagaaggtggaggagaccgagctctacctgaacctggagcggatcccctggatcgtgcgcaagctcctgcaggtcagcgagtccaccggcgtggccctgaagcggagctcctggctcatcgtgctgctggtcctcctgccggtgagcctgtcccccgtgcagagcgcgcccgtcggccacgggaagacgatcgagacctaccagacccgcgagggcttcacctccatctgcctcttcatgctggggagcatcctgttcatcgtgtcctgcctcgtgaagggcctggtcgacagcgtgggggactccttcttccccggcctgagcgtgtgcaagacgtgctccatcggcagcatcaacgggttcgagatcgagtcccacaagtgctactgcagcctcttctgctgcccgtactgccggcactgctccgccgaccgcgagatccaccagctgcacctgagcatctgcaagaagcggaagaccggctccaacgtcatgctcgccgtgtgcaagcgcatgtgcttccgggccaccatcgaggccagccgccgggcgctgctgatccgcagcatcatcaacaccacgttcgccatgtgcatcctcaccctgaccatctgcgtggtctccaccagcgccgtggagatggagaacctgcccgccgggacgtgggagcgggaggaggacctcaccaacttctgccaccaggagtgccaggtgaccgagaccgagtgcctgtgcccctacgaggccctggtcctccgcaagcccctgttcctggactccatcgtgaagggcatgaagaacctcctgaacagcacgtccctggagaccagcctctccatcgaggcgccgtggggcgccatcaacgtgcagagcaccttcaagcccaccgtctccacggccaacatcgccctgagctggtccagcgtggagcaccgcggcaacaagatcctggtgaccggccggtccgagagcatcatgaagctcgaggagcgcaccggggtctcctgggacctgggcgtggaggacgccagcgagtccaagctgctcaccgtgagcatcatggacctgtcccagatgtacagccccgtcttcgagtacctgagcggggaccgccaggtggaggagtggcccaaggcgacgtgcaccggcgactgcccggagcgctgcgggtgcacctccagcacgtgcctccacaaggagtggccccactcccggaactggcgctgcaaccccacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctgacgagccaggagcggcagtgctccctcatcgaggccgggacccgcttcaacctgggccccgtcaccatcaccctgagcgagccgcggaacatccagcagaagctgccgcccgagatcatcacgctgcaccccaagatcgaggagggcttcttcgacctgatgcacgtgcagaaggtgctctccgccagcaccgtctgcaagctgcagtcctgcacccacgggatcccgggcgacctccaggtgtaccacatcgggaacctcctgaagggcgaccgcgtgaacgggcacctgatccacaagatcgagccccacttcaacaccagctggatgtcctgggacggctgcgacctcgactactactgcaacatgggcgactggcccagctgcacgtacaccggggtcacccagcacaaccacgcggccttcgtgaacctgctgaacatcgagaccgactacacgaagaccttccacttccactccaagcgggtgaccgcccacggcgacacgccccagctcgacctgaaggcccgcccgacgtacggggccggcgagatcaccgtcctggtggaggtcgcggacatggagctccacaccaagaaggtggagatcagcgggctgaagttcgcctccctgacctgcacgggctgctacgcctgcagctccggcatcagctgcaaggtgcggatccacgtcgacgagcccgacgagctcaccgtgcacgtgaagtccagcgaccccgacgtcgtggccgccgggaccagcctgatggcgcgcaagctggagttcggcaccgactccacgttcaaggccttcagcgccatgcccaagacctccctctgcttctacatcgtggagcgggagtactgcaagagctgctccgaggacgacacccagaagtgcgtcgacaccaagctggagcagccgcagagcatcctgatcgagcacaaggggacgatcatcggcaagcagaacgacacgtgcaccgcccgcgcctcctgctggctcgagagcgtgaagtccttcttctacgggctgaagaacatgctgggcagcgtgttcggcaacttcctcatcgggatcctgctgttcctcgcgcccttcgtcctgctggtgctgttcttcatgttcggctggaagatcctcttctgcttcaagtgctgccggcgcacccgggggctgttcaagtaccgccacctgaaggacgacgaggagacgggctaccggcgcatcatcgagcgcctcaactccaagaagggcaagaaccggctgctggacggggagcgcctcgccgaccggaagatcgccgagctgttcagcaccaagacccacatcggctga

SEQ ID NO: 12062 - RNA, 5052 nt, synthetic construct
  misc_feature 1..5052: note = derived and/or modified CDS sequence (opt1) from CCHFV(Min)__KX013481.1__GP
  source 1..5052: mol_type = other RNA
atgcacaccctgctggtgtgcttcatcctgtacctgcagctcctgggcctcggcggggcccacgggcagagcaacgccaccgagcacaacgggaccaacaccaccaccgccccctccacctcccagtccccgaagcccctcgtcagcaccgccccgccccacgccctggagtccagcaccatcaagcccaccacccccgcctccgagaccgaggggagcggcgagaccacgcccccgcccaacaccacccagggccccagcccgcccgagaccacccccgagcgccccgccaccaccgcgaccagcaccccctccacggacaacaccaacagcaccacccacgtgacggacaacaaccccacctccaccatcagcacctccccgagctccagcccctccacgcccagcacgccccaggggatccaccacccggcccggaacctgctcagcgtgtccagcctgaagaccgccaccacgcccacccccacctcccccggcgagatcagctccgagaccagctccctgcacagcgccatgtcccgcacgagcaccctctacaccgcgacccaggtctccaccgagaacgccaaccacagcgccccgcgccagtccgagagctccgcccagcccacgaccaccagccccatgacctcccccgcccagagcatcctggtgatgtccgcggccccgatcgccatccagaacatccaccccagccccacgaaccgcagcaagcggaacctggagatggagatcatcctcaccctgtcccaggggctgaagaagtactacggcaagatcctcaagctgctgcacctcaccctggaggaggacaccgaggggctgctcgagtggtgcaagcgcaacctgggcagcaactgcgacgacgacttcttccagaagcggatcgaggagttcttcatgacgggcgaggggtacttcaacgaggtgctgcagttcaagaccctctccaccctgagcccgaccgagccctcccacgcccggccgcccacggtcgagccgttcaagagctacttcgccaagggcttcctgtccatcgacagcgggtacttctccgcgaagtgctacccccggagctccaccagcggcctccagctgatcaacgtgacccagcaccccgcccgcatcgccgagacccccggcccgaagacgacctccctgaagaccatcaactgcatcaacctccgggccagcgtgttcaaggagcaccgcgagatcgagatcaacgtcctgctgccccagatcgccgtgaacctctccaactgccacgtggtcatcaacagccacgtgtgcgactactccctggacaccgacgggcccgtgcggctgccccacatctaccacgagggcacgttcatcccggggacctacaagatcgtcatcgacaagaagaacaagctcaacgaccgctgcaccctggtgaccaactgcgtgatcaagggccgggaggtccgcaaggggcagagcgtgctgcggcagtacaagacggagatcaagatcggcaaggcgagcaccggctcccgcaagctcctgagcgaggagcccggggacgactgcatctcccggacccagctgctccgcaccgagacggccgagatccacgacgacaactacggcgggcccggcgacaagatcaccatctgcaacgggagcaccatcgtggaccagcggctgggctccgagctgggctgctacaccatcaaccgcgtcaagagcttcaagctctgcgagaactccgccacggggaagacctgcgagatcgacagcacccccgtgaagtgccgccagggcttctgcctgaagatcacccaggaggggcggggccacgtgaagctgtcccgcgggagcgaggtcgtgctggacgcctgcgactccagctgcgaggtcatgatcccgaagggcacgggcgacatcctcgtggactgctccgggggccagcagcacttcctgaaggacaacctgatcgacctcgggtgcccccacatccccctgctgggcaagatggccatctacatctgccggatgagcaaccacccccgcaccaccatggcgttcctcttctggttctccttcggctacgtgatcacgtgcatcttctgcaaggccctgttctacagcctgatcatcatcgggaccctcggcaagaagatcaagcagtaccgggagctgaagccgcagacgtgcaccatctgcgagaccgcccccgtcaacgccatcgacgcggagatgcacgacctgaactgctcctacaacatctgcccctactgcgccagccgcctcacctccgacgggctggcccggcacgtgccccagtgcccgaagcgcaaggagaaggtggaggagacggagctgtacctcaacctggagcggatcccctggatcgtccgcaagctgctccaggtgagcgagagcaccggcgtggccctgaagcggtccagctggctgatcgtcctcctggtgctgctcaccgtgtccctgagccccgtccagtccgccccggtggggcacggcaagaccatcgagacgtaccagacccgcgagggcttcaccagcatctgcctgttcatgctcgggtccatcctgttcctggtgagctgcctcgtcaagggcctggtggactccgtgagcgactccttcttccccgggctgagcgtctgcaagacctgcacgatcggctccatcaacgggttcgagatcgagagccacaagtgctactgctccctcttctgctgcccctactgccggcactgcagcgcggaccgcgagatccaccagctgcacctgtccatctgcaagaagcggaagaccggcagcaacgtgatgctcgccgtgtgcaagcgcatgtgcttccgggccaccatcgaggcctcccgccgggccctgctgatccgcagcatcatcaacaccacgttcgtcatctgcatcctcaccctgaccatctgcgtggtgagcacctccgcggtcgagatggagaacctgcccagcggcacgtgggagcgcgaggaggacctcaccaacttctgccaccaggagtgccaggtgaccgagaccgagtgcctgtgcccgtacgaggccctggtgctccggaagcccctgttcctggactccatcgtcaaggggacgaagaacctcctgaacagcacctccctggagaccagcctctccatcgaggccccctggggcgccatcaacgtgcagagcaccttcaagcccacggtgtccaccgccaacatcgcgctgagctggtccagcgtcgagcaccgcgggaacaagatcctggtgaccggccggtccgagagcatcatgaagctcgaggagcgcaccggggtgtcctgggacctgggcgtcgaggacgccagcgagtccaagctgctcacggtgagcatcatggacctgtcccagatgtacagcccggtgttcgagtacctgagcggcgaccggcaggtcgaggagtggcccaaggcgacctgcaccggggactgccccgagcgctgcggctgcacctccagcacgtgcctccacaaggagtggccccactcccggaactggcgctgcaacccgacctggtgctggggcgtgggcaccgggtgcacgtgctgcggcgtggacgtcaaggacctgttcaccgaccacatgttcgtgaagtggaaggtggagtacatcaagacggaggccatcgtctgcgtggagctgaccagccaggagcggcagtgctccctcatcgaggcgggcacccgcttcaacctggggcccgtgaccatcacgctgagcgagccccggaacatccagcagaagctgccgcccgagatcatcaccctgcaccccaaggtcgaggagggcttcttcgacctgatgcacgtgcagaaggtgctctccgccagcaccgtctgcaagctgcagtcctgcacccacgggatccccggcgacctccaggtgtaccacatcggcaacctcctgaagggggaccgcatcaacggccacctgatccacaagatcgagccccacttcaacacgagctggatgtcctgggacgggtgcgacctcgactactactgcaacatgggcgactggcccagctgcacctacaccggggtgacccagcacaaccacgccgccttcgtcaacctgctgaacatcgagacggactacaccaagaccttccacttccactccaagcgggtgaccgcccacggcgacacgccccagctcgacctgaaggcgcgccccacctacggcgccggggagatcaccgtcctggtggaggtggccgacatggagctccacaccaagaaggtcgagatcagcggcctgaagttcgcctccctggcctgcacggggtgctacgcgtgcagctccggcatcagctgcaaggtgcggatccacgtggacgagcccgacgagctcaccgtccacgtgaagtccagcgacccggacgtggtcgccgccagcacctccctgatggcccgcaagctggagttcgggaccgacagcacgttcaaggccttctccgcgatgcccaagaccagcctctgcttctacatcgtggagcgggagtactgcaagtcctgcagcgaggaggacacccagaagtgcgtggacaccaagctggagcagccccagtccatcctgatcgagcacaagggcacgatcatcggcaagcagaacgacacgtgcaccgccaaggccagctgctggctcgagtccgtcaagagcttcttctacgggctgaagaacatgctgggctccgtgttcgggaacttcttcatcggcatcctcctgttcctggcccccttcgtgctgctcgtcctgttcttcatgttcgggtggaagatcctgttctgcttcaagtgctgccgccggacccgcggcctcctgaagtaccggcacctgaaggacgacgaggagacgggctaccgccgcatcatcgagcggctcaacaacaagaaggggaagaaccgcctgctggacggcgagcggctcgcggaccgcaagatcgccgagctgttcagcaccaagacccacatcgggtga

SEQ ID NO: 12063 - RNA, 5052 nt, synthetic construct
  misc_feature 1..5052: note = derived and/or modified CDS sequence (opt1) from CCHFV(Kosovo/9553/2001)__AY675511.1__GP
  source 1..5052: mol_type = other RNA
atgcacaccctgctcgtgtgcttcatcctgtacctgcagctcctgggcctggggggcgcccacgggcagagcaacgccaccgagcacaacggcacgaacaccaccaccgcgcccgggacgtcccagagcccgaagccccccgcctccaccacccccagccacgccccggagtccagcaccatcaagctcacgacccccacctccgagaccgagggcagcggcgagacgaccccccccacctccaccacgcaggggagcccgcccctggagaccacccccgagcgctccaccacgaccgccaccagcacctccggcacggacaacatgaacagcaccacccagatgaccgacaacacgcccaccctgaccgcctccaccagcccgtccagctcccccagcacgcccagcacctcccaggggctccactaccccgtccggagcctgctgtccgtgagctccccgaagaccgtgaccacgcccacccccatgagccccggcgagatgtccagcgagacctccagccagcactccgcgatgagccgcaccccgaccccccacacggccacccaggtctccaccgagaacgccaaccggagcacctcccgccagagcgagtccagcgcccagcccgcgacgcagtcccccgtgaccagcccggcccagagcatcctcctgatgtccgccacccccaccacgatccagaacatccaccccagccccaccaaccggtccaagcgcaacctggagatggagatcatcctcaccctgagccaggggctgaagaagtactacggcaagatcctcaagctgctgcacctcaccctggaggaggacacggagggcctgctcgagtggtgcaagcggaacctggggtccaactgcgacgacgacttcttccagaagcgcatcgaggagttcttcatcaccggcgaggggtacttcaacgaggtgctgcagttcaagaccctcagcaccccgtcccccacggagcccagccacgcccggctgccgaccgccgagcccttcaagtcctacttcgcgaagggcttcctgagcatcgactccggctacttcagcgccaagtgctacccccgctccagcacctccgggctccagctgatcaacgtcacccagcaccccgcccggatcgccgagacgccgggccccaagatcaccagcctgaagaccatcaactgcatcaacctccgcgcctccgtgttcaaggagcaccgggaggtggagatcaacgtcctgctgccccagatcgcggtgaacctcagcaactgccacgtggtcatcaacagccacgtgtgcgactactccctggacaccgacgggcccgtgcgcctgccgcggatctaccacgagggcacgttcatgcccgggacctacaagatcgtcatcgaccgcaagaacaagctcaacgaccggtgcaccctggtgaccaactgcgtgatcaagggccgcgaggtccggaagggccagagcgtgctgcgccagtacaagacggagatcaagatcgggaaggcccccaccggctcccggaagctcctgagcgaggagcccggggacgactgcatctcccgcacccagctgctccgcaccgagacggccgagatccacgacgacaactacggcgggccgggcgacaagatcaccatctgcaacggcagcaccatcgtggaccagcggctggggtccgagctgggctgctacaccatcaaccgcgtcaagagcttcaagctctgcgagaactccgccacggggaagacctgcgagatcgacagcacccccgtgaagtgccggcagggcttctgcctgaagatcacccaggaggggcgcggccacgtgaagctgtcccggggcagcgaggtcgtgctggacgcctgcgactccagctgcgaggtcatgatccccaaggggaccggcgacatcctcgtggactgctccgggggccagcagcacttcctgaaggacaacctgatcgacctcggctgcccccacatcccgctgctggggaagatggcgatctacatcgcccgcatgagcaaccaccccaagacgaccatggccttcctcttctggttctccctgggctacgtgatcacctgcatcctgtgcaaggccctcttctacagcctgatcatcatcgggaccctgggcaagaagatcaagcagtaccgggagctcaagccccagacgtgcaccatctgcgagaccgcccccgtcaacgcgatcgacgccgagatgcacgacctgaactgctcctacaacatctgcccgtactgcgccagccgcctgaccagcgacgggctcgcccggcacgtgaagcagtgccccaagcgcaaggagaaggtggaggagacggagctgtacctgaacctcgagcggatcccctgggtcgtgcgcaagctgctgcaggtgtccgagagcaccggcgtcgcgctcaagcggtccagctggctgatcgtgctgctcgtgctgctgaccgtctccctcagccccgtgcagtccgccccggtgggccacgggaagaccatcgagacgtaccagacccgcgagggcttcaccagcatctgcctgttcatgctggggtccatcctcttcatcgtcagctgcctggtgaagggcctggtggactccgtcagcgactccttcttccccgggctcagcgtgtgcaagacctgctccatcggcagcatcaacggcttcgagatcgagtcccacaagtgctactgcagcctgttctgctgcccctactgccggcactgctccgccgaccgcgagatccaccagctgcacctcagcatctgcaagaagcggaagacggggagcaacgtgatgctggccgtctgcaagcgcatgtgcttccgggccaccatcgaggcgtcccgccgcgccctgctcatccggagcatcatcaacaccaccttcgtgatctgcatcctgacgctgaccatctgcgtggcctccaccagcgccgtcgagatggagaccctcccggccgcgacgtgggagcgcgaggaggacctgaccaacttctgccaccaggagtgccaggtgcccgagaccgagtgcctgtgcccctacgaggccctcgtgctgcggaagcccctgttcctcgactccatcgtcaagggcatgaagaacctgctgaacagcacctccctcgagacgagcctgtccatcgaggccccgtggggggccatcaacgtgcagagcaccttcaagcccaccgtgtccaccgccaacatcgcgctgagctggtccagcgtcgagcaccgcggcaacaagatcctcgtgacggggcggtccgagagcatcatgaagctggaggagcgcaccggcgtgtcctgggacctgggcgtcgaggacgccagcgagtccaagctcctgaccgtgagcatcatggacctgagccagatgtactcccccgtgttcgagtacctcagcggggaccggcaggtcgaggagtggcccaaggccacctgcacgggcgactgcccggagcgctgcgggtgcacctccagcacctgcctgcacaaggagtggccccactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctcaccagccaggagcggcagtgctccctgatcgaggcggggacgcgcttcaacctgggccccgtgaccatcaccctcagcgagccgcggaacatccagcagaagctgccccccgagatcatcaccctgcaccccaagatcgaggaggggttcttcgacctcatgcacgtccagaaggtgctgtccgccagcacggtgtgcaagctgcagtcctgcacccacggcatcccgggcgacctccaggtctaccacatcgggaacctgctgaagggcgaccgcgtgaacgggcacctcatccacaagatcgagccccacttcaacaccagctggatgtcctgggacggctgcgacctggactactactgcaacatgggggactggcccagctgcacctacacgggcgtgacccagcacaaccacgccgccttcgtcaacctgctcaacatcgagaccgactacaccaagacgttccacttccactccaagcgggtgaccgcccacggcgacaccccccagctggacctgaaggcgcgcccgacctacggggccggcgagatcacggtcctcgtggaggtggccgacatggagctgcacaccaagaaggtcgagatcagcgggctgaagttcgcctccctcgcctgcaccggctgctacgcgtgcagctccgggatcagctgcaaggtgcggatccacgtggacgagcccgacgagctgaccgtccacgtgaagagctccgaccccgacgtggtcgccgccagcacgtccctgatggcccgcaagctcgagttcggcaccgacagcaccttcaaggccttctccgcgatgcccaagaccagcctgtgcttctacatcgtggagaaggagtactgcaagtcctgcagcgaggacgacacgaagaagtgcgtggacaccaagctggagcagccgcagtccatcctcatcgagcaccggggcaccatcatcgggaagcccaacgacacctgccccgccaagacgagctgctggctggagtccgtcaagagcttcttctacggcctgaagaacatgctcgggtccgtgttcggcaacttcttcatcgggatcctgctgttcctggcccccttcttcctctggatgctgagcttcatgttcggctggaagatcctgttctgcttcaagtgctgccgccggacccgcggcctcttcaagtaccgccacctgaaggacgacgaggagaccgggtaccggcgcatcatcgagcggctgaacaacaagaagggcaagaaccgcctcctggacggggagcggctggccgaccgcaagatcgcggagctcttctccaccaagacgcacatcggctga

SEQ ID NO: 12064 - RNA, 5052 nt, synthetic construct
  misc_feature 1..5052: note = derived and/or modified CDS sequence (opt1) from CCHFV(4495-ST-2008)__KR814869.1__GP
  source 1..5052: mol_type = other RNA
atgcacaccctgctcgtgtgcttcatcctgtacctgcagctcctgggccccgggggcgcccacgggcagccgaacgccaccgagcacaaccgcacgaacaccaccaccgcgcccagcacgtcccagagccccaagcccccggtctccaccgcccccccccacgccctggagagccccaccatcaagtccaccacgccgaccagcgagaccgagggctccggggagaccacgcccccccccaacaccacccagggcccgagcccccccgagaccacgcccgagcggccggccaccaccgccacctccacgcccagcaccgacaacaccaactccaccacgcacgtgaccgacaacaaccccaccagcaccatctccacgagcccctccagctccccgagcaccccctccaccccccgcggcatccaccaccccgcgcggaacctcctgagcgtgagctccccgaagaccgccacgacccccacccccaccagccccggggagatctccagcgagacgtccagcctgcactccgccatgagccgcacctccaccctctacaccgccacccaggcgagcacggagaacgccaaccactccaccccgcggcagagcgagtcccccgcccagcccaccaccacgagcctgatgacctccccggcccagagcatcctggtcatgtccgccgcgcccaccgccatccagaacatccaccccagccccaccaaccgctccaagcggaacctcgagatggagatcatcctgacgctgagccagggcctcaagaagtactacgggaagatcctgaagctgctccacctgaccctggaggaggacaccgagggcctcctggagtggtgcaagcgcaacctggggagcaactgcgacgacgacttcttccagaagcggatcgaggagttcttcatgaccggcgagggctacttcaacgaggtgctccagttcaagacgctgtccaccctgagcccgaccgagccctcccacgcccgcccccccaccgtggagccgttcaagagctacttcgccaaggggttcctctccatcgacagcggctacttctccgccaagtgctacccccggagctccacgagcgggctgcagctgatcaacgtcacccagcaccccgcgcgcatcgccgagacccccggcccgaagaccacgtccctcaagaccatcaactgcatcaacctgcgggccagcgtgttcaaggagcaccgcgagatcgagatcaacgtgctgctcccccagatcgccgtcaacctgtccaactgccacgtggtgatcaacagccacgtctgcgactactccctggacaccgacggccccgtgcggctcccccacatctaccacgaggggaccttcatcccgggcacgtacaagatcgtgatcgacaagaagaacaagctgaacgaccgctgcaccctggtcaccaactgcgtgatcaaggggcgggaggtgcgcaagggccagagcgtcctccggcagtacaagaccgagatcaagatcgggaaggtgtccacgggcagccgcaagctgctgagcgaggagtccggcgacgactgcatcagccggacccagctcctgcgcaccgagaccgccgagatccacgacgacaactacgggggccccggggacaagatcacgatctgcaacggctccaccatcgtggaccagcgcctggggagcgagctcggctgctacaccatcaaccgggtcaagtccttcaagctgtgcgagaacagcgcgaccggcaagacgtgcgagatcgactccacccccgtgaagtgccgccaggggttctgcctgaagatcacccaggagggccgggggcacgtgaagctcagccgcggctccgaggtcgtgctggacgcctgcgacagctcctgcgaggtcatgatccccaaggggaccggcgacatcctggtggactgcagcggcgggcagcagcacttcctgaaggacaacctcatcgacctgggctgcccgcacatccccctgctcgggaagatggccatctacatctgccggatgtccaaccacccccgcaccacgatggccttcctgttctggttcagcttcggctacgtgatcacctgcctgttctgcaaggccctcttctactccctgatcatcatcggcaccctggggaagaagatcaagcagtaccgggagctccgcccccagacctgcacgatctgcgagaccgcgccggtcaacgccatcgacgccgagatgcacgacctgaactgcagctacaacatctgcccctactgcgcctcccggctgaccagcgacggcctcgcgcgccacgtgccccagtgcccgaagcggaaggagaaggtggaggagaccgagctgtacctgaacctcgagcgcatcccctggatcgtccggaagctgctgcaggtgtccgagagcacgggggtggccctcaagcgcagctcctggctgatcgtcctgctcgtgctgctgaccgtgagcctctcccccgtccagagcgcccccgtgggccacgggaagaccatcgagacctaccagacgcgggagggcttcacctccatctgcctgttcatgctgggcagcatcctcttcctggtgtcctgcctggtcaaggggctcgtggacagcgtgtccgacagcttcttcccgggcctgtccgtctgcaagacctgcagcatcgggtccatcaacggcttcgagatcgagagccacaagtgctactgctccctgctctgctgcccctactgccgccactgcagcgccgaccgggagatccaccagctgcacctgtccatctgcaagaagcgcaagaccgggagcaacgtgatgctcgccgtgtgcaagcggatgtgcttccgcgcgacgatcgaggcctcccgccgggccctgctgatccgcagcatcatcaacaccaccttcgtcatctgcatcctcaccctgacgatctgcgtggtgagcacctccgccgtcgagatggagaacctgcccagcggcacctgggagaaggaggaggacctcaccaacttctgccaccaggagtgccaggtgacggagaccgagtgcctgtgcccctacgaggccctggtgctccggaagccgctgttcctggactccatcgtcaagggcatgaagaacctcctgaacagcacctccctggagaccagcctctccatcgaggcgccctggggggccatcaacgtgcagagcacgttcaagcccaccgtgtccaccgccaacatcgccctgagctggtccagcgtcgagcaccgcggcaacaagatcctggtgaccgggcggtccgagagcatcatgaagctcgaggagcgcacgggcatctcctgggacctgggggtggaggacgccagcgagtccaagctgctcaccgtcagcatcatggacctgtcccagatgtacagccccgtgttcgagtacctgagcggcgaccggcaggtggaggagtggccgaaggcgacctgcaccggcgactgccccgagcgctgcgggtgcacgtccagcacctgcctccacaaggagtggccccactcccggaactggcgctgcaaccccacctggtgctggggcgtcgggaccggctgcacctgctgcggggtggacgtgaaggacctgttcacggaccacatgttcgtcaagtggaaggtggagtacatcaagaccgaggccatcgtgtgcgtcgagctgaccagccaggagcggcagtgctccctcatcgaggccggcacccgcttcaacctgggcccggtgacgatcaccctgagcgagccccggaacatccagcagaagctcccccccgagatcatcaccctgcacccgaaggtggaggaggggttcttcgacctgatgcacgtccagaaggtgctctccgccagcaccgtgtgcaagctgcagtcctgcacgcacggcatccccggggacctgcaggtctaccacatcggcaacctcctgaagggcgaccgcgtgaacgggcacctgatccacaagatcgagccccacttcaacaccagctggatgtcctgggacggctgcgacctcgactactactgcaacatgggggactggcccagctgcacctacaccggcgtgacgcagcacaaccacgcggccttcgtcaacctgctgaacatcgagaccgactacaccaagaccttccacttccactccaagcgggtgacggcccacggggacaccccgcagctcgacctgaaggcccgccccacctacggcgccggcgagatcaccgtcctggtggaggtggcggacatggagctccacacgaagaaggtcgagatcagcgggctgaagttcgcctccctggcctgcaccggctgctacgcctgcagctccgggatcagctgcaaggtgcggatccacgtggacgagcccgacgagctcaccgtccacgtgaagtccagcgaccccgacgtggtcgccgcgagcacctccctgatggcccgcaagctggagttcggcacggacagcaccttcaaggccttctccgccatgccgaagaccagcctctgcttctacatcgtggagcgggagtactgcaagtcctgcagcgaggaggacacccagcgctgcgtggacacgaagctggagcagccccagtccatcctgatcgagcacaaggggaccatcatcggcaagcagaacgacacctgcaccgccaaggcgagctgctggctcgagtccgtcaagagcttcttctacggcctgaagaacatgctggggtccgtgttcggcaacttcttcatcgggatcctcctgttcctggcccccttcgtgctgctcgtcctgttcttcatgttcggctggaagatcctgttctgcttcaagtgctgccggcgcgcccgcgggctcctgaagtaccggcacctgaaggacgacgaggagacgggctaccgcaagatcatcgagcggctcaacaacaagaagggcaagaaccgcctgctggacggggagcggctcgccgaccgcaagatcgcggagctgttcagcaccaagacccacatcggctga

SEQ ID NO: 12065 - RNA, 5052 nt, synthetic construct
  misc_feature 1..5052: note = derived and/or modified CDS sequence (opt1) from CCHFV(Mamon)__KX013478.1__GP
  source 1..5052: mol_type = other RNA
atgcacaccctgctggtgtgcttcatcctgtacctgcagctgctgggcctcggcggggcccacgggcagagcaacaccaccgagcacaacgggaccaacaccaccaccgccccctccaccagccagtccccgaagcccctcgtcagcaccgcgccgccccacgccctggagtccagcaccatcaagcccaccacccccgcctccgagaccgaggggagcggcgagaccaccccgccgcccaacatcacccagggccccagcccgcccgagaccacccccgagcgccccgccacgaccgccaccagcaccccctccacggacaacaccaacagcaccacccacgtgacggacaacaaccccacctccaccatcagcacctccccgagctccagcccctccacgcccagcacgccccaggggatccaccacccggcccggaacctgctcagcgtgtccagccccaagaccgccaccacgcccacccccacctccccgggcgagatcagctccaagaccagctccctgcacagcgccatgtcccgcacgagcaccctgtacaccgccacccaggtctccaccgagaacgcgaaccacagcgcgccccggcagtccgagagctccgcccagcccacgaccaccagccccatgacctccccggcccagagcatcctcgtgatgtccgccgcgcccacggccatccagaacatccaccccagcccgaccaaccgcagcaagcggaacctggagatggagatcatcctgaccctctcccaggggctgaagaagtactacggcaagatcctgaagctcctgcacctgaccctcgaggaggacacggaggggctgctggagtggtgcaagcgcaacctcggcagcaactgcgacgacgacttcttccagaagcggatcgaggagttcttcatgaccggcgaggggtacttcaacgaggtgctgcagttcaagaccctgtccaccctcagccccacggagccctcccacgcccggccgcccaccgtcgagcccttcaagagctacttcgccaagggcttcctgtccatcgacagcgggtacttctccgccaagtgctacccccggagctccaccagcggcctgcagctcatcaacgtgacccagcaccccgcgcgcatcgccgagacgcccggccccaagaccacctccctgaagaccatcaactgcatcaacctgcgggccagcgtgttcaaggagcaccgcgagatcgagatcaacgtcctcctgccccagatcgccgtgaacctgtccaactgccacgtggtcatcaacagccacgtgtgcgactactccctcgacacggacgggcccgtgcggctgccgcacatctaccacgagggcaccttcatccccgggacctacaagatcgtcatcgacaagaagaacaagctgaacgaccgctgcaccctcgtgacgaactgcgtgatcaagggccgggaggtccgcaaggggcagagcgtgctgcggcagtacaagaccgagatcaagatcggcaaggccagcaccggctcccgcaagctgctcagcgaggagcccggggacgactgcatctcccggacccagctgctgcgcacggagaccgcggagatccacgacgacaactacggcgggcccggcgacaagatcaccatctgcaacgggagcaccatcgtggaccagcggctcggctccgagctgggctgctacacgatcaaccgcgtcaagagcttcaagctgtgcgagaactccgccaccgggaagacctgcgagatcgacagcaccccggtgaagtgccgccagggcttctgcctcaagatcacgcaggaggggcggggccacgtgaagctgtcccgcgggagcgaggtcgtgtccgacgcctgcgacagctcctgcgaggtcatgatccccaagggcaccggcgacatcctggtggactgcagcgggggccagcagcacttcctgaaggacaacctcatcgacctggggtgcccccacatccccctgctcggcaagatggccatctacatctgccggatgtccaaccacccgcgcaccaccgtggccttcctgttctggttcagcttcggctacgtcatcacgtgcatcttctgcaaggcgctgttctactccctcatcatcatcgggacgctgggcaagaagatcaagcagtaccgggagctgaagccccagacctgcaccatctgcgagaccgcccccgtgaacgccatcgacgccgagatgcacgacctcaactgcagctacaacatctgcccctactgcgcgtcccgcctgacgagcgacgggctggcccggcacgtgccgcagtgccccaagcgcaaggagaaggtcgaggagaccgagctctacctgaacctggagcggatcccctggatcgtgcgcaagctcctccaggtgagcgagtccaccggcgtcgccctgaagcggagctcctggctcatcgtgctgctggtgctcctgaccgtcagcctgtccccggtgcagagcgcccccgtggggcacggcaagacgatcgagacctaccagacccgcgagggcttcacctccatctgcctcttcatgctggggagcatcctgttcctcgtctcctgcctggtgaagggcctggtggacagcgtctccgacagcttcttccccgggctctccgtgtgcaagacgtgcagcatcggctccatcaacgggttcgagatcgagagccacaagtgctactgctccctgttctgctgcccctactgccggcactgcagcgccgaccgcgagatccaccagctgcacctctccatctgcaagaagcggaagaccggcagcaacgtgatgctggcggtctgcaagcgcatgtgcttccgggccaccatcgaggccagccgccgggccctgctcatccgctccatcatcaacaccacgttcgtgatctgcatcctgaccctgaccatctgcgtggtcagcacctccgccgtggagatggagaacctcccgagcggcacgtgggagcgcgaggaggacctgaccaacttctgccaccaggagtgccaggtgaccgagaccgagtgcctgtgcccctacgaggcgctcgtcctgcggaagcccctgttcctcgactccatcgtgaaggggatgaagaacctgctgaacagcacgtccctcgagaccagcctgtccatcgaggccccctggggcgccatcaacgtgcagagcaccttcaagccgaccgtctccacggccaacatcgccctgagctggtccagcgtggagcaccgcgggaacaagatcctcgtgaccggccggtccgagagcatcatgaagctggaggagcgcaccggggtctcctgggacctgggcgtggaggacgcgagcgagtccaagctcctgaccgtgagcatcatggacctgagccagatgtactcccccgtcttcgagtacctcagcggcgaccgccaggtggaggagtggcccaaggccacgtgcaccggggactgccccgagcgctgcggctgcacctccagcacgtgcctgcacaaggagtggccgcactcccggaactggcgctgcaaccccacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctcacgagccaggagcggcagtgctccctgatcgaggccggcacccgcttcaacctggggcccgtcaccatcaccctcagcgagccccggaacatccagcagaagctgccgcccgagatcatcacgctgcaccccaaggtggaggagggcttcttcgacctcatgcacgtgcagaaggtcctgtccgcgagcaccgtgtgcaagctgcagtcctgcacccacgggatccccggcgacctccaggtgtaccacatcggcaacctgctgaagggggaccgcgtcaacggccacctcatccacaagatcgagccgcacttcaacaccagctggatgtcctgggacgggtgcgacctggactactactgcaacatgggcgactggcccagctgcacgtacaccggggtgacccagcacaaccacgccgccttcgtcaacctgctcaacatcgagaccgactacacgaagaccttccacttccactccaagcgggtgaccgcccacggcgacacgccccagctggacctgaaggcccgccccacgtacggcgcgggggagatcaccgtgctcgtcgaggtggccgacatggagctgcacaccaagaaggtggagatcagcggcctgaagttcgcctccctcgcctgcaccgggtgctacgcctgcagctccggcatcagctgcaaggtccggatccacgtggacgagccggacgagctgacggtgcacgtcaagagctccgaccccgacgtggtggcggccagcacctccctgatggcccgcaagctcgagttcgggaccgacagcaccttcaaggccttctccgccatgcccaagacgagcctgtgcttctacatcgtcgagcgggagtactgcaagtcctgcagcgaggaggacacccagaagtgcgtggacaccaagctggagcagccccagtccatcctcatcgagcacaagggcaccatcatcggcaagcagaacgacacgtgcaccgcgaagaccagctgctggctggagtccgtgaagtccttcttctacgggctgaagaacatgctcggctccgtcttcgggaacttcttcatcggcatcctgctgttcctcgccccgttcgtgctgctggtgctgttcttcatgttcgggtggaagatcctcttctgcttcaagtgctgccgccggacccgcggcctgctgaagtaccggcacctcaaggacgacgaggagacgggctaccgccgcatcatcgagcggctgaacaacaagaaggggaagaaccgcctgctcgacggcgagcggctggccgaccgcaagatcgccgagctgttcagcaccaagacccacatcgggtga

SEQ ID NO: 12066 - RNA, 5052 nt, synthetic construct
  misc_feature 1..5052: note = derived and/or modified CDS sequence (opt1) from CCHFV(81-R-2014)__KR814865.1__GP
  source 1..5052: mol_type = other RNA
atgcacaccctgctggtgtgcttcatcctgtacctgcagctcctgggcctcggcggggcccacgggcagagcaacgccaccgagcacaacggcaccaacaccaccaccgtgccctccaccagccagtccccgaagcccctcgtgagcaccaccccgccccacgcgctggagtccagcaccatcaagcccaccacccccacctccgagaccgaggggagcggcgagacggcgcccctgcccaacaccacccagggcccgccgccgcccgagaccacgccggagcggcccgccaccaccgtgacctccacgcccagcaccgacaacaccaactccaccatccacgtgacggacaacaaccccaccagcaccatctccaccagcccgtccagctcccccagcacgccctccacgccccaggggatccaccacccggcccggagcctcctgagcgtgtccagccccaagaccgccaccacgcccacccccacctccccgggcgagatcaacagcgagacctccagcctgcactccgccatgagccgcacgcccaccctccacaccgccacccaggtgtccaccgagaacgccaaccacagcgcgccccggcagtccgagagctccgcccagcccacgaccaccagcctgatgacctccccggcccagagcatcctgctcatgtccgccgcccccacggccatccagaacacccaccccagcccgaccaaccgctccaagcggaacctggagatggagatcatcctgaccctcagccaggggctgaagaagtactacggcaagatcctgaagctcctgcacctgacgctcgaggaggacaccgaggggctgctggagtggtgcaagcgcaacctcggcagcaactgcgacgacgacttcttccagaagcggatcggcgagttcttcatgaccggggagggctacttcaacgaggtcctgcagttcaagaccctgtccacgctcagccccaccgagccctcccacgcgcgcctgcccaccgtggagccgttcaagagctacttcgccaaggggttcctgtccatcgacagcggctacttctccgccaagtgctacccccggagctccaccagcggcctccagctgatcaacgtgacgcagcaccccgcccgcatcgccgagacccccgggccgaagaccacctccctgaagacgatcaactgcatcaacctccgggcgagcgtcttcaaggagcaccgcgagatcgagatcaacgtgctgctgccccagatcgccgtgaacctctccaactgccacgtcgtgatcaacagccacgtgtgcgactactccctggacaccgacggccccgtccggctgccccacatctaccacgaggggaccttcatcccgggcacctacaagatcgtgatcgacaagaagaacaagctcaacgaccgctgcacgctggtgaccaactgcgtcatcaaggggcgggaggtgcgcaagggccagagcgtgctgcggcagtacaagaccgagatcaagatcggcaaggcctccaccgggagccgcaagctcctgagcgaggagcccggcgacgactgcatctcccggacgcagctgctccgcaccgagaccgccgagatccacgacgacaactacgggggccccggggacaagatcaccatctgcaacggcagcacgatcgtcgaccagcggctggggtccgagctggggtgctacaccatcaaccgcgtcaagagcttcaagctgtgcgagaactccgccaccggcaagacctgcgagatcgacagcacgcccgtgaagtgccgccaggggttctgcctcaagatcacccaggagggccgggggcacgtcaagctgtcccgcggcagcgaggtggtcctggacgcgtgcgactccagctgcgaggtgatgatccccaagggcaccggggacatcctcgtggactgctccggcgggcagcagcacttcctgaaggacaacctgatcgacctcggctgcccccacatccccctgctgggcaagatggccatctacatctgccggatgagcaaccacccccgcaccaccatggccttcctcttctggttctccttcgggtacgtcatcacgtgcatcttctgcaaggccctgttctacagcctgatcatcatcggcaccctcgggaagaagatcaagcagtaccgggagctgaagccgcagacctgcaccatctgcgagacggcccccgtgaacgcgatcgacgccgagatgcacgacctgaactgctcctacaacatctgcccctactgcgccagccgcctcacctccgacggcctggcccggcacgtgccccagtgcccgaagcgcaaggagaaggtcgaggagaccgagctgtacctcaacctggagcggatcccctggatcgtgcgcaagctgctccaggtgagcgagtccaccggggtcgcgctgaagcggagcagctggctgatcgtgctcctggtgctgctcacggtctccctgagccccgtgcagtccgccccggtgggccacggcaagaccatcgagacctaccagacccgcgaggggttcacgagcatctgcctgttcatgctcggctccatcctgttcctggtcagctgcctcgtgaaggggctggtggactccgtcagcgactccttcttccccggcctgagcgtgtgcaagacctgctccatcgggagcatcaacggcttcgagatcgagtcccacaagtgctactgcagcctcttctgctgcccctactgccggcactgctccgccgaccgcgagatccaccagctgcacctgagcatctgcaagaagcggaagaccggctccaacgtgatgctcgccgtctgcaagcgcatgtgcttccgggccaccatcgaggcgagccgccgggccctgctgatccgctccatcatcaacacgaccttcgtgatctgcatcctcaccctgaccatctgcgtggtcagcacgagcgccgtggagatggagaacctgcccgccgggacctgggagcgcgaggaggacctcaccaacttctgccaccaggagtgccaggtgaccgagacggagtgcctgtgcccgtacgaggccctggtcctccggaagcccctgttcctggactccatcgtgaagggcatgaagaacctcctgaacagcacctccctggagaccagcctctccatcgaggcgccctggggcgccatcaacgtgcagagcaccttcaagcccacggtctccaccgccaacatcgccctgagctggtccagcgtggagcaccgcggcaacaagatcctggtgaccgggcggtccgagagcatcatgaagctcgaggagcgcaccggcgtctcctgggacctgggcgtggaggacgccagcgagtccaagctgctcacggtgagcatcatggacctgtcccagatgtacagcccggtcttcgagtacctgtccggggaccgccaggtggaggagtggcccaaggcgacctgcaccggcgactgccccgagcgctgcgggtgcaccagcagcacgtgcctccacaaggagtggccccactcccggaactggcgctgcaacccgacctggtgctggggcgtggggaccggctgcacgtgctgcggcgtcgacgtgaaggacctgttcaccgaccacatgttcgtgaagtggaaggtcgagtacatcaagacggaggccatcgtgtgcgtggagctgaccagccaggagcggcagtgctccctcatcgaggccgggacccgcttcaacctgggccccgtcaccatcacgctgagcgagccccggaacatccagcagaagctgccgcccgagatcatcaccctgcaccccaaggtggaggaggggttcttcgacctgatgcacgtgcagaaggtcctctccgccagcaccgtgtgcaagctgcagtcctgcacccacggcatccccggcgacctccaggtgtaccacatcgggaacctcctgaagggcgaccgcatcaacgggcacctgatccacaagatcgagccccacttcaacacgagctggatgtcctgggacggctgcgacctcgactactactgcaacatgggggactggcccagctgcacctacaccggcgtcacccagcacaaccacgcggccttcgtgaacctgctgaacatcgagacggactacaccaagaccttccacttccactccaagcgggtcaccgcccacggcgacacgccccagctcgacctgaaggcccgccccacctacggggccggcgagatcaccgtgctggtggaggtcgcggacatggagctccacaccaagaaggtggagatcagcgggctgaagttcgcctccctggcctgcacgggctgctacgcctgcagctccgggatcagctgcaaggtgcggatccacgtcgacgagcccgacgagctcaccgtgcacgtgaagtccagcgacccggacgtcgtggccgcgtccaccagcctgatggcccgcaagctggagttcggcaccgacagcacgttcaaggccttctccgccatgcccaagaccagcctctgcttctacatcgtggagcgggagtactgcaagtcctgcagcgaggaggacacccagaagtgcgtcgacacccgcctggagcagccccagtccatcctgatcgagcacaagggcacgatcatcgggaagcagaacgacacgtgcaccgccaaggcgagctgctggctcgagtccgtcaagagcttcttctacggcctgaagaacatgctggggtccgtgttcggcaacttcttcatcgggatcctcctgttcctggcccccttcgtcctgctcgtgctgttcttcatgttcggctggaagatcctgttctgcttcaagtgctgccggcgcacccggggcctcctgaagtaccgccacctgaaggacgacgaggagacggggtaccgccggatcatcgagcgcctcaacaacaagaagggcaagaaccggctgctggacggggagcgcctcgccgaccggaagatcgccgagctgttcagcaccaagacccacatcggctga

SEQ ID NO: 12067 - RNA, 5052 nt, synthetic construct
  misc_feature 1..5052: note = derived and/or modified CDS sequence (opt1) from CCHFV(5180-R-2011)__KR814874.1__GP
  source 1..5052: mol_type = other RNA
atgcacaccctgctcgtgtgcttcatcctgtacctgcagctcctgggcctcgggggcgcccaccgccagagcaacgccaccgagcacaacgggacgaacaccaccaccgcgccctccacgagccagtccccgaagccgcccgtcagcaccgcgccgccctacgcccccgagtccagcaccatcaagcccaccacgcccgcctccgagaccgagggcagcggggagaccacgcccccgcccaacaccacccagggcccctccccgcccgaggccacccccgagcggcccgccaccacggccaccagcaccccctccaccgacaacacgaacagcaccacccacgccaccgacaacaaccccacgtccaccatcagcacctcccccagctccagcccctccaccccgagcacgccccagggcatccaccaccccgcccgcaacctcctgagcgtgtccagccccaagaccgcgaccaccccgacgcccacctcccccggggacatcagctccgagaccagctccctgcacagcgccatgtcccggacccccacgctccacaccgccacccaggccagcaccgagaacgccaaccactccgcgccgcgccagagcgagtccagcgcccagcagaccacgacctcccccatgaccagccccgcccagccgatcctggtgatgtccgccgcccccaccgcgatccagaacatccaccccagccccacgaaccggtccaagcgcaacctggagatggagatcatcctcaccctgagccagggcctgaagaagtactacgggaagatcctcaagctgctgcacctcaccctggaggaggacaccgagggcctgctcgagtggtgcaagcggaacctggggagcaactgcgacgacgacttcttccagaagcgcatcgaggagttcttcatgacgggcgagggctacttcaacgaggtcctgcagttcaagaccctctccaccctgagcccgaccgagccctcccacgcccggccgcccacggtggagcccttcaagagctacttcgccaaggggttcctgtccatcgacagcggctacttctccgccaagtgctacccccgcctcagcacctccgggctgcagctgatcaacgtgacccagcaccccgcccggatcgcggagacccccggcccgaagacgaccagcctcaagaccatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacaccgacggccccgtccgcctcccccacatctaccacgaggggacgttcatcccgggcacctacaagatcgtgatcgacaagaagaacaagctgaacgaccggtgcaccctggtgaccaactgcgtcatcaaggggcgcgagatccggaagggccagtccgtgctccgccagtacaagacggagatcaagatcgggaaggccagcaccggctcccggaagctgctgagcgaggagcccggcgacgactgcatcagccgcacccagctcctgcggaccgagacggccgagatccacgacgacaactacgggggccccggggacaagatcaccatctgcaacggctccaccatcgtggaccagcgcctggggagcgagctcggctgctacaccatcaaccgcgtcaagtccttcaagctgtgcgagaacagcgcgacgggcaagacctgcgagatcgactccacccccgtgaagtgccggcaggggttctgcctgaagatcacccaggagggccgcgggcacgtgaagctcagccggggctccgaggtcgtgctggacgcctgcgacacgagctgcgaggtgatgatcccgaaggggaccggcgacatcctggtcgactgctccggcgggcagcagcacttcctgaaggacaacctcatcgacctgggctgcccccacatccccctgctcgggaagatggccatctacatctgccgcatgagcaaccacccccggaccaccatggccttcctgttctggttctccttcggctacgtgatcacgtgcatcttctgcaaggcgctgttctacagcctcatcatcatcggcaccctggggaagaagatcaagcagtaccgcgagctgaagccgcagacctgcaccatctgcgagaccgcccccgtcaacgccatcgacgccgagatgcacgacctcaactgctcctacaacatctgcccctactgcgccagccggctgacgtccgacggcctggcgcgccacgtgccgcagtgccccaagcggaaggagaaggtggaggagaccgagctctacctgaacctggagcgcatcccctggatcgtccggaagctcctccaggtgagcgagtccaccggggtggccctgaagcgcagctcctggctgatcgtcctgctggtgctcctgaccgtgagcctgagccccgtccagtccgccccggtgggccacgggaagacgatcgagacctaccagacccgggagggcttcaccagcgtgtgcctcttcatgctgggctccatcctgttcctcgtcagctgcctggtgaaggggctggtggactccgtcagcgactccttcttccccggcctcagcgtgtgcaagacgtgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtctgcaagcggatgtgcttccgcgcgaccatcgaggccagccggcgcgccctgctcatccgctccatcatcaacaccaccttcgtgatctgcatcctgacgctgaccatctgcgtggtcagcacctccgccgtggagatggagaacctccccagcggcacctgggagcgggaggaggacctgacgaacttctgccaccaggagtgccaggtgaccgagaccgagtgcctgtgcccgtacgaggccctcgtcctgcgcaagcccctgttcctcgacagcatcgtgaagggcatgaagaacctgctgaactccaccagcctcgagacgtccctgagcatcgaggcgccctggggcgccatcaacgtgcagtccaccttcaagcccaccgtcagcaccgccaacatcgccctgtcctggagctccgtggagcaccgggggaacaagatcctcgtgacggggcgcagcgagtccatcatgaagctggaggagcggaccggcgtcagctgggacctgggggtggaggacgcgtccgagagcaagctcctgaccgtgtccatcatggacctgagccagatgtactccccggtcttcgagtacctcagcggcgaccgccaggtggaggagtggcccaaggcgacctgcacgggcgactgccccgagcggtgcgggtgcacctcctccacgtgcctgcacaaggagtggccccacagccgcaactggcggtgcaacccgacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctcaccagccaggagcgccagtgcagcctgatcgaggccggcacccggttcaacctgggccccgtcaccatcaccctctccgagccccgcaacatccagcagaagctgcccccggagatcatcaccctgcaccccaaggtggaggaggggttcttcgacctcatgcacgtgcagaaggtcctgagcgcctccacggtgtgcaagctgcagagctgcacccacggcatccccggggacctccaggtgtaccacatcggcaacctgctgaagggcgaccgggtcaacgggcacctcatccacaagatcgagccccacttcaacacctcctggatgagctgggacggctgcgacctggactactactgcaacatgggggactggccgtcctgcacctacacgggcgtgacccagcacaaccacgccgccttcgtgaacctgctcaacatcgagaccgactacaccaagacgttccacttccacagcaagcgcgtcaccgcccacggggacacgccccagctggacctgaaggcccggcccacctacggcgccggcgagatcaccgtgctcgtcgaggtggcggacatggagctgcacaccaagaaggtggagatctccgggctgaagttcgccagcctcgcctgcaccggctgctacgcctgctccagcgggatctcctgcaaggtccgcatccacgtggacgagcccgacgagctgaccgtgcacgtcaagagcaacgacccggacgtggtggccgcgtccacgagcctgatggcccggaagctcgagttcggcaccgactccaccttcaaggccttcagcgccatgcccaagaccagcctgtgcttctacatcgtcgagcgcgagtactgcaagtcctgcagcgaggaggacacgcagaagtgcgtggacaccaagctggagcagccccagtccatcctcatcgagcacaaggggaccatcatcggcaagcagaacgacacgtgcaccgcgaaggccagctgctggctggagtccgtcaagagcttcttctacggcctgaagaacatgctcgggtccgtgttcggcaacttcttcatcgggatcctgctgttcctcgccccgttcgtgctgctggtgctgttcttcatgttcggctggaagatcctcttctgcttcaagtgctgccggcgcacccgggggctgctgaagtaccgcctcctgaaggacgacgaggagaccggctaccgccggatcatcgagcgcctgaacaacaagaagggcaagaaccggctcctggacggggagcgcctggccgaccggaagatcgccgagctgttcagcaccaagacgcacatcggctga

SEQ ID NO: 12068 - RNA, 5052 nt, synthetic construct
  misc_feature 1..5052: note = derived and/or modified CDS sequence (opt1) from CCHFV(24-R-2012)__KR814856.1__GP
  source 1..5052: mol_type = other RNA
atgcacaccctgctcgtgtgcttcatcctgtacctgcagctcctgggcctcgggggcgcccaccgccagagcaacgccaccgagcacaacgggacgaacaccaccaccgcgccctccacgagccagtccccgaagccgcccgtcagcaccgcgccgccccacgcccccgagtccagcaccatcaagcccaccacgcccgcctccgagaccgagggcagcggggagaccacgcccccgcccaacaccacccagggcccctccccgcccgaggccacccccgagcggaccgccacgaccgccaccagcaccccctccacggacaacaccaacagcaccacccacgccacggacaacaaccccacctccaccatcagcacctcccccagctccagcccctccacgcccagcaccccgcagggcatccaccaccccgcccgcaacctcctgagcgtgtccagccccaagaccgcgaccacgcccaccccgacctcccccggggacatcagctccgagaccagctccctgcacagcgccatgtcccggacgcccaccctccacaccgccacccaggccagcaccgagaacgccaaccactccgcgccccgccagagcgagtccagcgcccagcagacgaccacctccccgatgaccagccccgcccagcccatcctggtgatgtccgccgccccgacggcgatccagaacatccaccccagccccaccaaccggtccaagcgcaacctggagatggagatcatcctcaccctgagccagggcctgaagaagtactacgggaagatcctcaagctgctgcacctcaccctggaggaggacacggagggcctgctcgagtggtgcaagcggaacctggggagcaactgcgacgacgacttcttccagaagcgcatcgaggagttcttcatgaccggcgagggctacttcaacgaggtcctgcagttcaagaccctctccaccctgagccccacggagccgtcccacgcccggccgcccaccgtggagcccttcaagagctacttcgccaaggggttcctgtccatcgacagcggctacttctccgccaagtgctacccccgcctcagcacctccgggctgcagctgatcaacgtgacccagcaccccgcccggatcgcggagacgcccggccccaagaccaccagcctcaagaccatcaactgcatcaacctgcgcgcctccgtcttcaaggagcaccgggagatcgagatcaacgtgctgctcccgcagatcgccgtgaacctgagcaactgccacgtcgtgatcaactcccacgtgtgcgactacagcctggacacggacggccccgtccgcctcccccacatctaccacgaggggaccttcatccccggcacctacaagatcgtgatcgacaagaagaacaagctgaacgaccggtgcaccctggtgacgaactgcgtcatcaaggggcgcgaggtgcggaagggccagtccgtgctccgccagtacaagaccgagatcaagatcgggaaggccagcaccggctcccggaagctgctgagcgaggagccgggcgacgactgcatcagccgcacccagctcctgcggacggagaccgccgagatccacgacgacaactacgggggccccggggacaagatcaccatctgcaacggctccaccatcgtcgaccagcgcctggggagcgagctcggctgctacacgatcaaccgcgtgaagtccttcaagctgtgcgagaacagcgcgaccggcaagacctgcgagatcgactccacccccgtgaagtgccggcaggggttctgcctgaagatcacgcaggagggccgcgggcacgtcaagctcagccggggctccgaggtggtgctggacgcctgcgacaccagctgcgaggtcatgatccccaaggggaccggcgacatcctggtggactgctccggcgggcagcagcacttcctgaaggacaacctcatcgacctgggctgcccgcacatccccctgctcgggaagatggccatctacatctgccgcatgagcaaccacccccggaccaccatggccttcctgttctggttctccttcggctacgtcatcacgtgcatcttctgcaaggcgctgttctacagcctcatcatcatcggcaccctggggaagaagatcaagcagtaccgcgagctgaagccccagacctgcaccatctgcgagacggccccggtgaacgccatcgacgccgagatgcacgacctcaactgctcctacaacatctgcccctactgcgccagccggctgacctccgacggcctggcgcgccacgtgccccagtgcccgaagcggaaggagaaggtcgaggagaccgagctctacctgaacctggagcgcatcccctggatcgtgcggaagctcctccaggtgagcgagtccaccggggtcgccctgaagcgcagctcctggctgatcgtgctgctggtgctcctgacggtcagcctgagccccgtgcagtccgcccccgtgggccacgggaagaccatcgagacctaccagacccgggagggcttcacgagcgtctgcctcttcatgctgggctccatcctgttcctcgtgagctgcctggtgaaggggctggtcgactccgtgagcgactccttcttcccgggcctcagcgtgtgcaagacctgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtcatgctggccgtgtgcaagcggatgtgcttccgcgcgaccatcgaggccagccggcgcgccctgctcatccgctccatcatcaacaccacgttcgtgatctgcatcctgaccctgaccatctgcgtcgtgagcacctccgccgtggagatggagaacctccccagcggcacgtgggagcgggaggaggacctgaccaacttctgccaccaggagtgccaggtcaccgagaccgagtgcctgtgcccctacgaggccctcgtgctgcgcaagccgctgttcctcgacagcatcgtgaagggcatgaagaacctgctgaactccacgagcctcgagacctccctgagcatcgaggcgccctggggcgccatcaacgtccagtccaccttcaagcccaccgtgagcacggccaacatcgccctgtcctggagctccgtggagcaccgggggaacaagatcctcgtcaccgggcgcagcgagtccatcatgaagctggaggagcggaccggcgtgagctgggacctgggggtggaggacgcgtccgagagcaagctcctgaccgtctccatcatggacctgagccagatgtactcccccgtgttcgagtacctcagcggcgaccgccaggtggaggagtggccgaaggccacgtgcaccggcgactgccccgagcggtgcgggtgcacctccagcacgtgcctgcacaaggagtggccccacagccgcaactggcggtgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctcacctcccaggagcgccagtgcagcctgatcgaggccggcacccggttcaacctgggcccggtgaccatcaccctctccgagccccgcaacatccagcagaagctgccgcccgagatcatcacgctgcaccccaaggtggaggaggggttcttcgacctcatgcacgtccagaaggtgctgagcgcctccaccgtgtgcaagctgcagagctgcacccacggcatccccggggacctccaggtctaccacatcggcaacctgctgaagggcgaccgggtgaacgggcacctcatccacaagatcgagccccacttcaacacctcctggatgagctgggacggctgcgacctggactactactgcaacatgggggactggccctcctgcacgtacaccggcgtgacccagcacaaccacgcggccttcgtcaacctgctcaacatcgagaccgactacacgaagaccttccacttccacagcaagcgcgtgaccgcccacggggacaccccgcagctggacctgaaggcccggcccacgtacggcgccggcgagatcaccgtcctcgtggaggtggcggacatggagctgcacaccaagaaggtcgagatctccgggctgaagttcgccagcctcgcctgcaccggctgctacgcctgctccagcgggatctcctgcaaggtgcgcatccacgtggacgagcccgacgagctgacggtccacgtcaagagcaacgaccccgacgtggtggccgcgtccaccagcctgatggcccggaagctcgagttcggcaccgactccaccttcaaggccttcagcgccatgccgaagacgagcctgtgcttctacatcgtggagcgcgagtactgcaagtcctgcagcgaggaggacacccagaagtgcgtggacaccaagctggagcagccccagtccatcctcatcgagcacaaggggaccatcatcggcaagcagaacgacacgtgcaccgcgaaggccagctgctggctggagtccgtcaagagcttcttctacggcctgaagaacatgctcgggtccgtgttcggcaacttcttcatcgggatcctgctgttcctcgcccccttcgtgctgctggtcctgttcttcatgttcggctggaagatcctcttctgcttcaagtgctgccggcgcacccgggggctgctgaagtaccgcctcctgaaggacgacgaggagaccggctaccgccggatcatcgagcgcctgaacaacaagaagggcaagaaccggctcctggacggggagcgcctggccgaccggaagatcgccgagctgttcagcacgaagacccacatcggctga

SEQ ID NO: 12069 - RNA, 5052 nt, synthetic construct
  misc_feature 1..5052: note = derived and/or modified CDS sequence (opt1) from CCHFV(46-ST-2012)__KR814860.1__GP
  source 1..5052: mol_type = other RNA
atgcacaccctgctcgtgtgcttcatcctgtacctgcagctcctgggcctcggcggggcccacgggcagagcaacgccaccgagcacaacgggaccaacaccaccaccgtccccagcaccagccagtccccgaagcccctcgtgagcaccaccccgccccacgcgctggagtccagcaccatcaagcccaccacccccacctccgagaccgaggggagcggcgagaccgcgcccctgcccaacaccacccaggggcccccgccgcccgagaccaccccggagcggcccgccaccaccgtgacctccacgcccagcaccgacaacacctccagcaccatccacgtcacggacaacaaccccacctccaccatcagcacctccccgagctccagcccctccacgcccagcacgccccagggcatccaccacccggcccggagcctcctgtccgtgagctcccccaagaccgccaccacgcccacccccaccagcccgggcgagatcaactccgagaccagctccctgcacagcgccatgtcccgcacgcccaccctccacaccgccacccaggtgagcaccgagaacgccaaccactccgcgccccggcagagcgagtccagcgcccagcccacgaccacctccctgatgaccagcccggcccagtccatcctgctcatgagcgccgcccccacggccatccagaacatccacccctccccgaccaaccgcagcaagcggaacctggagatggagatcatcctgaccctcagccaggggctgaagaagtactacggcaagatcctgaagctcctgcacctgaccctcgaggaggacacggaggggctgctggagtggtgcaagcgcaacctcggctccaactgcgacgacgacttcttccagaagcggatcgaggagttcttcatgaccggcgaggggtacttcaacgaggtcctgcagttcaagaccctgagcaccctctcccccacggagcccagccacgcccgcctgcccaccgtggagccgttcaagtcctacttcgccaagggcttcctgagcgtggactccgggtacttcagcgccaagtgctacccccggtccagcacctccggcctccagctgatcaacgtcacccagcaccccgcccgcatcgccgagacgcccggcccgaagaccaccagcctgaagaccatcaactgcatcaacctccgggcgtccgtgttcaaggagcaccgcgagatcgagatcaacgtgctgctgccccagatcgccgtcaacctcagcaactgccacgtggtgatcaactcccacgtctgcgactacagcctggacacggacgggcccgtgcggctgccccacatctaccacgagggcaccttcatcccggggacctacaagatcgtgatcgacaagaagaacaagctcaacgaccgctgcaccctggtcacgaactgcgtgatcaagggccgggaggtgcgcaaggggcagtccgtcctgcggcagtacaagaccgagatcaagatcggcaaggccagcaccggcagccgcaagctcctgtccgaggagcccggggacgactgcatcagccggacccagctgctccgcacggagaccgccgagatccacgacgacaactacggcgggcccggcgacaagatcaccatctgcaacgggtccaccatcgtggaccagcggctgggcagcgagctgggctgctacacgatcaaccgcgtgaagtccttcaagctgtgcgagaacagcgccaccgggaagacctgcgagatcgactccacccccgtcaagtgccgccagggcttctgcctcaagatcacgcaggaggggcggggccacgtgaagctgagccgcgggtccgaggtcgtgctggacgcgtgcgacagctcctgcgaggtgatgatcccgaagggcaccggcgacatcctcgtcgactgcagcgggggccagcagcacttcctgaaggacaacctgatcgacctcgggtgcccccacatccccctgctgggcaagatggccatctacatctgccggatgtccaaccacccccgcaccaccatggccttcctcttctggttcagcttcggctacgtgatcacgtgcatcttctgcaaggccctgttctactccctgatcatcatcgggacgctcggcaagaagatcaagcagtaccgggagctgaagccgcagacctgcaccatctgcgagaccgcccccgtgaacgcgatcgacgccgagatgcacgacctgaactgcagctacaacatctgcccctactgcgcctcccgcctcacgagcgacgggctggcccggcacgtcccccagtgcccgaagcgcaaggagaaggtggaggagaccgagctgtacctcaacctggagcggatcccctggatcgtgcgcaagctgctccaggtctccgagagcaccggcgtggcgctgaagcggagctcctggctgatcgtgctcctggtcctgctcaccgtgagcctgtcccccgtgcagagcgccccggtcgggcacggcaagacgatcgagacctaccagacccgcgagggcttcacctccatctgcctgttcatgctcgggagcatcctgttcctggtgtcctgcctcgtgaagggcctggtcgacagcgtgtccgacagcttcttccccgggctgtccgtgtgcaagacgtgcagcatcggctccatcaacgggttcgagatcgagagccacaagtgctactgctccctcttctgctgcccctactgccggcactgcagcgccgaccgcgagatccaccagctgcacctgtccatctgcaagaagcggaagaccggcagcaacgtcatgctcgccgtgtgcaagcgcatgtgcttccgggccaccatcgaggcgtcccgccgggccctgctgatccgcagcatcatcaacgccaccttcgtgatctgcatcctcacgctgaccatctgcgtcgtgagcacctccgccgtggagatggagagcctgcccgccggcacctgggagcgcgaggaggacctcacgaacttctgccaccaggagtgccaggtcaccgagaccgagtgcctgtgcccgtacgaggcgctggtgctccggaagcccctgttcctggactccatcgtgaaggggatgaagaacctcctgaacagcacctccctggagacgagcctctccatcgaggccccctggggcgccatcaacgtccagagcaccttcaagcccaccgtgtccaccgccaacatcgccctgagctggtccagcgtggagcaccgcgggaacaagatcctggtcacgggccggtccgagagcatcatgaagctcgaggagcgcaccggggtgtcctgggacctgggcgtggaggacgcgagcgagtccaagctgctcaccgtcagcatcatggacctgtcccagatgtacagcccggtgttcgagtacctgagcggcgaccgccaggtggaggagtggcccaaggcgacctgcacgggggactgccccgagcgctgcggctgcacctcctccacgtgcctccacaaggagtggccccactcccggaactggcgctgcaacccgacctggtgctggggcgtgggcaccgggtgcacgtgctgcggcgtggacgtgaaggacctgttcaccgaccacatgttcgtcaagtggaaggtggagtacatcaagaccgaggccatcgtgtgcgtcgagctgaccagccaggagcggcagtgctccctcatcgaggccggcacgcgcttcaacctggggcccgtgaccatcaccctgagcgagccccggaacatccagcagaagctgccgcccgagatcatcaccctgcaccccaaggtggaggagggcttcttcgacctgatgcacgtccagaaggtgctctccgcgagcacggtgtgcaagctgcagtcctgcacccacgggatccccggcgacctgcaggtctaccacatcggcaacctcctgaagggggaccgcatcaacggccacctgatccacaagatcgagccccacttcaacaccagctggatgtcctgggacgggtgcgacctcgactactactgcaacatgggcgactggcccagctgcacctacacgggggtgacccagcacaaccacgccgccttcgtcaacctgctgaacatcgagaccgactacaccaagacgttccacttccactccaagcgggtgaccgcccacggcgacacgccccagctcgacctgaaggcccgccccacctacggcgcgggggagatcacggtgctggtcgaggtggccgacatggagctccacaccaagaaggtggagatcagcggcctgaagttcgcctccctggcctgcaccgggtgctacgcctgcagctccggcatcagctgcaaggtccggatccacgtggacgagcccgacgagctcaccgtgcacgtcaagtccagcgacccggacgtggtggcggccagcacgtccctgatggcccgcaagctggagttcgggaccgacagcaccttcaaggccttctccgccatgcccaagaccagcctctgcttctacatcgtcgagcgggagtactgcaagtcctgcagcgaggaggacacgcagaagtgcgtggacacccgcctggagcagccccagtccatcctgatcgagcacaagggcaccatcatcggcaagcagaacgacacgtgcacggcgaaggccagctgctggctcgagtccgtcaagagcttcttctacgggctgaagaacatgctgggctccgtcttcgggaacttcttcatcggcatcctcctgttcctggcccccttcgtgctgctcgtgctgttcttcatgttcgggtggaagatcctgttctgcttcaagtgctgccggcgcacccggggcctcctgaagtaccgccacctgaaggacgacgaggagaccggctaccgccggatcatcgagcgcctcaacaacaagaaggggaagaaccggctgctggacggcgagcgcctcgccgaccggaagatcgcggagctgttcagcaccaagacgcacatcgggtga

SEQ ID NO: 12070 - RNA, 5052 nt, synthetic construct
  misc_feature 1..5052: note = derived and/or modified CDS sequence (opt1) from CCHFV(ROS/HUVLV-100)__DQ206448.1__GP
  source 1..5052: mol_type = other RNA
atgcacaccctgctggtgtgcttcatcctgtacctgcagctcctgggcctcggcggggcccaccgccagagcaacgccaccgagcacaacgggaccaacaccaccaccgccccctccaccagccagtccccgaagcccctcgtcagcaccgccccgccccacgccctggagtccagcaccatcaagcccaccacccccgtgtccgagaccgaggggagcggggagaccacgcccccgcccaacaccacccagggccccagcccgcccgaggccacccccgagcggcccaccaccaccgccaccagcaccccctccacggacaacaccaacagcaccacccacgtgacggacaacaaccccacctccaccatcagcacctccccgagctccagcccctccacgcccagcacgccccagggcatccaccacccggcgcgcaacctgctcagcgtctccagccccaagaccgccaccacgcccacccccacctccccgggggagatcagctccgagaccagctccctgcacagcgccatgtcccggacgagcaccctgtacaccgccacccaggtgtccaccgagaacgcgaaccacagcgcgccccgccagtccgagagctccgcccagcagacgaccaccagccccatgacctcccccgcccagagcatcctcgtgatgtccgccgcgccgacggccatccagaacatccaccccagccccaccaaccggagcaagcgcaacctggagatggagatcatcctgaccctctcccagggcctgaagaagtactacgggaagatcctgaagctcctgcacctgaccctcgaggaggacacggagggcctgctggagtggtgcaagcggaacctcgggagcaactgcgacgacgacttcttccagaagcgcatcgaggagttcttcatgaccggcgagggctacttcaacgaggtcctgcagttcaagaccctgtccaccctcagcccgacggagccctcccacgcccggccgcccaccgtggagccgttcaagagctacttcgccaaggggttcctgtccatcgacagcggctacttctccgccaagtgctacccccgcctgagcacctccgggctccagctgatcaacgtgacccagcaccccgcgcggatcgccgagacgcccggcccgaagaccaccagcctgaagaccatcaactgcatcaacctccgcgcctccgtcttcaaggagcaccgggagatcgagatcaacgtgctgctgccccagatcgccgtgaacctcagcaactgccacgtcgtgatcaactcccacgtgtgcgactacagcctggacacggacggccccgtccgcctgccccacatctaccacgaggggaccttcatcccgggcacctacaagatcgtgatcgacaagaagaacaagctcaacgaccggtgcaccctggtgacgaactgcgtcatcaaggggcgcgaggtgcggaagggccagtccgtgctgcgccagtacaagaccgagatcaagatcgggaaggccagcaccggcagccggaagctcctgtccgaggagcccggcgacgactgcatcagccgcacccagctgctccggacggagaccgcggagatccacgacgacaactacgggggccccggggacaagatcaccatctgcaacggctccaccatcgtcgaccagcgcctggggagcgagctgggctgctacacgatcaaccgcgtgaagtccttcaagctctgcgagaacagcgccaccggcaagacctgcgagatcgactccacccccgtgaagtgccggcaggggttctgcctgaagatcacgcaggagggccgcgggcacgtcaagctgagccggggctccgaggtggtcctggacgcctgcgacagctcctgcgaggtgatgatcccgaaggggaccggcgacatcctcgtggactgcagcggcgggcagcagcacttcctgaaggacaacctgatcgacctcggctgcccccacatccccctgctggggaagatggccatctacatctgccgcatgtccaaccacccccggaccaccatggccttcctcttctggttcagcttcggctacgtcatcacgtgcatcttctgcaaggcgctgttctactccctgatcatcatcggcacgctcgggaagaagatcaagcagtaccgcgagctgaagccgcagacctgcaccatctgcgagaccgcccccgtgaacgccatcgacgccgagatgcacgacctgaactgcagctacaacatctgcccctactgcgcgtcccggctcacgagcgacggcctggcccgccacgtgccccagtgcccgaagcggaaggagaaggtcgaggagaccgagctgtacctcaacctggagcgcatcccctggatcgtgcggaagctgctccaggtgtccgagagcaccggggtcgccctgaagcgcagctcctggctgatcgtgctcctggtgctgctcaccgtcagcctgtcccccgtgcagagcgccccggtgggccacgggaagacgatcgagacctaccagacccgggagggcttcacctccatctgcctgttcatgctcggcagcatcctgttcctggtctcctgcctcgtgaaggggctggtggacagcgtctccgacagcttcttccccggcctgtccgtgtgcaagacgtgcagcatcgggtccatcaacggcttcgagatcgagagccacaagtgctactgctccctcttctgctgcccctactgccgccactgcagcgccgaccgggagatccaccagctgcacctgtccatctgcaagaagcgcaagaccgggagcaacgtgatgctcgcggtctgcaagcggatgtgcttccgcgccaccatcgaggcctcccggcgcgccctgctgatccgcagcatcatcaacaccacgttcgtgatctgcatcctcaccctgaccatctgcgtggtcagcacctccgccgtggagatggagaacctgcccagcggcacgtgggagcgggaggaggacctcaccaacttctgccaccaggagtgccaggtgaccgagaccgagtgcctgtgcccgtacgaggcgctggtcctccgcaagcccctgttcctggactccatcgtgaagggcatgaagaacctcctgaacagcacgtccctggagaccagcctctccatcgaggccccctggggcgccatcaacgtgcagagcaccttcaagcccaccgtctccacggccaacatcgccctgagctggtccagcgtggagcaccggggcaacaagatcctggtgaccgggcgctccgagagcatcatgaagctcgaggagcggaccggcgtctcctgggacctgggggtggaggacgcgagcgagtccaagctgctcaccgtgagcatcatggacctgtcccagatgtacagcccggtcttcgagtacctgagcggcgaccgccaggtggaggagtggcccaaggccacgtgcaccggcgactgccccgagcggtgcgggtgcacctccagcacgtgcctccacaaggagtggccccactcccgcaactggcggtgcaacccgacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacgagccaggagcgccagtgctccctcatcgaggccggcacccggttcaacctgggccccgtcaccatcaccctgagcgagccccgcaacatccagcagaagctgccgcccgagatcatcacgctgcaccccaaggtggaggaggggttcttcgacctgatgcacgtgcagaaggtcctctccgcgagcaccgtgtgcaagctgcagtcctgcacccacggcatccccggggacctccaggtgtaccacatcggcaacctcctgaagggcgaccgggtcaacgggcacctgatccacaagatcgagccccacttcaacaccagctggatgtcctgggacggctgcgacctcgactactactgcaacatgggggactggcccagctgcacgtacaccggcgtgacccagcacaaccacgccgccttcgtcaacctgctgaacatcgagaccgactacacgaagaccttccacttccactccaagcgcgtgaccgcccacggggacacgccccagctcgacctgaaggcccggcccacgtacggcgcgggcgagatcaccgtgctggtcgaggtggccgacatggagctccacaccaagaaggtggagatcagcgggctgaagttcgcctccctggcctgcaccggctgctacgcctgcagctccgggatcagctgcaaggtccgcatccacgtggacgagcccgacgagctcacggtgcacgtcaagtccagcgacccggacgtggtggcggccagcacctccctgatggcccggaagctggagttcggcaccgacagcaccttcaaggccttctccgccatgcccaagacgagcctctgcttctacatcgtcgagcgcgagtactgcaagtcctgcagcgaggaggacacccagaagtgcgtggacaccaagctggagcagccccagtccatcctgatcgagcacaaggggaccatcatcggcaagcagaacgacacgtgcaccgcgaaggccagctgctggctcgagtccgtgaagtccttcttctacggcctgaagaacatgctggggtccgtcttcggcaacttcttcatcgggatcctcctgttcctggcccccttcgtgctgctcgtgctgttcttcatgttcggctggaagatcctgttctgcttcaagtgctgccggcgcacccgggggctcctgaagtaccgcctgctcaaggacgacgaggagaccggctaccgccggatcatcgagcgcctgaacaacaagaagggcaagaaccggctgctcgacggggagcgcctggccgaccggaagatcgcggagctgttcagcacgaagacccacatcggctga

SEQ ID NO: 12071 - RNA, 5052 nt, synthetic construct
  misc_feature 1..5052: note = derived and/or modified CDS sequence (opt1) from CCHFV(Saf)__KX013487.1__GP
  source 1..5052: mol_type = other RNA
atgcacaccctgctggtgtgcttcatcctgtacctgcagctgctgggcctcggcggggcccacgggcagagcaacgccaccgagcacaacgggaccaacaccaccaccgccccctccaccagccagtccccgaagcccctcgtcagcaccgccccgccccacgccctggagtccagcaccatcaagcccaccacccccgcctccgagaccgaggggagcggcgagaccacgccgccgcccaacaccacccagggccccagcccgcccgagaccacccccgagcgccccgccaccaccgcgaccagcaccccctccaccgacaacaccaacagcaccacccacgtgacggacaacaaccccacctccaccatcagcacctccccgagctccagcccctccacgcccagcacgccccaggggatccaccacccggcccggaacctgctcagcgtgtccagccccaagaccgccaccacgcccacccccacctccccgggcgagatcagctccgagaccagctccctgcacagcgccatgtcccgcacgagcaccctgtacaccgcgacccaggtctccaccgagaacgccaaccacagcgcgccccggcagtccgagagctccgcccagcccacgaccaccagccccatgacctccccggcccagagcatcctcgtgatgtccgcggcccccacggccatccagaacatccaccccagcccgaccaaccgcagcaagcggaacctggagatggagatcatcctgaccctctcccaggggctgaagaagtactacggcaagatcctgaagctcctgcacctgaccctcgaggaggacacggaggggctgctggagtggtgcaagcgcaacctcggcagcaactgcgacgacgacttcttccagaagcggatcgaggagttcttcatgaccggcgaggggtacttcaacgaggtgctgcagttcaagaccctgtccaccctcagccccacggagccctcccacgcccgcccgcccaccgtcgagcccttcaagagctacttcgccaagggcttcctgtccatcgacagcgggtacttctccgcgaagtgctacccccggagctccaccagcggcctgcagctcatcaacgtgacccagcaccccgcccgcatcgccgagacgcccggccccaagaccacctccctgaagaccatcaactgcatcaacctgcgggccagcgtgttcaaggagcaccgcgagatcgagatcaacgtcctcctgccccagatcgccgtgaacctgtccaactgccacgtggtcatcaacagccacgtgtgcgactactccctcgacacggacgggcccgtgcggctgccgcacatccaccacgagggcaccttcatccccgggacctacaagatcgtcatcgacaaggagaacaagctgaacgaccgctgcaccctcgtgacgaactgcgtgatcaagggccgggaggtccgcaaggggcagagcgtgctgcggcagtacaagaccgagatcaagatcggcaaggcgagcaccggctcccgcaagctgctcagcgaggagcccggggacgactgcatctcccggacccagctgctgcgcacggagaccgccgagatccacgacgacaactacggcgggcccggcgacaagatcaccatctgcaacgggagcaccatcgtggaccagcggctcggctccgagctgggctgctacacgatcaaccgcgtcaagagcttcaagctgtgcgagaactccgccaccgggaagacctgcgagatcgacagcaccccggtgaagtgccgccagggcttctgcctcaagatcacgcaggaggggcggggccacgtgaagctgtcccgcgggagcgaggtcgtgctggacgcctgcgactccagctgcgaggtcatgatccccaagggcaccggcgacatcctggtggactgctccgggggccagcagcactacctcaaggacaacctgatcgacctggggtgcccccacatccccctcctgggcaagatggccatctacatctgccggatgagcaaccacccgcgcaccaccatggcgttcctgttctggttctccttcggctacgtgatcacgtgcatcttctgcaaggccctcttctacagcctgatcatcatcgggacgctgggcaagaagatcaagcagtaccgggagctcaagccccagacctgcaccatctgcgagaccgcccccgtcaacgccatcgacgcggagatgcacgacctgaactgctcctacaacatctgcccctactgcgccagccgcctgacgtccgacgggctcgcccggcacgtgccgcagtgccccaagcgcaaggagaaggtggaggagaccgagctgtacctgaacctcgagcggatcccctggatcgtccgcaagctgctccaggtgagcgagagcaccggcgtggccctcaagcggtccagctggctgatcgtcctgctcgtgctgctgaccgtgtccctcagcccggtccagtccgcccccgtggggcacggcaagacgatcgagacctaccagacccgcgagggcttcaccagcatctgcctgttcatgctggggtccatcctcttcctggtgagctgcctggtcaagggcctcgtggactccgtgagcgactccttcttccccgggctgagcgtctgcaagacgtgctccatcggcagcatcaacgggttcgagatcgagtcccacaagtgctactgcagcctgttctgctgcccctactgccggcactgctccgcggaccgcgagatccaccagctccacctgagcatctgcaagaagcggaagaccggctccaacgtgatgctggccgtgtgcaagcgcatgtgcttccgggccaccatcgaggccagccgccgggccctcctgatccgcagcatcatcaacaccacgttcgtcatctgcatcctgaccctcaccatctgcgtggtgtccaccagcgcggtcgagatggagaacctgccgtccggcacgtgggagcgcgaggaggacctgaccaacttctgccaccaggagtgccaggtgaccgagaccgagtgcctctgcccctacgaggccctggtgctgcggaagcccctcttcagcgactccatcgtcaaggggatgaagaacctgctgaacagcacgtccctcgagaccagcctgtccatcgaggccccctggggcgccatcaacgtgcagagcaccttcaagccgaccgtgtccacggccaacatcgcgctgagctggtccagcgtcgagcaccgcgggaacaagatcctcgtgaccggccggtccgagagcatcatgaagctggaggagcgcaccggggtgtcctgggacctgggcgtcgaggacgccagcgagtccaagctcctgaccgtgagcatcatggacctgagccagatgtactcccccgtgttcgagtacctcagcggcgaccggcaggtcgaggagtggcccaaggccacgtgcaccggggactgccccgagcgctgcggctgcacctccagcacgtgcctgcacaaggagtggccgcactcccggaactggcgctgcaaccccacctggtgctggggcgtgggcaccgggtgcacgtgctgcggcgtggacgtcaaggacctgttcaccgaccacatgttcgtgaagtggaaggtggagtacatcaagaccgaggccatcgtctgcgtggagctcacgagccaggagcggcagtgctccctgatcgaggcgggcacccgcttcaacctggggcccgtgaccatcaccctcagcgagccccggaacatccagcagaagctgccgcccgagatcatcacgctgcaccccaaggtcgaggagggcttcttcgacctcatgcacgtgcagaaggtgctgtccgccagcaccgtctgcaagctgcagtcctgcacccacgggatccccggcgacctccaggtgtaccacatcggcaacctgctgaagggggaccgcgtgaacggccacctcatccacaagatcgagccgcacttcaacaccagctggatgtcctgggacgggtgcgacctggactactactgcaacatgggcgactggcccagctgcacgtacaccggggtcacccagcacaaccacgccgccttcgtgaacctgctcaacatcgagaccgactacatgaagacgttccacttccactccaagcgggtcaccgcccacggcgacacgccccagctggacctgaaggcgcgccccacctacggcgccggggagatcacggtgctcgtggaggtcgccgacatggagctgcacaccaagaaggtggagatcagcggcctgaagttcgtgtccctcgcctgcaccgggtgctacgcctgcagctccggcatcagctgcaaggtccggatccacgtggacgagccggacgagctgaccgtgcacgtcaagagctccgaccccgacgtggtggcggccagcacgtccctgatggcccgcaagctcgagttcgggaccgacagcaccttcaaggccttctccgccatgcccaagaccagcctgtgcttctacatcgtcgagcgggagtactgcaagtcctgcagcgaggaggacacgcagaagtgcgtggacaccaagctggagcagccccagtccatcctcatcgagcacaagggcaccatcatcggcaagcagaacgacacgtgcacggcgaaggccagctgctggctggagtccgtgaagtccttcttctacgggctgaagaacatgctcggctccgtcttcgggaacttcttcatcggcatcctgctgttcctcgccccgttcgtgctgctggtgctgttcttcatgttcgggtggaagatcctcttctgcttcaagtgctgccgccggacccgcggcctgctgaagtaccggcacctcaaggacgacgaggagaccggctaccgccgcatcatcgagcggctgaacaacaagaaggggaagaaccgcctgctcgacggcgagcggctggccgaccgcaagatcgcggagctgttcagcaccaagacgcacatcgggtga

SEQ ID NO: 12072 - RNA, 5052 nt, synthetic construct
  misc_feature 1..5052: note = derived and/or modified CDS sequence (opt1) from CCHFV(52-R-2014)__KR814862.1__GP
  source 1..5052: mol_type = other RNA
atgcacaccctgctcgtgtgcttcatcctgtacctgcagctcctgggcctcgggggcgcccaccgccagagcaacgccaccgagcacaacgggacgaacaccaccaccgcgccctccacgagccagtccccgaagccgcccgtcagcaccgcgccgccccacgcccccgagtccagcaccatcaagcccaccacgcccgcctccgagaccgagggcagcggggagaccacgcccccgcccaacaccacccagggcccctccccgcccgaggccacccccgagcggcccgccaccacggccaccagcaccccctccaccgacaacacgaacagcaccacccacgccaccgacaacaaccccacgtccaccatcagcacctcccccagctccagcccctccaccccgagcacgccccagggcatccaccaccccgcccgcaacctcctgagcgtgtccagccccaagaccgcgaccaccccgacgcccacctcccccggggacatcagctccgagaccagctccctgcacagcgccatgtcccggacccccacgctccacaccgccacccaggccagcaccgagaacgccaaccactccgcgccgcgccagagcgagtccagcgcccagcagaccacgacctcccccatgaccagccccgcccagccgatcctggtgatgtccgccgcccccaccgcgatccagaacatccaccccagccccacgaaccggtccaagcgcaacctggagatggagatcatcctcaccctgagccagggcctgaagaagtactacgggaagatcctcaagctgctgcacctcaccctggaggaggacaccgagggcctgctcgagtggtgcaagcggaacctggggagcaactgcgacgacgacttcttccagaagcgcatcgaggagttcttcatgacgggcgagggctacttcaacgaggtcctgcagttcaagaccctctccaccctgagcccgaccgagccctcccacgcccggccgcccacggtggagcccttcaagagctacttcgccaaggggttcctgtccatcgacagcggctacttctccgccaagtgctacccccgcctcagcacctccgggctgcagctgatcaacgtgacccagcaccccgcccggatcgcggagacccccggcccgaagacgaccagcctcaagaccatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacaccgacggccccgtccgcctcccccacatctaccacgaggggacgttcatcccgggcacctacaagatcgtgatcgacaagaagaacaagctgaacgaccggtgcaccctggtgaccaactgcgtcatcaaggggcgcgaggtgcggaagggccagtccgtgctccgccagtacaagacggagatcaagatcgggaaggccagcaccggctcccggaagctgctgagcgaggagcccggcgacgactgcatcagccgcacccagctcctgcggaccgagacggccgagatccacgacgacaactacgggggccccggggacaagatcaccatctgcaacggctccaccatcgtcgaccagcgcctggggagcgagctcggctgctacaccatcaaccgcgtgaagtccttcaagctgtgcgagaacagcgcgacgggcaagacctgcgagatcgactccacccccgtgaagtgccggcaggggttctgcctgaagatcacccaggagggccgcgggcacgtcaagctcagccggggctccgaggtggtgctggacgcctgcgacacgagctgcgaggtcatgatcccgaaggggaccggcgacatcctggtggactgctccggcgggcagcagcacttcctgaaggacaacctcatcgacctgggctgcccccacgtccccctgctcgggaagatggccatctacatctgccgcatgagcaaccacccccggaccaccatggccttcctgttctggttctccttcggctacgtgatcacgtgcatcttctgcaaggcgctgttctacagcctcatcatcatcggcaccctggggaagaagatcaagcagtaccgcgagctgaagccgcagacctgcaccatctgcgagaccgcccccgtgaacgccatcgacgccgagatgcacgacctcaactgctcctacaacatctgcccctactgcgccagccggctgacgtccgacggcctggcgcgccacgtcccgcagtgccccaagcggaaggagaaggtggaggagaccgagctctacctgaacctggagcgcatcccctggatcgtgcggaagctcctgcaggtcagcgagtccaccggggtggccctgaagcgcagctcctggctcatcgtgctgctggtcctcctgaccgtgagcctgagccccgtgcagtccgccccggtcggccacgggaagacgatcgagacctaccagacccgggagggcttcaccagcgtgtgcctcttcatgctgggctccatcctgttcctcgtgagctgcctggtcaaggggctggtggactccgtgagcgactccttcttccccggcctcagcgtctgcaagacgtgctccatcgggagcatcaacggcttcgagatcgagtcccacaagtgctactgcagcctgttctgctgcccctactgccgccactgctccgccgaccgggagatccaccagctgcacctcagcatctgcaagaagcgcaagatggggtccaacgtgatgctggccgtgtgcaagcggatgtgcttccgcgcgaccatcgaggccagccggcgcgccctgctcatccgctccatcatcaacaccaccttcgtcatctgcatcctgacgctgaccatctgcgtggtgagcacctccgccgtcgagatggagaacctccccagcggcacctgggagcgggaggaggacctgacgaacttctgccaccaggagtgccaggtgaccgagaccgagtgcctgtgcccgtacgaggccctcgtgctgcgcaagcccctgttcctcgacagcatcgtcaagggcatgaagaacctgctgaactccaccagcctcgagacgtccctgagcatcgaggcgccctggggcgccatcaacgtgcagtccaccttcaagcccaccgtgagcaccgccaacatcgccctgtcctggagctccgtcgagcaccgggggaacaagatcctcgtgacggggcgcagcgagtccatcatgaagctggaggagcggaccggcgtgagctgggacctgggggtcgacgacgcgtccgagagcaagctcctgaccgtgtccatcatggacctgagccagatgtactccccggtgttcgagtacctcagcggcgaccgccaggtcgaggagtggcccaaggcgacctgcacgggcgactgccccgagcggtgcgggtgcacctcctccacgtgcctgcacaaggagtggccccacagccgcaactggcggtgcaacccgacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcaccagccaggagcgccagtgcagcctgatcgaggccggcacccggttcaacctgggccccgtgaccatcaccctctccgagccccgcaacatccagcagaagctgcccccggagatcatcaccctgcaccccaaggtcgaggaggggttcttcgacctcatgcacgtgcagaaggtgctgagcgcctccacggtctgcaagctgcagagctgcacccacggcatccccggggacctccaggtgtaccacatcggcaacctgctgaagggcgaccgggtgaacgggcacctcatccacaagatcgagccccacttcaacacctcctggatgagctgggacggctgcgacctggactactactgcaacatgggggactggccgtcctgcacctacacgggcgtcacccagcacaaccacgccgccttcgtgaacctgctcaacatcgagaccgactacaccaagacgttccacttccacagcaagcgcgtcaccgcccacggggacacgccccagctggacctgaaggcccggcccacctacggcgccggcgagatcaccgtgctcgtggaggtcgcggacatggagctgcacaccaagaaggtggagatctccgggctgaagttcgccagcctcgcctgcaccggctgctacgcctgctccagcgggatctcctgcaaggtgcgcatccacgtcgacgagcccgacgagctgaccgtgcacgtcaagagcaacgacccggacgtggtggccgcgtccacgagcctgatggcccggaagctcgagttcggcaccgactccaccttcaaggccttcagcgccatgcccaagaccagcctgtgcttctacatcgtggagcgcgagtactgcaagtcctgcagcgaggaggacacgcagaagtgcgtcgacaccaagctggagcagccccagtccatcctcatcgagcacaaggggaccatcatcggcaagcagaacgacacgtgcaccgcgaaggccggctgctggctggagagcgtgaagtccttcttctacgggctgaagaacatgctcggcagcgtgttcgggaacttcttcatcggcatcctgctgttcctcgccccgttcgtcctgctggtgctgttcttcatgttcgggtggaagatcctcttctgcttcaagtgctgccggcgcacccggggcctgctgaagtaccgcctcctgaaggacgacgaggagaccggctaccgccggatcatcgagcgcctgaacaacaagaaggggaagaaccggctcctggacggcgagcgcctggccgaccggaagatcgccgagctgttctccaccaagacgcacatcgggtga

SEQ ID NO: 12073 - RNA, 5052 nt, synthetic construct
  misc_feature 1..5052: note = derived and/or modified CDS sequence (opt1) from CCHFV(Turkey-Kelkit06)__GQ337054.1__GP
  source 1..5052: mol_type = other RNA
atgcacacgcccctggtgtgcttcatcctctacctgcagctgctctgcctgggcggggcccacggccagctgaacgccaccgagcacaacgggaccaacaacaccaccgcgccgggcgccagccagtcccccaagccgcccatgagcaccacgccgccccacgcccccgagtccagcaccatcaagcccaccacccccatctccgaggccgaggggagcggcgagacgacctccccgcccaacaccacccagggcctcagctcccccgagacgaccagcgagcgccccgccaccacctccatcagcacgtccagcaccgactccaccaaccccaccacgcagatgaccgacaacacccccacccccacggtcagcacctccccgagctccagccccagcaccccctccacgccccaggggatccaccacccggcgcggagcctgctgtccgtgagctcccccaagaccgtgaccacccccacccccacgagcccgggcgagatgtccagcgagacctccagccagcactccgccatgagccgcatccccacgccccacaccgccacccgggtctccaccgagatcaccaaccaccgcacgccccggcagagcgagtccagcgcccagcagaccaccccgtcccccatgaccagccccgcgcagtccatcctcctgatgagcgccgccccgaccgccgtgcaggacatccaccccagccccaccaaccgctccaagcggaacctggagacggagatcatcctcaccctgagccaggggctgaagaagtactacggcaagatcctcaagctgctgcacctcaccctggagcaggacaccgaggggctgctcgagtggtgcaagggcaacctgggctccaactgcgacgacgacttcttccagaagcgcatcgaggagttcttcatgacgggggagtgctacttcaacgaggtgctgcagttcaagaccctcagcaccctgtcccccaccgagccgagccacgcccggctgcccacggcggagcccttcaagtcctacttcgccaagggcttcctcagcatcgactccgggtacttcagcgccaagtgctacccccgctccagcgcctccggcctgcagctgatcaacgtcacccagcacccggcccggatcgcggagacccccggccccaagaccacgagcctcaagaccatcaactgcatcaacctgcgcgcctccgtgttcaaggagcaccgggaggtggagatcaacgtcctgctcccccagatcgccgtgaacctgagcaactgccacgtggtcatcaactcccacgtgtgcgactacagcctggacaccgacgggccggtgcgcctcccccggatctaccacgagggcaccttcatccccgggacgtacaagatcgtcatcgacaagaagaacaagctgaacgaccgctgcaccctggtgaccaactgcgtgatcaagggccgggaggtccgcaaggggcagagcgtgctccggcagtacaagaccgagatcaagatcggcaaggcctccacgggcttccgcaagctgctgagcgaggagcccggggacgactgcatctcccggacccagctcctgcgcaccgagaccgccgagatccacgacgacaactacggcgggccgggcgacaagatcacgatctgcaacgggagcaccatcgtggaccagcgcctgggctccgagctcggctgctacaccatcaaccgggtcaagagcttcaagctgtgcaagaactccgcgaccgggaagacgtgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcaccggcgacatcctggtggactgctccgggggccagcagcacttcctgaaggacaacctcatcgacctggggtgcccccacatcccgctgctcggccggatggccatctacatctgccgcatgagcaaccacccccggacgaccatggccttcctgttctggttctccttcggctacgtcatcacgtgcatcttctgcaaggccctgttctacagcctcatcatcatcgggaccctgggcaagaagatcaagcagtaccgcgagctgaagccccagacctgcaccatctgcgagaccgcgcccgtgaacgccatcgacgccgagatgcacgacctcaactgctcctacaacatctgcccgtactgcgccagccggctgacctccgacgggctggcgcgccacgtgacccagtgccccaagcggaaggagaaggtcgaggagacggagctctacctgaacctggagcgcatcccctggatcgtgcggaagctcctccaggtgagcgagagcaccggcgtcgccctgaagcgctccagctggctgatcgtgctgctggtgctcctgaccgtctccctgagcccggtgcagtccgcccccgtggggcacggcaagaccatcgagatctaccagacgcgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccctactgccgccactgctccgccgaccgggagatccaccagctgcacctgagcatctgcaagaagcgcaagaccggctccaacgtcatgctcgcggtgtgcaagcggatgtgcttccgcgccaccatcgaggccagccgccgggccctgctgatccgcagcatcatcaacacgaccttcgtgatctgcatcctcaccctgaccatctgcgtcgtgtccacgagcgccgtggagatggagaacctgccggcgggcacctgggagcgggaggaggacctcaccaacttctgccaccaggagtgccaggtcaccgagacggagtgcctgtgcccctacgaggccctggtgctccgcaagcccctgttcctggactccatcgtgaaggggatgaagaacctcctgaacagcacctccctggagaccagcctctccatcgaggccccctggggcgccatcaacgtccagagcaccttcaagccgacggtgtccaccgccaacatcgcgctgagctggtccagcgtggtccaccgggggaacaagatcctggtgaccggccgctccgagagcatcatgaagctcgaggagcggaccggggtgtcctgggacctgggcgtcgaggacgccagcgagtccaagctgctcacggtgagcatcatggacctgtcccagatgtacagccccgtgttcgagtacctgagcggcgaccgccaggtcgaggagtggcccaaggcgacctgcaccggggactgccccgagcggtgcggctgcacctccagcacgtgcctccacaaggagtggtcccacagccgcaactggcggtgcaacccgacctggtgctggggcgtggggaccgggtgcacgtgctgcggcgtggacgtcaaggacctgttcaccgaccacatgttcgtgaagtggaaggtggagtacatcaagaccgaggccatcgtctgcgtggccctgacctcccaggagcgccagtgcagcctcatcgaggccggcacccggttcaacctggggcccgtgaccatcacgctgtccgagccccgcaacatccagcagaagctgcccccggagatcatcaccctccaccccaagatcgaggagggcttcttcgacctgatgcacgtccagaaggtgctcagcgcctccaccgtgtgcaagctgcagagctgcacccacgggatccccggcgacctgcaggtctaccacatcggcaacctcctgaagggggaccgggtgaacggccacctgatccacaagatcgagtcccacttcaacacgagctggatgtcctgggacgggtgcgacctcgactactactgcaacatgggcgactggcccagctgcacctacaccggggtcacccagcacaaccacgccgccttcgtgaacctgctgaacatcgagacggactacaccaagaccttccacttccactccaagcgcgtgaccgcgcacggcgacacgccgcagctcgacctgaaggcccggcccacctacggcgccgggggcatcaccgtcctggtggaggtggccgacatggagctccacaccaagaaggtcgagatcagcgggctgaagttcgcctccctggcgtgcacgggctgctacgcctgcagctccgggatcagctgcaaggtgcgcatccacgtggacgagcccgacgagctcaccgtccacgtcaagagctccgaccccgacgtggtggccgccagcacctccctgatggcccggaagctggagttcggcaccgacagcacgttcaaggcgttctccgccatgccgaagaccagcctctgcttctacatcgtggagcgcgagtactgcaagtcctgcagcgaggacgacacccagaagtgcgtggacacccggctggagcagccccagtccatcctgatcgagcacaagggcacgatcatcgggaagcagaacgacacgtgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacccggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctga

SEQ ID NO: 12074 - RNA, 5052 nt, synthetic construct
  misc_feature 1..5052: note = derived and/or modified CDS sequence (opt1) from CCHFV(V42/81)__GU477490.1__GP
  source 1..5052: mol_type = other RNA
atgcacaccctgctcgtgtgcttcatcctgtacctgcagctcctgggcctcgggggcgcccacgtccagcccaacgccaccgagcacaaccgcacgaacaccaccaccgcgccggggacgagccactccctcaagcccctggtgagcaccaccccgccccaggcccccgagtccagcaccatcaagcccacgacccccacctccgagaccgagggcagcggggaggccacgcccctgtccaacaccatccaggccccgagctcccccgagaccaccagcgagcggcccgccacggcggtgatctccaccagcggcaccgactccaccaacagcacgacccagaccaccgacaacaaccccacgaccaccgtcggcacctccccgagctccagcccctccacgcccagcacgccccaggggatccaccaccacgcccgcagcctcctgtccgtgaccagcccggagaccgtgaccacccccaagcccaccagcccccgggagatgtcctccgagaccagcaaccagcactccgccatgagccgcacgccgacccaccacaccgtcacccaggtgtccaccgagaacacgagccactccacgccccggcagcccgagagctccgcccagcccaccagctccagcccgatgacctcccccgcgcagagcaccctgctcatgtccgccgcccccaccgccgtgcagagcatccaccccagcccgaccaaccgctccaagcggaacctggagaccgagatcatcctgacgctcagccagggcctgaagaagtactacgggaagatcctgaagctcctgcacctgaccctcgaggaggacaccgagggcctgctggagtggtgcaagcgcaacctcgggtccaactgcgacgacgacttcttccagaagcggatcgaggagttcttcatgaccggcgagggctacttcaacgaggtcctgcagttcaagacgcccagcaccgtgtcccccaccgagccgagccacgcccgcctgcccaccgcggagcccttcaagtcctacttcgccaaggggttcctcagcatcgactccggctacttcagcgccaagtgctactcccggagctccacgagcgggctgcagctgatcaacgtgacccagcaccccgcccgcatcgccgagaccccgggccccaagaccacgtccctcaagaccatcaactgcatcaacctgcgggcgagcgtcttcaaggagaaccgcgagatcgagatctccgtgctgctcccccagatcgccgtgaacctgagcaactgccacgtcgtgatcaacagccacgtgtgcgactactccctggacaccgacggccccgtccggctcccgcgcatcaaccacgaggggaccttcatccccggcacgtacaagatcgtgatcgacaagaagaacaagctgaacgaccggtgcaccctggtgaccaactgcgtcatcaaggggcgcgaggtgcggaagggccagagcgtgctccgccagtacaagaccgagatcaagatcgggaaggcctccacgggcagccggaagctgctgtccaaggagcccggcgacgactgcatcagccgcacccagctcatgcgcaccgagaccgccgagatccacgacgacaactacgggggccccggggacaagatcacgatctgcaacggctccaccatcgtcgaccagcggctggggagcgagctgggctgctacaccatcaaccgcgtgaagtccttcaagctctgcgagaacagcgccaccggcaaggcgtgcgaggtcgactccacgccggtgaagtgccggcaggggttctgcctgaagatcacccaggagggccgcgggcacgtgaagctgagccggggctccgaggtcgtgctcgacgcctgcgacagctcctgcgaggtgatgatccccaaggggaccggcgacatcctggtcgactgcagcggcgggcagcagcacttcctgaaggacaacctgatcgacctcgagtgcccccacatccccctgctgggcaagctcgccatctacatctgccgcatgtccaaccacccgcggaccaccatggccttcctgttctggttcgggttcggctacgtgatcacgtgcatcctgtgcaaggccctcttctacagcctgatcatcatcggcaccctggggaagaagatcaagcagtaccgcgagctcaagccccagacctgcaccatctgcgagacggcgcccgtgaacgccatcgacgccgagatgcacgacctgaactgctcctacaacatctgcccctactgcgccagccggctgaccagcgacggcctcgcgcgccacgtcacccagtgcccgaagcggaaggagaaggtggaggagaccgagctgtacctgaacctcgagcgcatcccctggatcgtgcggaagctgctgcaggtctccgagagcacgggggtggtgctcaagcgctccagctggctgatcgtcctgctcgtgctgctgaccgtgtccctcagccccgtccagtccgcccccgtgggccacgggaagaccatcgagacctaccagacgcgggagggcttcaccagcatctgcctgttcatgctgggctccatcctcttcatcgtgagctgcatcgtcaaggggctggtggactccgtgagcgactccttcttcccgggcctgagcgtctgcaagacctgctccatcagctccatcaacgggttcgagatcgagagccacaagtgctactgctccctcttctgctgcccctactgccgccactgcagcgccgaccgggagatccaccagctgcacctgagcatctgccgcaagcggcgcaccggctccaacgtgatgctcgccgtgtgcaagcgcatgtgcttccgggccacgatcgaggtcagccgccgggcgctgctgatccgctccatcatcaacaccaccttcgtgatctgcatcctcaccctgacgatctgcgtggtcagcacctccgccgtggagatggagaacctgcccgccgggacctgggagcgggaggaggacctcaccaacttctgccaccaggagtgccaggtgacggagaccgagtgcctgtgcccgtacgaggccctggtcctccgcaagcccctgttcctggacagcatcgtgaagggcaagaagaacctcctgaactccaccagcctggagacctccctcagcatcgaggccccctggggcgcgatcaacatccagtccacgttcaagcccaccgtgagcgccgccaacatcgccctgtcctggagctccgtcgagcaccgggggaacaagatcctggtgagcggccgctccgagagcatcatgaagctcgaggagcggaccggggtgtcctggaacctgggcgtcgaggacgccagcgagagcaagctgctcaccgtgtccatcatggacctgagccagatgtactccccggtgttcgagtacctgagcggggaccgccaggtcgaggagtggcccaaggcgacgtgcaccggcgactgccccgagcggtgcggctgcacctcctccacgtgcctccacaaggagtggccccacagccgcaactggcggtgcaacccgacctggtgctggggcgtggggaccgggtgcacgtgctgcggcgtggacgtcaaggacctgttcatcgaccacatgttcgtgaagtggaaggtggagtacatcaagaccgaggccatcgtctgcgtggagctgaccagccaggagcgccagtgctccctcatcgaggccgggacccggttcaacctgggccccgtgaccatcaccctgagcgagccccgcaacatccagcagaagctgcccccggagatcatcaccctgcaccccaagatcgaggagggcttcttcgacctgatgcacgtccagaaggtgctctccgccagcacggtctgcaagctgcagtcctgcacccacgggatccccggcgacctccaggtgtaccacatcgggaacctcctgaagggcgaccgggtgaacggccacctgatccacaagatcgagccccacttcaacaccagctggatgtcctgggacgggtgcgacctcgactactactgcaacatgggcgactggccgagctgcacctacacgggggtcacccagcacaaccacgcggccttcgtgaacctgctgaacatcgagaccgactacaccaagacgttccacttccactccaagcgcgtgaccgcccacggcgagacgccccagctcgacctgaaggcccggcccgcctacggggcgggcgagatcaccgtcctggtggaggtggccgacatggagctccacaccaagaaggtcgagatcagcggcctgaagttcgcctccctggcctgcaccgggtgctacgcctgcagcagcggcatctcctgcaaggtgcgcatccacgtggacgagcccgacgagctcaccgtccacgtcaagagcaacgacccggacgtggtggcggcctccaccagcctgatggcccggaagctggagtccgggacggacagcaccttcaaggccttctccgccatgcccaagaccagcctctgcttctacatcgtggagcgcgagtactgcaagtcctgcagcgaggacgacacccagaagtgcgtggagacgaagctggagcagccccagtccatcctgatcgagcacaagggcaccatcatcgggaagcagaacgacacgtgcaccgcgaaggccagctgctggctcgagtccgtcaagagcttcttctacggcctgaagaacatgctgggctccgtgttcgggaacttcttcatcggcatcctcctgttcctggcccccttcgtgctcctggtcctgttcttcatgttcgggtggaagatcctgttctgcttcaagtgctgccgccggacccgcggcctcttcaagtaccggcacctgaaggaggacgaggagaccgggtaccgccggatcatcgagcgcctgaacagcaagaagggcaagaaccggctcctggacggcgagcgcctggccgaccggaagatcgcggagctgttctccaccaagacccacatcgggtga

SEQ ID NO: 12075 - RNA, 5052 nt, synthetic construct
  misc_feature 1..5052: note = derived and/or modified CDS sequence (opt1) from CCHFV(75-R-2012)__KR814863.1__GP
  source 1..5052: mol_type = other RNA
atgcacaccctgctggtgtgcttcatcctgtacctgcagctcctgggcctcggcggggcccaccgccagagcaacgccaccgggcacaacgggaccaacaccaccaccgccccctccaccagccagtccccgaagcccctcgtcagcaccgccccgccccacgccctggagtccagcatcatcaagcacaccacccccgtgtccgagaccgaggggagcggcgagaccacgcccccgcccaacaccacccagggccccagccccctggagaccacccccgagcggcccgccaccaccgccaccagcaccccgtccaccgacaacacgaacagcaccacccacgtgaccgacaacaaccccacgtccaccatcagcacctcccccagctccagcccctccaccccgagcacgccccaggggatccaccaccccgcgcgcaacctcctgagcgtctccagcctgaagaccgccaccacccccacgccgacctcccccggcgagatcagctccgagaccagctccctccacagcgccatgtcccggaccagcacgctgtacaccgccacccaggtgtccaccgagaacgccaaccacagcgcgccccgccagtccgagagctccgcccagcagaccacgaccagccccatgacctccccggcccagagcatcctggtgatgtccgccgcgcccaccgccatccagaacacgcaccccagccccaccaaccggagcaagcgcaacctcgagatggagatcatcctgaccctgtcccaggggctcaagaagtactacggcaagatcctgaagctgctccacctgaccctggaggaggacacggaggggctcctggagtggtgcaagcggaacctgggcagcaactgcgacgacgacttcttccagaagcgcatcgaggagttcttcatgaccggcgaggggtacttcaacgaggtgctccagttcaagaccctgtccacccagagcccgacggagccctcccacgcccggcccccgaccgtggagcccttcaagagctacttcgccaagggcttcctgtccatcgacagcgggtacttctccgccaagtgctacccccgcctcagcacctccggcctgcagctgatcaacgtgacccagcaccccgcgcggatcgccgagacgccgggccccaagaccaccagcctcaagaccatcaactgcatcaacctgcgcgcctccgtcttcaaggagcaccgggagatcgagatcaacgtgctgctcccccagatcgccgtgaacctgagcaactgccacgtcgtgatcaactcccacgtgtgcgactacagcctggacacggacgggcccgtccgcctcccgcacatctaccacgagggcaccttcatccccgggacctacaagatcgtgatcgacaagaagaacaagctgaacgaccggtgcaccctggtgacgaactgcgtcatcaagggccgcgaggtgcggaaggggcagtccgtgctccgccagtacaagaccgagatcaagatcggcaaggccagcaccggcagccggaagctgctgtccgaggagcccggggacgactgcatcagccgcacccagctcctgcggacggagaccgcggagatccacgacgacaactacggcgggcccggcgacaagatcaccatctgcaacgggtccaccatcgtcgaccagcgcctgggcagcgagctcggctgctacacgatcaaccgcgtgaagtccttcaagctgtgcgagaacagcgccaccgggaagacctgcgagatcgactccgccccggtgaagtgccggcagggcttctgcctgaagatcacccaggaggggcgcggccacgtcaagctgagccgggggtccgaggtggtcctcgacgcctgcgacagctcctgcgaggtgatgatccccaagggcacgggcgacatcctggtggactgcagcgggggccagcagcacttcctgaaggacaacctcatcgacctggggtgcccccacatccccctgctcggcaagatggccatctacatctgccgcatgtccaaccacccgcggaccaccatggcgttcctgttctggttcagcttcggctacgtcatcacgtgcatcttctgcaaggccctgttctactccctcatcatcatcgggaccctgggcaagaagatcaagcagtaccgcgagctgaagccccagacgtgcaccatctgcgagaccgcccccgtgaacgccatcgacgcggagatgcacgacctcaactgcagctacaacatctgcccctactgcgcctcccggctgaccagcgacgggctggcccgccacgtgccgcagtgccccaagcggaaggagaaggtcgaggagacggagctctacctgaacctggagcgcatcccctggatcgtgcggaagctcctccaggtgtccgagagcaccggcgtcgccctgaagcgcagctcctggctcatcgtgctgctggtgctcctgaccgtcagcctgtcccccgtgcagagcgccccggtggggcacggcaagaccatcgagacgtaccagacccgggagggcttcacctccatctgcctcttcatgctggggagcatcctgttcctcgtctcctgcctggtgaagggcctggtgaacagcgtctccgacagcttcttccccgggctctccgtgtgcaagacctgcagcatcggctccatcaacgggttcgagatcgagagccacaagtgctactgctccctgttctgctgcccctactgccgccactgcagcgcggaccgggagatccaccagctgcacctctccatctgcaagaagcgcaagacgggcagcaacgtgatgctggccgtctgcaagcggatgtgcttccgcgccaccatcgaggcctcccggcgcgccctgctcatccgcagcatcatcaacaccaccttcgtgatctgcatcctgacgctgaccatctgcgtggtcagcacctccgcggtggagatggagaacctcccgagcggcacctgggagcgggaggaggacctgacgaacttctgccaccaggagtgccaggtgaccgagaccgagtgcctgtgcccctacgaggccctcgtcctgcgcaagcccctgttcctcgactccatcgtgaaggggatgaagaacctgctgaacagcacctccctcgagacgagcctgtccatcgaggccccctggggcgccatcaacgtgcagagcaccttcaagccgaccgtctccaccgccaacatcgcgctgagctggtccagcgtggagcaccgggggaacaagatcctcgtgacgggccgctccgagagcatcatgaagctggaggagcggaccggggtctcctgggacctgggcgtggaggacgccagcgagtccaagctcctgaccgtgagcatcatggacctgtcccagatgtacagccccgtcttcgagtacctcagcggcgaccgccaggtggaggagtggcccaaggcgacctgcacgggggactgccccgagcggtgcggctgcacctcctccacgtgcctgcacaaggagtggccgcactcccgcaactggcggtgcaaccccacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctcaccagccaggagcgccagtgctccctgatcgaggcgggcacgcggttcaacctggggcccgtcaccatcaccctcagcgagccccgcaacatccagcagaagctgccgcccgagatcatcaccctgcaccccaaggtggaggagggcttcttcgacctcatgcacgtgcagaaggtcctgtccgccagcacggtgtgcaagctgcagtcctgcacccacgggatccccggcgacctccaggtgtaccacatcggcaacctgctgaagggggaccgggtcaacggccacctcatccacaagatcgagccgcacttcaacaccagctggatgtcctgggacgggtgcgacctggactactactgcaacatgggcgactggcccagctgcacctacacgggggtgacccagcacaaccacgccgccttcgtcaacctgctcaacatcgagaccgactacaccaagacgttccacttccactccaagcgcgtgaccgcccacggcgacacgccccagctggacctgaaggcgcggcccacctacggcgccggggagatcacggtgctcgtcgaggtggccgacatggagctgcacaccaagaaggtggagatcagcggcctgaagttcgcctccctcgcctgcaccgggtgctacgcgtgcagctccggcatcagctgcaaggtccgcatccacgtggacgagccggacgagctgaccgtgcacgtcaagtccagcgaccccgacgtggtggccgccagcacgtccctgatggcccggaagctcgagttcgggaccgacagcaccttcaaggccttctccgcgatgcccaagaccagcctgtgcttctacatcgtcgagcgcgagtactgcaagtcctgcagcgaggaggacacgcagaagtgcgtggacaccaagctggagcagccccagtccatcctcatcgagcacaagggcaccatcatcggcaagcagaacgacacgtgcacggccaaggccagctgctggctggagtccgtcaagagcttcctgtacgggctcaagaacatgctgggctccgtcttcgggaacttcttcatcggcatcctgctgttcctcgccccgttcgtgctgctggtgctgttcttcatgttcgggtggaagatcctgttctgcttcaagtgctgccggcgcacccggggcctgctcaagtaccgcctgctgaaggacgacgaggagaccggctaccgccggatcatcgagcgcctcaacaacaagaaggggaagaaccggctgctggacggcgagcgcctcgcggaccggaagatcgccgagctgttcagcaccaagacgcacatcgggtga

SEQ ID NO: 12076 - RNA, 5052 nt, synthetic construct
  misc_feature 1..5052: note = derived and/or modified CDS sequence (opt1) from CCHFV(VLG/TI29414)__AY179961.1__GP
  source 1..5052: mol_type = other RNA
atgcacaccctgctggtgtgcttcatcctgtacctgcagctcctgggcctcgggggcgcccacatccagagcaacgccaccgagcacaacgggaccaacaccaccaccgccccctccaccagccagtccccgaagcccctcgtcagcaccgccccgccccacgccctggagtccagcaccatcaagcccaccacccccgtgtccgagaccgagggcagcgggggcaccacgcccccgcccaacaccacccagggccccagcccgcccgaggccacccccgagcgccccgccaccacggcgaccagcaccccctccaccgacaacacgaacagcaccacccacgtgaccgacaacaaccccacgtccaccatcagcacctccccgagctccagcccctccacccccagcacgccccaggggatccaccacccggcccggaacctgctcagcgtctccagccccaagaccgccaccacccccacgcccacctccccgggcgacatcagctccgagaccagctccctgcacagcgccatgtcccgcaccagcacgctgtacaccgcgacccaggtgtccaccgagaacgccaaccacagcgcgccccggcagtccgagagctccgcccagcagaccacgaccagccccatgacctcccccgcccagccgatcctcgtgatgagcgcggcccccaccgccatccagaacatccacccctccccgacgaaccgcagcaagcggaacctggagatggagatcatcctgaccctcagccaggggctgaagaagtactacggcaagatcctgaagctcctgcacctgaccctcgaggaggacaccgaggggctgctggagtggtgcaagcgctccctcggcagcaactgcgacgacgacttcttccagaagcggatcgaggagttcttcatgacgggcgaggggtacttcaacgaggtcctgcagttcaagaccctgtccaccctcagccccaccgagccctcccacgcccggccgcccacggtggagcccttcaagagctacttcgccaagggcttcctgtccatcgacagcgggtacttctccgcgaagtgctacccccggctgagcacctccggcctccagctgatcaacgtgacccagcaccccgcccgcatcgccgagacccccggccccaagacgaccagcctgaagaccatcaactgcatcaacctccgggcctccgtcttcaaggagcaccgcgagatcgagatcaacgtgctgctgccccagatcgccgtgaacctcagcaactgccacgtcgtgatcaactcccacgtgtgcgactacagcctggacaccgacgggcccgtccggctgccgcacatctaccacgagggcacgttcatccccgggacctacaagatcgtgatcgacaagaagaacaagctcaacgaccgctgcaccctggtgaccaactgcgtcatcaagggccgggaggtgcgcaaggggcagtccgtgctgcggcagtacaagacggagatcaagatcggcaaggcgagcaccggcagccgcaagctcctgtccgaggagcccggggacgactgcatcagccggacccagctgctccgcgccgagcccgccgagatccacgacgacaactacggcgggccgggcgacaagatcaccatctgcaacgggtccacgatcgtcgaccagcggctgggcagcgagctgggctgctacaccatcaaccgcgtgaagtccttcaagctctgcgagaacagcgccaccgggaagacctgcgagatcgactccacgcccgtgaagtgccgccagggcttctgcctgaagatcacccaggaggggcggggccacgtcaagctgagccgcgggtccgaggtggtcctggacgcctgcgacagctcctgcgaggtgatgatccccaagggcaccggcgacatcctcgtggactgcagcgggggccagcagcacttcctgaaggacaacctgatcgacctcgggtgcccccacatcccgctgctgggcaagatggcgatctacatctgccggatgtccaaccacccccgcaccacgatggccttcctcttctggttcagcttcggctacgtcatcacgtgcatcttctgcaaggccctgttctactccctgatcatcatcgggaccctcggcaagaagatcaagcagtaccgggagctgaagccccagacctgcaccatctgcgagacggcccccgtgaacgcgatcgacgccgagatgcacgacctgaactgcagctacaacatctgcccgtactgcgcctcccgcctcaccagcgacgggctggcccggcacgtgccccagtgccccaagcgcaaggagaaggtcgaggagaccgagctgtacctcaacctggagcggatcccgtggaacgtgcgcaagctgctccaggtgtccgagagcaccggcgtcgccctgaagcggagctcctggctgatcgtgctcctggtgctgctcacggtcagcctgtcccccgtgcagagcgcgcccgtggggcacggcaagaccatcgagacctaccagacccgcgagggcttcacgtccatctgcctgttcatgctcgggagcatcctgttcctggtctcctgcctcgtgaagggcctggtggacagcgtctccgacagcttcttccccgggctgtccgtgtgcaagacctgcagcatcggctccatcaacgggttcgagatcgagagccacaagtgctactgctccctcttctgctgcccgtactgccggcactgcagcgccgaccgcgagatccaccagctgcacctgtccatctgcaagaagcggaagatgggcagcaacgtgatgctcgccgtctgcaagcgcatgtgcttccgggccaccatcgaggcctcccgccgggcgctgctgatccgcagcatcatcaacaccacgttcgtgatctgcatcctcaccctgaccatctgcgtggtcagcacctccgccgtggagatggagaacctgcccagcggcacgtgggagcgcgaggaggacctcaccaacttctgccaccaggagtgccaggtgaccgagaccgagtgcctgtgcccctacgaggccctggtcctccggaagcccctgttcctggactccatcgtgaaggggatgaagaacctcctgaacagcacgaacctggagacctccctcagcatcgaggccccgtggggcgccatcaacgtgcagtccaccttcaagcccaccgtcagcacggcgaacatcgccctgtcctggagctccgtggagcaccgcgggaacaagatcctggtgaccggccggagcgagtccatcatgaagctcgaggagcgcaccggggtcagctgggacctgggcgtggaggacgcctccgagagcaagctgctcaccgtgtccatcatggacctgagccagatgtactcccccgtcttcgagtacctgagcggcgaccgccaggtggaggagtggcccaaggccacgtgcaccggggactgcccggagcgctgcggctgcaccagcagcacgtgcctccacaaggagtggccccacagccggaactggcgctgcaaccccacctggtgctgggaggtggggaccggctgcacgtgctgcgggtggaacgtcaaggacctgttcaccgaccacatgttcgtgaagtggaaggtggagtacatcaagacggaggcgatcgtctgcgtggagctgacctcccaggagcggcagtgcagcctcatcgaggccggcacccgcttcaacctgggccccgtgaccatcaccctgtccgagccgcggaacatccagcagaagctgccgcccgagatcatcacgctgcaccccaaggtcgaggaggggttcttcgacctgatgcacgtgcagaaggtgctcagcgcctccaccgtctgcaagctgcagagctgcacccacggcatcccgggggacctccaggtgtaccacatcggcaacctcctgaagggcgaccgcgtgaacgggcacctgatccacaagatcgagccccacttcaacacctcctggatgagctgggacggctgcgacctcgactactactgcaacatgggggactggccctcctgcacgtacaccggcatgacccagcacaaccacgccgccttcgtcaacctgctgaacatcgagaccgactacacgaagaccttccacttccacagcaagcgggtgaccgcgcacggggacacgccccagctcgacctgaaggcccgcccgacgtacggcgccggcgagatcaccgtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagcccgacgagctcacggtccacgtgaagtccaacgaccccgacgtgatcgccgcctccaccagcctgatggcccgcaagctggagttcggcaccgacagcaccttcaaggcgttctccgccatgcccaagacgagcctctgcttctacatcgccgagcgggagtactgcaagtcctgcagcgaggaggacacccagaagtgcgtcgacaccaagctggagcagccgcagtccatcctgatcgagcacaaggggaccatcatcggcaagcagaacgacacgtgcaccgccaaggcgagctgctggctcgagtccgtgaagtccttcttctacggcctgaagaacatgctggggtccgtgttcggcaacttcttcatcgggatcctcctgttcctggcccccttcgtcctgctcgtgctgttcttcatgttcggctggaagatcctgttctgcttcaagtgctgccgccggacccgcgggctcctgaagtaccggctgctcaaggacgacgaggagaccggctaccgccgcatcatcgagcggctgaacaacaagaagggcaagaaccgcctgctcgacggggagcggctggccgaccgcaagatcgccgagctgttcagcacgaagacccacatcggctga

SEQ ID NO: 12077 - RNA, 5055 nt, synthetic construct
  misc_feature 1..5055: note = derived and/or modified CDS sequence (opt1) from CCHFV__KJ648916.1__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccccggggacaacccgagctccgagccccccgtgagcacggccctgtccatcaccctggaccccagcaccgtcaccccgacgacccccgcgtccggcctcgaggggagcggcgaggtgtacacctccccccccatcaccacgggcagcctgccgctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccgtccggcaccggcaaggagagctccgccaccagctccccccaccccgtgagcaaccggcccccgacgccccccgcgaccgcccaggggcccaccgagaacgactcccacaacgccaccgagcacccggagagcctgacgcagtccgccacccccggcctcatgaccagccccacccagatcgtgcacccgcagtccgcgacccccatcacggtccaggacacccaccccagccccaccaacgcctccaaggccaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgcgaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggccagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcgtccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcggctgggctccgagctggggtgctacaccatcaaccgcgtccgcagcttcaagctgtgcgagaactccgccaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggcgttcctcttctggttctccttcgggtacgtgatcacctgcatcctgtgcaaggccatcttctacctgctcatcatcgtgggcaccctggggaagcgcctgaagcagtaccgggagctcaagccgcagacctgcaccatctgcgagacgacccccgtcaacgccatcgacgccgagatgcacgacctgaactgcagctacaacatctgcccctactgcgcctcccgcctgaccagcgacggcctcgcgcggcacgtgatccagtgccccaagcgcaaggagaaggtggaggagaccgagctgtacctgaacctcgagcggatcccgtgggtcgtgcgcaagctgctgcaggtgtccgagagcacgggcgtcgccctcaagcggtccagctggctgatcgtgctgctcgtgctgttcaccgtctccctgagccccgtgcagtccgcccccatcgggcagggcaagaccatcgaggcctaccgcgcgcgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgccaccatggaggtgtccaaccgggccctgttcatccgcagcatcatcaacaccacgttcgtcctctgcatcctgatcctggccgtgtgcgtggtctccaccagcgcggtggagatggagaacctccccgccgggacctgggagcgcgaggaggacctgaccaacttctgccaccaggagtgccaggtgacggagaccgagtgcctgtgcccctacgaggccctcgtcctgcggaagccgctgttcctcgactccaccgccaagggcatgaagaacctgctgaacagcacctccctcgagacgagcctgtccatcgaggccccctggggggcgatcaacgtgcagagcacctacaagcccaccgtgtccaccgccaacatcgccctgagctggagctccgtcgagcaccgcggcaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacctgcaccggcgactgccccgagcgctgcgggtgcacgagctccacctgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggcgatcgtgtgcgtcgagctgacctcccaggagcggcagtgcagcctgatcgaggccggcacgcgcttcaacctcggcccggtgaccatcaccctgtccgagccccggaacatccagcagaagctgccccccgagatcatcaccctccacccgcgcatcgaggaggggttcttcgacctgatgcacgtgcagaaggtcctgagcgcctccaccgtgtgcaagctccagagctgcacgcacggcgtccccggggacctgcaggtgtaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcgcacggggacacgccgcagctggacctcaaggcccgccccacctacggcgccggggagatcaccgtcctggtggaggtggccgacatggagctgcacaccaagaagatcgagatctccggcctcaagttcgccagcctggcgtgcacgggctgctacgcctgctccagcgggatctcctgcaaggtccggatccacgtggacgagcccgacgagctgaccgtgcacgtcaagagcgacgaccccgacgtggtggccgcctccagctccctcatggcccgcaagctggagttcggcaccgacagcaccttcaaggcgttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgccaaggccagctgctggctggagtccgtgaagagcttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgggggctgttcaagtaccgccacctgaaggacgacgaggagaccggctaccgccggatcatcgagaagctcaacaacaagaagggcaagaacaagctgctggacggggagcgcctcgcggaccggcgcatcgccgagctgttcagcacgaagacccacatcggctga

SEQ ID NO: 12078 - RNA, 3495 nt, synthetic construct
  misc_feature 1..3495: note = derived and/or modified CDS sequence (opt1) from CCHVF(CCHVF 10200)__U39455.2__Gn-NSm-Gc
  source 1..3495: mol_type = other RNA
agcgaggagccctccgacgactgcgtgagccgcacccagctgctccggaccgagacggccgagatccacggcgacaactacgggggcccgggggacaagatcaccatctgcaacggctccaccatcgtcgaccagcgcctggggagcgagctgggctgctacaccatcaaccgggtgcgctccttcaagctctgcgagaacagcgccacgggcaagaactgcgagatcgactccgtgcccgtcaagtgccggcaggggtactgcctgcgcatcacccaggagggccgggggcacgtgaagctgagccgcggctccgaggtggtcctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtcggcaccctggggcgccggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggccaggggaagacgatcgaggcctaccgggcccgcgagggctacacctccatctgcctgttcgtcctgggcagcatcctcttcatcgtgtcctgcctgatgaaggggctggtggacagcgtcggcaactccttcttccccgggctcagcatctgcaagacctgctccatcagctccatcaacggcttcgagatcgagagccacaagtgctactgctccctgttctgctgcccctactgccggcactgcagcaccgacaaggagatccacaagctgcacctctccatctgcaagaagcgcaagacggggagcaacgtgatgctggccgtctgcaagctgatgtgcttccgcgccaccatggaggtgtccaaccgggcgctgttcatccgcagcatcatcaacaccaccttcgtgctgtgcatcctgatcctcgccgtctgcgtggtgtccacgagcgccgtcgagatggagaacctgcccgccggcacctgggagcgggaggaggacctgaccaacttctgccaccaggagtgccaggtgaccgagacggagtgcctgtgcccgtacgaggccctcgtgctgcgcaagcccctgttcctcgacagcaccgcgaagggcatgaagaacctgctgaactccaccagcctcgagacctccctgagcatcgaggccccctggggcgccatcaacgtccagtccacgtacaagcccaccgtgagcaccgccaacatcgccctgtcctggagctccgtggagcaccgggggaacaagatcctcgtcagcgggcgctccgagagcatcatgaagctggaggagcggaccggcatctcctgggacctgggggtggaggacgcgagcgagtccaagctcctgaccgtgagcgtcatggacctgtcccagatgtacagcccggtgttcgagtacctcagcggcgaccgccaggtggaggagtggcccaaggccacgtgcaccggcgactgccccgagcggtgcgggtgcacctccagcacgtgcctgcacaaggagtggccccactcccgcaactggcggtgcaacccgacctggtgctggggcgtcgggaccggctgcacgtgctgcggcctggacgtgaaggacctcttcaccgactacatgttcgtgaagtggaaggtcgagtacatcaagaccgaggccatcgtgtgcgtggagctgaccagccaggagcgccagtgctccctgatcgaggccgggacccggttcaacctcggccccgtcaccatcacgctgagcgagccccgcaacatccagcagaagctgcccccggagatcatcaccctccacccccggatcgaggaggggttcttcgacctgatgcacgtgcagaaggtgctgtccgccagcaccgtctgcaagctccagtcctgcacccacggcgtgcccggggacctccaggtgtaccacatcggcaacctgctcaagggcgacaaggtcaacgggcacctgatccacaagatcgagccgcacttcaacacgagctggatgtcctgggacggctgcgacctggactactactgcaacatgggggactggcccagctgcacctacaccggcgtgacccagcacaaccacgcgtccttcgtgaacctcctgaacatcgagacggactacaccaagaacttccacttccacagcaagcgcgtcaccgcccacggggacacgccccagctggacctcaaggcccggcccacctacggcgccggcgagatcaccgtgctggtggaggtcgcggacatggagctgcacaccaagaagatcgagatctccgggctcaagttcgccagcctggcctgcaccggctgctacgcctgctccagctccatcagctgcaaggtgcgcatccacgtggacgagccggacgagctgacggtccacgtcaagagcgacgaccccgacgtggtggccgcgtccagctccctcatggcccggaagctggagttcgggaccgacagcaccttcaaggccttctccgccatgcccaagaccagcctgtgcttctacatcgtggagcgcgagcactgcaagtcctgcagcgaggaggacacgaagaagtgcgtgaacaccaagctcgagcagccccagtccatcctgatcgagcacaagggcaccatcatcgggaagcagaacagcacgtgcaccgccaaggcgtcctgctggctggagagcgtcaagtccttcttctacggcctcaagaacatgctgagcggcatcttcgggaacgtgttcatgggcatcttcctgttcctcgccccgttcatcctgctgatcctcttcttcatgttcgggtggcgcatcctgttctgcttcaagtgctgccggcgcacccggggcctgttcaagtaccgccacctcaaggacgacgaggagaccgggtaccggcgcatcatcgagaagctgaacaacaagaagggcaagaacaagctgctcgacggcgagcggctggccgacgggcgcatcgccgagctgttctccaccaagacccacatcggc

SEQ ID NO: 12079 - RNA, 3495 nt, synthetic construct
  misc_feature 1..3495: note = derived and/or modified CDS sequence (opt1) from CCHVF(CCHVF IbAr10200)__AF467768.2__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtccgctccttcaagctctgcgagaacagcgccacgggcaagaactgcgagatcgactccgtgcccgtgaagtgccggcaggggtactgcctgcgcatcacccaggagggccgggggcacgtcaagctgagccgcggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtgggcaccctggggaagcgcctcaagcagtaccgggagctgaagccccagacctgcaccatctgcgagaccacccccgtcaacgccatcgacgcggagatgcacgacctgaactgcagctacaacatctgcccgtactgcgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgagagcaccggggtcgccctgaagcggtccagctggctgatcgtgctcctggtgctgttcaccgtcagcctctcccccgtgcagagcgcgccgatcggccaggggaagacgatcgaggcctaccgcgcccgggagggctacacctccatctgcctgttcgtgctgggcagcatcctcttcatcgtctcctgcctgatgaaggggctggtggacagcgtgggcaactccttcttccccgggctcagcatctgcaagacctgctccatcagctccatcaacggcttcgagatcgagagccacaagtgctactgctccctgttctgctgcccctactgccgccactgcagcaccgacaaggagatccacaagctgcacctctccatctgcaagaagcggaagaaggggagcaacgtcatgctggccgtgtgcaagctgatgtgcttccgcgccacgatggaggtctccaaccgcgccctcttcatccggagcatcatcaacaccaccttcgtgctgtgcatcctgatcctcgccgtgtgcgtcgtgtccaccagcgccgtggagatggagaacctgcccgccggcacgtgggagcgcgaggaggacctgaccaacttctgccaccaggagtgccaggtcaccgagaccgagtgcctgtgcccgtacgaggccctcgtgctgcggaagcccctgttcctcgacagcacggcgaagggcatgaagaacctgctgaactccaccagcctcgagacctccctgagcatcgaggccccctggggcgccatcaacgtgcagtccacctacaagcccacggtcagcaccgccaacatcgccctgtcctggagctccgtggagcaccgcgggaacaagatcctcgtgagcgggcggtccgagagcatcatgaagctggaggagcgcaccggcatctcctgggacctgggggtcgaggacgcgagcgagtccaagctcctgaccgtgagcgtgatggacctgtcccagatgtacagcccggtcttcgagtacctcagcggcgaccgccaggtgggcgagtggcccaaggcgacctgcacgggggactgccccgagcggtgcggctgcacctccagcacgtgcctgcacaaggagtggccccactcccggaactggcgctgcaacccgacctggtgctggggcgtggggaccggctgcacgtgctgcgggctggacgtcaaggacctcttcaccgactacatgttcgtgaagtggaaggtggagtacatcaagaccgaggccatcgtctgcgtggagctgaccagccaggagcggcagtgctccctgatcgaggccggcacccgcttcaacctcgggcccgtgaccatcaccctgagcgagccccggaacatccagcagaagctgcccccggagatcatcacgctccacccccgcatcgaggagggcttcttcgacctgatgcacgtccagaaggtgctgtccgccagcaccgtgtgcaagctccagtcctgcacccacggggtccccggcgacctccaggtgtaccacatcggcaacctgctgaagggggacaaggtgaacggccacctgatccacaagatcgagccgcacttcaacaccagctggatgtcctgggacgggtgcgacctggactactactgcaacatgggcgactggcccagctgcacgtacaccggggtcacccagcacaaccacgcgtccttcgtgaacctcctgaacatcgagaccgactacacgaagaacttccacttccacagcaagcgggtgaccgcccacggcgacacgccccagctggacctcaaggcccgccccacctacggcgccggggagatcaccgtcctggtggaggtggcggacatggagctgcacaccaagaagatcgagatctccggcctcaagttcgccagcctggcctgcaccgggtgctacgcctgctccagcggcatctcctgcaaggtccggatccacgtggacgagccggacgagctgaccgtgcacgtcaagagcgacgaccccgacgtggtggccgcgagctccagcctcatggcccgcaagctggagttcgggacggactccaccttcaaggccttcagcgccatgcccaagacctccctgtgcttctacatcgtcgagcgggagcactgcaagagctgctccgaggaggacaccaagaagtgcgtgaacacgaagctcgagcagccccagagcatcctgatcgagcacaagggcaccatcatcggcaagcagaactccacgtgcaccgccaaggcgagctgctggctggagtccgtcaagagcttcttctacgggctcaagaacatgctgtccggcatcttcgggaacgtgttcatgggcatcttcctgttcctcgccccgttcatcctgctgatcctcttcttcatgttcgggtggcgcatcctgttctgcttcaagtgctgccgccggacccgcggcctgttcaagtaccggcacctcaaggacgacgaggagaccggctaccgccggatcatcgagaagctgaacaacaagaaggggaagaacaagctgctcgacggcgagcgcctggccgaccggcgcatcgccgagctgttcagcaccaagacccacatcggg

SEQ ID NO: 12080 - RNA, 3495 nt, synthetic construct
  misc_feature 1..3495: note = derived and/or modified CDS sequence (opt1) from CCHVF(CCHVF Turkey-Kelkit06)__GQ337054.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcaagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggcggatggccatctacatctgccgcatgagcaaccacccccggaccaccatggccttcctgttctggttctccttcggctacgtgatcacctgcatcttctgcaaggccctgttctacagcctcatcatcatcggcacgctggggaagaagatcaagcagtaccgcgagctgaagccccagacctgcaccatctgcgagaccgcccccgtcaacgcgatcgacgccgagatgcacgacctcaactgctcctacaacatctgcccgtactgcgccagccggctgacgtccgacggcctggcccgccacgtgacccagtgccccaagcggaaggagaaggtggaggagaccgagctctacctgaacctggagcgcatcccctggatcgtccggaagctcctgcaggtgagcgagtccaccggggtggcgctgaagcgcagcagctggctcatcgtcctgctggtgctcctgacggtgtccctgagccccgtccagtccgccccggtgggccacgggaagaccatcgagatctaccagacccgggagggcttcgccagcatctgcctcttcatgctgggctccatcctgttcatcgtgagctgcctcgtcaaggggctggtggactccgtgagcgagtccttcttccccggcctgagcgtctgcaagacctgctccatcgggagcgtgaacggcttcgagatcgagtcccacaagtgctactgcagcctcttctgctgcccctactgccgccactgctccgccgaccgggagatccaccagctgcacctgagcatctgcaagaagcgcaagacggggtccaacgtcatgctcgccgtgtgcaagcggatgtgcttccgcgcgaccatcgaggccagccgccgggccctgctgatccgctccatcatcaacaccaccttcgtgatctgcatcctcacgctgaccatctgcgtcgtgagcaccagcgccgtggagatggagaacctgcccgccggcacctgggagcgggaggaggacctcacgaacttctgccaccaggagtgccaggtcaccgagaccgagtgcctgtgcccgtacgaggcgctggtgctgcgcaagcccctcttcctggactccatcgtgaagggcatgaagaacctgctcaacagcacctccctggagacgagcctgtccatcgaggccccctggggggccatcaacgtccagagcaccttcaagcccaccgtgtccaccgccaacatcgccctcagctggtccagcgtggtccaccggggcaacaagatcctggtgaccgggcgctccgagagcatcatgaagctggaggagcggacgggcgtgtcctgggacctcggggtcgaggacgcgagcgagtccaagctgctgaccgtgagcatcatggacctctcccagatgtacagcccggtgttcgagtacctgagcggcgaccgccaggtcgaggagtggcccaaggccacctgcaccggcgactgccccgagcggtgcgggtgcacgtccagcacctgcctgcacaaggagtggtcccacagccgcaactggcggtgcaaccccacctggtgctggggcgtggggaccggctgcacgtgctgcggcgtggacgtcaaggacctcttcaccgaccacatgttcgtgaagtggaaggtggagtacatcaagaccgaggccatcgtctgcgtggccctgacctcccaggagcgccagtgcagcctgatcgaggccgggacgcggttcaacctcggcccggtgaccatcaccctgtccgagccccgcaacatccagcagaagctgccccccgagatcatcaccctccacccgaagatcgaggaggggttcttcgacctgatgcacgtccagaaggtgctgagcgcgtccacggtgtgcaagctccagagctgcacccacggcatccccggggacctgcaggtctaccacatcggcaacctgctcaagggcgaccgggtgaacgggcacctgatccacaagatcgagtcccacttcaacaccagctggatgtcctgggacggctgcgacctggactactactgcaacatgggggactggcccagctgcacctacacgggcgtgacccagcacaaccacgccgccttcgtcaacctcctgaacatcgagaccgactacaccaagacgttccacttccactccaagcgcgtgaccgcccacggggacaccccgcagctggacctcaaggcgcggcccacctacggcgccggcgggatcacggtgctggtcgaggtggccgacatggagctgcacaccaagaaggtggagatcagcggcctcaagttcgcctccctggcctgcaccgggtgctacgcgtgcagctccggcatcagctgcaaggtccgcatccacgtggacgagcccgacgagctgaccgtgcacgtcaagagctccgaccccgacgtggtggccgccagcacgtccctcatggcccggaagctggagttcgggaccgacagcaccttcaaggccttctccgcgatgccgaagaccagcctgtgcttctacatcgtcgagcgcgagtactgcaagtcctgcagcgaggacgacacgcagaagtgcgtggacacccgcctcgagcagccccagtccatcctgatcgagcacaagggcaccatcatcggcaagcagaacgacacctgcaccgccaaggccagctgctggctggagtccgtgaagagcttcttctacgggctcaagaacatgctgggctccgtcttcgggaacctgttcatcggcatcctcctgttcctggcccccttcgtgctcctggtgctgttcttcatgttcgggtggaagatcctcttctgcttcaagtgctgccggcgcacgcggggcctgttcaagtaccgccacctgaaggacgacgaggagaccggctaccggcgcatcatcgagcggctcaacagcaagaaggggaagaaccgcctgctggacggcgaccggctcgccgaccgcaagatcgcggagctgttctccaccaagacccacatcggg

SEQ ID NO: 12081 - RNA, 3498 nt, synthetic construct
  misc_feature 1..3498: note = derived and/or modified CDS sequence (opt1) from CCHVF(CCHVF SR3)__AJ538199.1__Gn-NSm-Gc
  source 1..3498: mol_type = other RNA
agcgaggagtccggcgacgactgcatcagccgcacccagctcctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctcaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctgagcgtgtgcaagacgtgctccatcgggagcatcaacggcttcgagatcgagtcccacaagtgctactgcagcctcttctgctgcccctactgccggcactgctccgccgacggcgagatccaccagctgcacctgagcatctgcaagaagcgcaagaccgggtccaacgtcatgctcgcggtgtgcaagcggatgtgcttccgcgccaccatggaggtgagcaacaaggccctgttcatccgctccatcatcaacaccacgttcgtcatgtgcatcctgaagggcgagttcgccgccgtcaagagcatccaccccatcgagatggagtccctccccgcggggacctgggagcgggaggaggacctgaccaacttctgccaccaggagtgccaggtgaccgagacggagtgcctgtgcccgtacgaggccctcgtgctgcgccggcccctgttcctggacagcatcgtgaagggcatgaagaacctcctgaacagcacctccctggagaccagcctctccatcgaggccccctggggcgccatcaacgtgcagagcacctacaagcccacggtctccaccgccaacatcgcgctgagctggtccagcgtggagcaccgcgggaacaaggtgctggtctccggccggagcgagtccatcatgaagctcgaggagcgcaccgggatcagctgggacctgggcgtggaggacgcctccgagagcaagctgctcaccgtgtccgtcatggacctgagccagatgtactccccggtgttcgagtacctgagcggggaccgccaggtggaggagtggcccaaggcgacctgcacgggcgactgccccgagcggtgcggctgcaccagctccacgtgcctccacaaggagtggccccacagccggaactggcgctgcaacccgacctggtgctggggcgtcgggaccgggtgcacgtgctgcggcctggacgtgaaggacctgttcaccgactacatgttcgtgaagtggaaggtcgagtacatcaagaccgaggccatcgtgtgcgtggagctcacctcccaggagcggcagtgcagcctgatcgaggccgggacccgcttcaacctgggctccgtcaccatcaccctcagcgagccccggaacatccagcagaagctgccgcccgagatcatcacgctgcaccccaagatcgaggagggcttcttcgacctcatgcacgtgcagaaggtgctgtccgccagcaccgtctgcaagctgcagtcctgcacccacggggtgcccggcgacctccaggtgtaccacatcgggaacctgctgaagggcgaccgcgtcaacgggcacctcatccacaagatcgagcagcacttcaacaccagctggatgtcctgggacggctgcgacctggactactactgcaacatgggcgactggcccagctgcacgtacaccggggtgacccagcacaaccacgcctccttcgtgaacctgctcaacatcgagaccgactacacgaagaccttccacttccacagcaagcgggtcaccgcccacggcgacaccccgcagctggacctgaaggcccgccccacgtacggggccggcgagatcaccgtgctcgtggaggtcgcggacatggagctgcacaccaagaagatcgagatctccgggctgaagttcgccggcctgacctgcacgggctgctacgcctgcagctccgggatcagctgcaaggtgcggatccacgtggacgagcccgacgagctgaccgtccacgtgaagtccgacgaccccgacgtggtcgccgcgagcagctccctgatggcccgcaagctcgagttcggcaccgacagcaccttcaaggccttctccgccatgccgaagacgagcctgtgcttctacatcgtggagcgggagtactgcaagtcctgcaacaaggaggacacccagaagtgcgtgaacaccaagctggagcagccccagagcatcctcatcgagcacaaggggaccatcatcggcaagcagaacaacacgtgcaccgccaaggcgtcctgctggctggagagcgtcaagtccttcttctacgggctgaagaacatgctcggcggcatcttcgggaacgtgttcatcggcatcttcaccttcctgacccccttcatcctgctcatcctgttcttcatgttcgggtggcgcatcctgttctgcttcaagtgctgccgccggacccgcggcctcttcaagtaccggcacctgaaggacgacgaggagacgggctaccgcaagatcatcgagcggctgaacaacaagaaggggaagaaccgcctcctggacggcgagcggctggccgaccgcaagatcgccgagctgttcagcaccaagacccacatcggg

SEQ ID NO: 12082 - RNA, 3498 nt, synthetic construct
  misc_feature 1..3498: note = derived and/or modified CDS sequence (opt1) from CCHVF(CCHVF UCCR4413)__KY484038.1__Gn-NSm-Gc
  source 1..3498: mol_type = other RNA
agcgagtccagcgcctccggctgcatcagccgcacccagatgatcaagtccgagaccgccgagatccacgacgacatctacgggggccccggggagaagctgacgatctgcaacggcaccaccgtggtcgaccagcggctcgggagcgagctgggctgctacaccatcaaccgcatcaagacgtacaagctgtgcgagaactccgtgaaggagaagacctgcgagatcgacagcgtgccggtcaagtgccggcagggcctctgcctgaagatcacccaggaggggcgcggccacgtgaagctgtcccgggggagcgagatcgtgctcgacatctgcgactccagctgcgagctgatgatccccaagggcaccggggacatcctggtcgactgctccggcggccagcagcacttcctccaggacaacctggtggacctggggtgccccaacatccccctcctgggcaaggtggcgatctacatctgccgcatgagcaaccacccgaagacgaccatggccttcctgttctggttctccttcgggtacgtcatcacctgcatcctctgcaagatcctgttctacctgctcatcatcaccggcacgctgggcaagaagctgaagcagtaccgggagctcaagccccagacctgcaccatctgcgagagcacccccgtgaacgccatcgacgccgagatgcacgacctgaactgctcctacaacatctgcccctactgcgccagccgcctgacgtccgacgggctcatccggcacgtgaacctgtgcccgaagcgcaaggagaaggtcgaggagaccgagctgtacctcaacctggagcggatcccctggttcgtgcgcaagctgctccaggtgagcgagagcaccggcgtcgcgctgaagcggtccagctggctgctcatcctggtgatcctgctcaccgtgtccatgagccccgtccagtccgcccccatcaaccagcagcgcgccgtggaggcctaccaggcgcgggaggggtacacgggcatctgcctgttcatcctggggagcgtgctcttcatgacctcctggctgaccaagggcctgatcgacagcatcggcgactccttcttcccggggctcttcgtctgcaagacctgcagcatcggctccatcaacgggttcgagatcgagagccaccgctgctactgctccctgctgtgctgcccctactgccggacgtgcagcgccgacaaggactcccaccagctccacctgagcatctgcaagaagaagaaggccggctccaacgtgatgctggccgtgtgcaagcgcatgtgcttcaaggccaccatcgaggcgagcaaccgggtcctcctgatccgctccatcatcaacaccaccttcatcatctgcatgctgatcctggtggtctgcgtgatcagcacgagcgccgtggagatggaggacctccccgccgggacctgggagcgggaggaggacctgaccaacttctgccaccaggagtgccaggtcaccgagacggagtgcctgtgcccctacgaggccttcgtgctccgcaagccgctgttcctgtccagcatcgtgaagggcaagaagaacctcctgaactccgccagcctggagacctccctcagcatcgaggcgccctggggcgccatcaacgcccagtccaccttcaagcccaccatcagcacggccaacatcgccctgtcctggagctccgtcgagcaccgcgggaacaaggtgctggtgagcggccggtccgagagcatcatgaagctcgaggagcgcaccgggatctcctggaacctgggcgtcgaggacgcgagcgagtcccggatgctgaccgtgagcgtgatggacctcagccagatgtacctgcccgtcttcgagtacctgtccggggaccgccaggtggaggagtggccgaaggccacctgcaccggcgactgccccgagcggtgcggctgcacgagctccacctgcctccacaaggagtggccccacagccgcaactggcggtgcaaccccacctggtgctggggggtgggcaccgggtgcacgtgctgcggcctggacgtcaaggacctgttcaccgactacatgttcgtgaagtggaaggtggagtacatcaagaccgaggccatcgtctgcgtggagctcacctcccaggagcgccagtgcagcctgatcgaggccggcacgcggttcaacctggggccggtgaccatcaccctctccgagccccgcaacatccagcagaagctgcccagcgagatcgtcaccctgcaccccaagatcgaggagggcttcttcgacctcatgcacgtgcagaaggtgctgtccgccagcacggtctgcaagctgcagtcctgcacccacggggtggcgggcgacctccaggtgtaccacgtcgggaacctgctgaagggcgacaagatcaacggccacagcatccacaagatcgagccgcacctcaacacctcctggatgagctgggacgggtgcgacctggactactactgcaacatgggcgactggccctcctgcacctacacgggggtgacccagcacaaccacgccgccttcgtgaacctgctcaacatcgagaccgactacaccaagagcttccacttccactccaagcgggtcacggcccacggcgacaccccccagctggacctgaaggcgcgcccgatgtacggggccggcgagatcaccgtgctcgtggaggtcgccgacatggagctgcacagcaagaacatcgagatctccggcctgaagttcgccagcctcacctgcagcgggtgctacgcctgctccagcggcatctcctgcaaggtgcggatccacgtggacgagcccgacgagctggcggtccacgtgaagagcgacgacctggacgtggtcgccgcctccagctccctcatggcccgcaagatcgagttcgggacggacagcaccttcaaggccttctccagcatgcccaaggagtccctgtgcttctacatcgtggagcgggacttctgcaagagctgcgcggccgaggacacccagaagtgcgtgaaggccaagctggagcagccccagtccatcctcatcgagcacaagggcaccatcatcgggaagcagaacgacacgtgcagcaccaagacctcctgctggctggagagcttcaagtccttcttctacggcctgaagaacatgctcagcggcgtcttcgggtccgccatcatgggcatcctgctgttcctcgccccgttcatcctgctgatcctcttcttcttcttcgggtggcgcatcctgttctgcctgcggtgctgccgccggacccgcggcctcttcaagtacaagcacatcaaggacgacgaggaggcggggtacaagaagatcatcgagaagctgaacaacaagaagggcggcacgagcaagctgctcgacggggagcgcctggccgaccggaagatcgccgagctgttcagcaccaaggcccacatcggc

SEQ ID NO: 12083 - RNA, 3495 nt, synthetic construct
  misc_feature 1..3495: note = derived and/or modified CDS sequence (opt1) from CCHVF(CCHVF 66019)__AB069669.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtggaccagcgcctgggcagcgagctgggctgctacaccatcaaccgggtgaagtccttcaagctctgcgagaacagcgggacgggcaagtcctgcaagatcgacaacaccccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagacgaccatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccacgaacgccatcgacgccgagatgcacgacctcaagtgctcctacaacatctgcccctactgcgccagccggctgacctccgacggcctggcgcgccacgtgacccagtgcccgaagcggaaggagaaggtcgaggagaccgagctctacctgaacctggagcgcatcccctggatcgtgcggaagctcctccaggtgagcgagtccacgggggtcgccctgaagcgcagcagctggctcatcgtgctgctggtgctcctgaccgtctccctgagccccgtgcagtccgcccccatcggccacggcaagaccatcgaggcctaccagacccgggaggggtacacgagcgtgtgcctcttcatgctgggcgggatcctgttcgtcgtgtcctgcctcatgaagggcctggtggacagcgtctccaacagcttcttcccggggctgtccatctgcaagacctgcagcatcggctccgtgaacggcttcgagatcgagagccacaagtgctactgctccctcctgtgctgcctgtactgccgccactgcagcgcggaccgggagatccaccagctccacctgtccatctgcaagaagcgccgggccgggggcaacgtcatgctggccgtgtgcaagcgcatgtgcctccgggccaccatggaggtgagcaacaaggtcctgttcatccgctccatcatcaacaccacgttcgtgatctgcatcctggtgctcgccgtctgcatcgtgagcacctccgcggtggagatggagagcctgcccgccgggacctgggagcgcgaggaggacctgaccaacttctgccaccaggagtgccaggtcacggagaccgagtgcctgtgcccctacgaggccctcgtgctgcggaagcccctgttcagcgactccatcgtgaagggcatgaagaacctcctgaacagcacctccctggagaccagcctctccatcgaggccccgtggggcgccatcaacgtccagagcacgttcaagcccaccgtgtccaccgcgaacatcgccctgagctggtccagcgtggagcaccgcgggaacaagatcctggtctccggccggagcgagtccatcatgaagctcgaggagcgcaccgggatcagctgggacctgggcgtggaggacgcctccgagagcaagctgctcaccgtgtccgtcatggacctgagccagatgtacagccccgtgttcgagtacctgtccggggaccgccaggtggaggagtggcccaaggccacgtgcaccggcaactgcccggaccggtgcggctgcaccagctccacgtgcctccacaaggagtggccccacagccggaactggcgctgcaaccccacctggtgctggggcgtcgggaccgggtgcacgtgctgcggcctggacgtgaaggacctgttcaccgactacatgttcgtgaagtggaaggtcgagtacatcaagaccgaggccatcgtgtgcgtggagctcaactcccaggagcggcagtgcagcctgatcgaggcggggacccgcttcaacctgggccccgtcaccatcaccctctccgagccgcggaacatccagcagaagctgcccagcgagatcatcacgctgcacccccgcatcgaggagggcttcttcgacctcatgcacgtgcagaaggtgctgtccgccagcaccgtctgcaagctgcagtcctgcacccacggggtgcccggcgacctccagatctaccacatcgggaacctgctgaagggcgaccgggtgaacgggcacctcatccacaagatcgagccgcacttcaacaccagctggatgtcctgggacggctgcgacctggactactactgcaacatgggcgactggcccagctgcacgtacaccggggtcacccagcacaaccacgccgccttcgtgaacctgctcaacatcgagaccgactacacgaagaacttccacttccactccaagcgcgtgaccgcccacggcgacacgccccagctggacctgaaggcgcggccgacctacggggccggcgagatcaccgtcctcgtggaggtggccgacatggagctgcacaccaagaagatcgccatcagcgggctgaagttcgcgtccctgacctgcaccggctgctacgcctgcagctccggcatcagctgcaaggtccgcatccacgtggacgagcccgacgagctgacggtgcacgtcaagagcgaggaccccgacatcgtggccgcctccagctccctgatggcccggaagctcgagttcgggaccgacagcaccttcaaggcgttctccgccatgcccaagaccagcctgtgcttctacatcgtggagcgcgagtactgcgagtcctgcagcaaggaggacacgcagaagtgcgtcaacaccaagctggagcagccgcagtccatcctcatcgagcacaagggcaccatcatcgggaagcagaacgacacgtgcaccgccaaggccagctgctggctggagtccgtcaagagcttcttctacggcctgaagaacatgctctccgggatcttcggcaacgtgttcatcggcatcttcctgttcctggcccccttcatcctcctgatcctgttcttcatgttcgggtggcggatcctcttctgcttcaagtgctgccgccgcacccggggcctgttcaagtaccgctacctgaaggacgacgaggagagcgggtaccggcgcatcatcgagcggctcaacaacaagaagggcaagaacaagctgctggacggcgagcgcctcgcggaccggcgcatcgccgagctgttctccaccaagacccacatcggg

SEQ ID NO: 12084 - RNA, 3495 nt, synthetic construct
  misc_feature 1..3495: note = derived and/or modified CDS sequence (opt1) from CCHVF(CCHVF 7001)__AB069670.1__Gn-NSm-Gc
  source 1..3495: mol_type = other RNA
gccgagggcgggagctccgactgcatcagccgcacccagctcgtgaagaccgaggtcgccgagatccacgaggactcctacggcgggcccggcgagaagatcacgatctgcaacgggagcaccatcgtggaccagcggctcggctccgagctgggctgctacaccatcaaccgcgtgcggagctacaagctgtgcgagaactccgcgagcgggaagtcctgcgagatcgacagcatcccggtcaagtgcaagcagggcttctgcctcaagatcacccaggaggggcgcggccacgtgaagctgtcccgggggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccgcatgtccaaccacccgaagaccaccatggccttcctgttctggttcagcttcggctacgtgatcacgtgcatcgcctgccgggtgctgttctacctcctgatcgccatcgggaccgtcggcaagaagctgaagcagtaccgcgagctcaagccccagacctgcatcgtgtgcgagtccgtgcccgtcaacgcgatcgacgccgagatgcacgagctgaactgcagctacaacatctgcccctactgcgcctcccggctgagcaccgacgggctcatccgccacgtgacgcagtgcccgaagcggcgcgagaaggtggaggagaccgagctgttcctgaacctcgagcggatcccctggctggtccgcaagctgctccaggtgagcgagtccaccggcatggccctgaagcggagctgctggatgatcaccctgctcatcctgctgctcgtgtccatcagccccgtccagtccgcgcccgtggggaaggagcgcgccatcgagacgtaccaggcccgggagacctacaccggcatctgcctgttcgtgctgggcagcgtcctcttcgccgtgtcctggctgaccaaggccctgatcgacgggatcggcaacagcttcttcccggggctctccgtctgcaagacgtgcagcatcggctccatcaacgggttcgagatcgagagccacaagtgctactgctccctgttctgctgcccctactgccgcgcgtgcagctccgacaagaacacccaccggatgcacctgaacgtgtgcaagaagcgcaagatgggcagcaacgtgatgctcgccgtctgcaagcggatgtgcttccgcgccaccatcgaggcctccaacaaggccctgctgatccgcagcatcatcaactccaccttcgtgatctgcatcctcatcctgacgatctgcgtggtcagcaccagcgcggtggacatggagaacctgcccgccggcatctgggagaaggaggaggacctcaccaacttctgccaccaggagtgccaggtgaccgagacggagtgcctgtgcccctacgaggccatggtcctgcggaagccgctgttcctcgacaacatcgccaaggggatgaagtccctgctgaacagcacctccctcgagaccagcctgtccatcgaggccccctggggcgcgatcaacgtgcagagcaccttcaagcccacggtgtccgccgccaacatcgccctgagctggtccagcgtcgagcaccgcgggaacaagatcctcgtgtccggccggagcgagtccatcatgaagctggaggagcgcaccggggtgagctggaacctgggcgtcgaggacgcctccgagagcaagaccctcaccgtgtccgtgatggacctgagccagatgtacagccccgtcttcgagtacctgtccggcgaccgccaggtggaggagtggccgaaggcgacgtgcaccggggactgccccgagcggtgcggctgcaccagctccacgtgcctccacaaggagtggccccacagccggaactggcgctgcaaccccacctggtgctggggcgtggggaccggctgcacgtgctgcgggctggacgtcaaggacttcttcaccgactacatgctggtgaagtggaaggtggagtacatcaagaccgaggccatcgtctgcgtggagctcacctcccaggagcggcagtgcagcctgatcgaggccggcacccgcttcaacctggggccggtgaccatcaccctctccgagccccggaacgtccagcagcgcctgccgcccgagatcgtgacgctgcaccccaagatcgaggagggcttcttcgacctcatgcacgtgcagaagatcctgagcgcctccaccgtctgcaagctgcagagctgcacccacggggtgcccggcgacttccaggtgtaccacgtcggcaacctcctgcgcggggacaaggtgaacggccactccatccacaagatcgagccccacttcaacaccagctggatgtcctgggacgggtgcgacctggactacttctgcaacatgggcgactggccgagctgcacgtacaccggggtgacccagcacaaccgggcggccttcatcaacatgctcaacatcgagaccgactacacgaagaccttccacttccactccaagcgggtcaccgcccacggcgacacgccccagctggacctgaaggcccgccccgcctacggcgcgggggaggtgaccgtgctcgtcgaggtggccgacctggagctgcacaccaagaagctcgaggtgagcggcctgaagatcgcctccctgacctgcagcgggtgctacgcctgctccagcggcatcagctgcaaggtccggatccacgtgaacgagcccgacgagttcaccgtgcacgtccgctccagcgacccggacgtggtggccgcggggtccagcctcatggcccggaagatcgagttcggcgccgactccacgttcaaggccttcagctccatgcccaaggacagcctgtgcttctacatcgtcgagaaggactactgctccagctgcaccgacgacgacacccagaagtgcgtgaacaccaagctggaccacccccagtccatcctcatcgagcacaagggcacgatcatcgggaagcagaacgacacgtgcagcaccaagacctcctgctggctggagagcgtgaagggcttcttctacgggctgaagaacatgctctccggcatcttcgggaacgtcttcctgggcatcttcctgttcctcgcccccttcgtgctgctgatcttcttcttcttcttcggctggcgcctcctgttctgcctgaagtgctgccgccggacccgcgggctcctgaagtacaagcacctgaaggacgaggaggaggcgggctacaagaagatcatcgagcggctcaacgggaagaagggcaagagccagctgttcgacggcgagcgcctggccgaccggaagatcgccgagctgttctccaccaagatccacatcggg

SEQ ID NO: 12085 - RNA, 3495 nt, synthetic construct
  misc_feature 1..3495: note = derived and/or modified CDS sequence (opt1) from CCHVF(CCHVF 75024)__AB069671.1__Gn-NSm-Gc
  source 1..3495: mol_type = other RNA
agcgaggagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagatgggctgctacaccatcaaccgggtgaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcgtgctggacgcgtgcgactccagctgcgaggtgatgatccccaagggcaccggcgacatcctcgtcgactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcacgatctgcgagaccacccccgccaacgcgatcgacgccgagatgcacgacctcaactgctcctacaacatctgcccctactgcgccagccgcctgacctccgacgggctggcccggcacgtcacgcagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtcctcttcgccatctccctgagccccgtgcagtccgcccccatcgggcacggcaagaccatcgagacgtaccaggcccgcgaggagtacaccagcatctgcctgttcgtgctcggctccatcctgttcatcgtgagctgcctgatgaaggggctcgtggactccatcggcaacatcttcttcccggggctgagcatctgcaagacctgctccatcggcagcatcaacgggttcgagatcgagtcccacaagtgctactgcagcctgctctgctgcccctactgccggcactgctccgccgaccgcgagatccaccagctgcacctgagcatctgcaagaagcggaagaccggctccaacgtcatgctcgcggtgtgcaagcgcatgtgcttccgggccacgatggaggtgagcaacaaggccctgctgatccgctccatcatcaacaccaccttcgtcgtgtgcatcctcatcctggccgtctgcgtggtgagcaccagcgccgtcgagatggagtccctgcccgcgggcacgtgggagcgcgaggaggacctcaccaacttctgccaccaggagtgccaggtgaccgagaccgagtgcctgtgcccctacgaggccctggtgctgcggcgccccctcttcctggacagcatcgtccgggggatgaagaaccagctgaactccacgagcctcgagacctccctgagcatcgaggccccctggggcgccatcaacgtgcagtccacctacaagcccaccgtgagcacggccaacatcgcgctgtcctggagctccgtcgagcaccgcgggaacaagatcctcgtgagcggccggtccgagagcatcatgaagctggaggagcgcaccgggatctcctgggacctgggcgtggaggacgccagcgagtccaagctcctgaccgtcagcgtgatggacctgagccagatgtactcccccgtgttcgagtacctcagcggcgaccggcaggtcgaggagtggccgaaggcgacctgcaccggggactgccccgagcgctgcggctgcacgacctccacgtgcctgcacaaggagtggccccacagccggaactggcgctgcaaccccacctggtgctggggcgtggggaccggctgcacgtgctgcgggctggacgtgaaggacctcttcaccgactacatgatcgtcaagtggaaggtggagtacatcaagaccgaggccatcgtgtgcgtcgagctgacctcccaggagcggcagtgcagcctgatcgaggccggcacccgcttcaacctcgggtccgtgaccatcaccctgagcgagccgcggaacatccagcagaagctgccgcccgagatcatcacgctccacccccgcatcgaggagggcttcttcgacctgatgcacgtgcagaaggtcctgtccgccagcaccgtgtgcaagctccagtcctgcacccacggggtgccgggcgacctgcaggtctaccacgtgggcaacctgctcaagggggacaaggtgaacggccacctgatccacaagatcgagccccacctgaacaccagctggatgtcctgggacgggtgcgacctcgactactactgcaacatgggcgactggcccagctgcacgtacaccggggtcacccagcacaaccacgcctccttcgtgaacctgctgaacatcgagaccgactacaccaagagcttccacttccactccaagcgggtgaccgcccacggcgacaccccgcagctcgacctgaaggcccgccccacctacggcgcgggggagatcacggtcctggtggaggtggccgacatggagttcacccccaagaagatcgagatcagcggcctcaagttcgcctccctgacctgcaccgggtgctacgcctgcagcagcggcatctcctgcaaggtccggatccacgtggacgagcccgacgagctgacggtgcacgtcaagagcgacgacccggacgtggtggccgcgtccagctccctcatggcccgcaagctggagttcgggaccgacagcaccttcaaggccttctccgccatgcccaagaccagcctgtgcttctacatcgtcgagcgggagtactgcaagtcctgcagcaaggaggacacgcagaagtgcgtgaacaccaagctcgagcagccccagtccatcctgatcgagcacaagggcaccatcatcggcaagcagaacaacacgtgcaccgccaaggcgagctgctggctggagtccgtcaagagcttcttctacgggctcaagaacatgctgtccggcatcttcgggaacctgttcatgggcatcttcctcttcctggcccccttcatcctgctcatcctgttcttcatgttcgggtggcgcatcctgttctgcttcaagtgctgccgccggacccgcggcctcttcaagtaccggcacctgaaggacgacgaggagaccggctaccgccggatcatcgagcgcctgaacaacaagaaggggaagaacaagctcctggacggcgagcggctggccgaccgccggatcgccgagctgttcagcaccaagacccacatcggg

SEQ ID NO: 12086 - RNA, 3495 nt, synthetic construct
  misc_feature 1..3495: note = derived and/or modified CDS sequence (opt1) from CCHVF(CCHVF 7803)__AB069672.1__Gn-NSm-Gc
  source 1..3495: mol_type = other RNA
agcgaggagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagatgggctgctacaccatcaaccgggtcaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcatcctggacgcgtgcgactccagctgcgaggtgatgatccccaagggcaccggcgacatcctcgtggactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtcatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaacatctgcccctactgcgccagccgcctgacctccgacgggctggcccggcacgtgacgcagtgcccgaagcgcaaggagaaggtcgaggagaccgagctctacctgaacctggagcggatcccctgggtggtgcgcaagctcctgcaggtcagcgagagcaccggcgtggcgctgaagcggtccagctggctcatcgtgctgctggtcctcttcgccatctccctgagccccgtgcagtccgcccccatcagccacgggaagaccatcgagacgtaccaggcccgcgaggagtacacctccatctgcctgttcgtgctcggcagcatcctgttcatcgtctcctgcctgatgaagggcctcgtggacagcatcgggaacatcttcttcccgggcctgtccatctgcaagacctgcagcatcgggtccatcaacggcttcgagatcgagagccacaagtgctactgctccctgctctgctgcccctactgccggcactgcagcgccgaccgcgagatccaccagctgcacctgtccatctgcaagaagcggaagaccgggagcaacgtgatgctcgcggcctgcaagcgcatgtgcttccgggccacgatggaggtctccaacaaggccctgctgatccgcagcatcatcaacaccaccttcgtggtgtacatcctcatcctggccgtctgcgtggtcagcacctccgcggtggagatggagagcctgcccgccggcacgtgggagcgcgaggaggacctcaccaacttctgccaccaggagtgccaggtgaccgagaccgagtgcctgtgcccctacgaggccctggtcctgcggcgccccctcttcctggactccatcgtgcggggcatgaagaaccccctgaacagcacgtccctcgagaccagcctgtccatcgaggccccctggggcgccatcaacgtgcagagcacctacaagcccaccgtctccacggcgaacatcgccctgagctggtccagcgtggagcaccgcgggaacaagatcctcgtgtccgggcggagcgagtccatcatgaagctggaggagcgcaccggcatcagctgggacctgggggtcgaggacgcctccgagagcaagctcctgaccgtgagcgtgatggacctgtcccagatgtacagcccggtcttcgagtacctctccggcgaccgccaggtggaggagtggcccaaggcgacctgcaccggcgactgccccgagcggtgcgggtgcacgaccagcacgtgcctgcacaaggagtggccccactcccggaactggcgctgcaacccgacctggtgctggggcgtggggaccggctgcacgtgctgcggcctggacgtcaaggacctcttcaccgactacatgatcgtgaagtggaaggtggagtacatcaagacccgggggatcgtctgcgtggagctgaccagccaggagcgccagtgctccctgatcgaggccggcacccggttcaacctcgggagcgtgaccatcaccctgtccgagccccgcaacatccagcagaagctgccgcccgagatcatcacgctccacccgcggatcgaggagggcttcttcgacctgatgcacgtccagaaggtgctgagcgcctccaccgtgtgcaagctccagagctgcacccacggggtccccggcgacctccaggtgtaccacgtgggcaacctgctgaagggggacaaggtcaacggccacctgatccacaagatcgagccccacctgaacacctcctggatgagctgggacgggtgcgacctcgactactactgcaacatgggcgactggccgtcctgcacgtacaccggggtgacccagcacaaccacgccagcttcgtgaacctgctgaacatcgagaccgactacacgaagtccttccacttccacagcaagcgcgtcaccgcccacggcgacacgccccagctcgacctgaaggcccggcccacctacggcgcgggggagatcaccgtgctggtggaggtcgccgacatggagttcacccccaagaagatcgagatctccggcctcaagttcgccagcctgacctgcaccgggtgctacgcctgcagctccggcatcagctgcaaggtgcgcatccacgtggacgagccggacgagctgacggtccacgtgaagtccgacgaccccgacgtggtcgccgcgagctccagcctcatggcccggaagctggagttcgggaccgactccaccttcaaggccttcagcgccatgcccaagacctccctgtgcttctacatcgtggagcgcgagtactgcaagagctgctccaaggaggacacgcagaagtgcgtgaacaccaagctcgagcagccccagagcatcctgatcgagcacaagggcaccatcatcggcaagcagaacaacacgtgcaccgccaaggcgtcctgctggctggagagcgtcaagtccttcttctacgggctcaagaacatgctgagcggcatcttcgggaacttcttcatgggcatcttcctgttcctcgccccgttcatcctgctgatcctcttcttcatgttcgggtggcgcatcctgttctgcttcaagtgctgccggcgcacccggggcctgttcaagtaccgccacctcaaggacgacgaggagaccggctaccggcgcatcatcgagcggctgaacaacaagaaggggaagaacaagctgctcgacggcgagcgcctggccgaccggcgcatcgccgagctgttctccaccaagacccacatcggg

SEQ ID NO: 12087 - RNA, 3495 nt, synthetic construct
  misc_feature 1..3495: note = derived and/or modified CDS sequence (opt1) from CCHVF(CCHVF 79121)__AB069673.1__Gn-NSm-Gc
  source 1..3495: mol_type = other RNA
gccgagggcgggagctccgactgcatcagccgcacccagctcgtgaagaccgaggtcgccgagatccacgaggactcctacggcgggcccggcgagaagatcacgatctgcaacgggagcaccatcgtggaccagggcctcggctccgagctggggtgctacaccatcaaccgggtgcgcagctacaagctgtgcgagaactccgcgagcggcaagtcctgcgagatcgacagcatcccggtcaagtgcaagcaggggttctgcctcaagatcacccaggagggccgggggcacgtgaagctgtcccgcggcacggagatcgtgctggacgtctgcgacagctcctgcgagctcatgatccccaagggcaccggggacatcctggtggactgcagcggcgggcagcagcacttcctgcagaacaacctcatcgacctgggctgccccaacgtgcccctgctcggcaagatggccatctacgtctgccggatgtccaaccacccgaagaccaccatggccttcctgttctggttcagcttcgggtacgtgatcacgtgcatcgcctgccgcgtgctgttctacctcctgatcgccatcggcaccgtcgggaagaagctgaagcagtaccgggagctcaagccccagacctgcatcgtgtgcgagtccgtgcccgtcaacgcgatcgacgccgagatgcacgagctgaactgcagctacaacatctgcccctactgcgcctcccgcctgagcaccgacggcctcatccggcacgtgacgcagtgcccgaagcgccgggagaaggtggaggagaccgagctgttcctgaacctcgagcgcatcccctggctggtccggaagctgctccaggtgagcgagtccaccgggatggccctgaagcgcagctgctggatgatcaccctgctcatcctgctgctcgtgtccatcagccccgtccagtccgcgcccgtgggcaaggagcgggccatcgagacgtaccaggcccgcgagacctacaccggcatctgcctgttcgtgctggggagcgtcctcttcgccgtgtcctggctgaccaaggccctgatcgacggcatcgggaacagcttctccccgggcctcagcgtctgcaagacgtgctccatcgggagcatcaacggcttcgagatcgagtcccacaagtgctactgcagcctgttctgctgcccctactgccgggcgtgctccagcgacaagaacacccaccgcatgcacctgaacgtgtgcaagaagcggaagatgggctccaacgtgatgctcgccgtctgcaagcgcatgtgcttccgggccaccatcgaggccagcaacaaggccctgctgatccgctccatcatcaacagcaccttcgtgatctgcatcctcatcctgacgatctgcgtggtcagcacctccgcggtggacatggagaacctgcccgccgggatctgggagaaggaggaggacctcaccaacttctgccaccaggagtgccaggtgaccgagacggagtgcctgtgcccctacgaggccatggtcctgcgcaagccgctgttcctcgacagcaccgccaagggcatgaagtccctgctgaacagcacctccctcgagaccagcctgtccatcgaggccccctggggcgcgatcaacgtgcagagcacgttcaagcccaccgtgtccgccgccaacatcgccctgagctggtccagcgtcgagcaccgggggaacaagatcctcgtgtccgggcgcagcgagtccatcatgaagctggaggagcggaccggcgtgagctggaacctgggcgtcgaggacgcctccgagagcaagaccctcacggtgagcgtgatggacctgtcccagatgtacagccccgtcttcgagtacctgtccggggaccgccaggtggaggagtggccgaaggcgacctgcaccggcgactgccccgagcggtgcgggtgcaccagctccacgtgcctccacaaggagtggccccacagccgcaactggcggtgcaaccccacctggtgctggggcgtgggcaccgggtgcacgtgctgcggcctggacgtcaaggacttcttcaccgactacatgctggtgaagtggaaggtggagtacatcaagaccgaggccatcgtctgcgtggagctcacctcccaggagcgccagtgcagcctgatcgaggccgggacccggttcaacctgggcccggtgaccatcacgctctccgagccccgcaacgtccagcagcggctgccgcccgagatcgtgaccctgcaccccaagatcgaggaggggttcttcgacctcatgcacgtgcagaagatcctgagcgcctccaccgtctgcaagctgcagagctgcacccacggcgtgcccggcgacttccagatctaccacgtggggaacctcctgcgcggcgacaaggtcaacgggcactccatccacaagatcgagccccacttcaacacgagctggatgtcctgggacggctgcgacctggactacttctgcaacatgggggactggccgagctgcacctacaccggcgtgacccagcacaaccgggcggccttcatcaacatgctcaacatcgagacggactacaccaagaccttccacttccactccaagcgcgtgaccgcccacggcgacacgccccagctggacctgaaggcccggcccgcctacggggcgggcgaggtcaccgtgctcgtggaggtcgccgacctggagctgcacaccaagaacctcgaggtgagcgggctgaagatcgcctccctgacctgcagcggctgctacgcctgcagctccgggatcagctgcaaggtgcgcatccacgtcaacgagcccgacgagttcacggtgcacgtgcggtccagcgacccggacgtcgtggccgcgggctccagcctcatggcccgcaagatcgagttcggcgccgactccaccttcaaggccttcagctccatgcccaaggacagcctgtgcttctacatcgtggagaaggactactgctccagctgcaccgacgacgacacccagaagtgcgtcaacacgaagctggaccacccccagtccatcctcatcgagcacaaggggaccatcatcggcaagcagaacgacacgtgcagcaccaagacctcctgctggctggagagcgtgaaggggttcttctacggcctgaagaacatgctctccgggatcttcggcaacgtgttcctgggcatcttcctgttcctcgcccccttcgtcctgctgatcttcttcttcttcttcgggtggcggctcctgttctgcctgaagtgctgccgccgcacccggggcctcctgaagtacaagcacctgaaggacgaggaggaggcggggtacaagaagatcatcgagcgcctcaacggcaagaagggcaagagccagctgttcgacggggagcggctggccgaccgcaagatcgccgagctgttctccaccaagatccacatcggc

SEQ ID NO: 12088 - RNA, 3495 nt, synthetic construct
  misc_feature 1..3495: note = derived and/or modified CDS sequence (opt1) from CCHVF(CCHVF 8402)__AB069674.1__Gn-NSm-Gc
  source 1..3495: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtggtgacctgcatcctgtgcaaggtcatcttctacctcctgatcgtggtgggcaccctggggaagaagttcaagcagtaccgcgagctcaagccccagacgtgcaccatctgcgagaccacccccgtcaacgccatcgacgccgagatgcacgacctgaactgcagctacaacatctgcccctactgcgcgtcccggctgacgagcgacggcctcgcccgccacgtgatgcagtgcccgaagcggaaggagaagatcgaggagaccgagctgtacctgaacctcgagcgcatcccctgggtggtccggaagctgctccaggtgtccgagagcaccggggtggccctgaagcgcagctcctggctggtcgtgctgctcgtgctgctgaccgtcagcctctcccccgtgcagagcgcccccatcggccacgggaagacggtggagacctaccagacccgggagggctacacctccatctgcctgttcgtcctgggcagcatcctcttcatcgtgtcctgcctgatgaaggggctggtcgacagcgtgggcaactccttcttcccggggctcagcatctgcaagacgtgctccatcggcagcgtgaacgggttcgagatcgagtcccacaagtgctactgcagcctgttctgctgcccctactgccgccactgctccgcggaccgggagatccaccgcctgcacctcagcatctgcaagaagcggaagaccggctccaacgtcatgctggccgtgtgcaagcgcatgtgcttccgggccaccgtggaggtcagcaacaaggccctgctcatccgcaacatcatcaacaccacgttcgtgctgtgcatcctgatcctcgccgtgtgcgtcgtgtccaccagcgcggtggagatggagagcctgcccgccggcacctgggagcgcgaggaggacctgaccaacttctgccaccaggagtgccaggtcacggagaccgagtgcctgtgcccctacgaggccctcgtgctgcggaagccgctgttctccgacagcatcgtgaaggggatgaagaacctcctgaactccaccagcctggagacctccctcagcatcgaggccccctggggcgccatcaacgtccagtccacgttcaagcccaccgtgagcgcggccaacatcgccctgtcctggagctccgtggagcaccgcgggaacaagatcctggtcagcggccggtccgagagcatcatgaagctcgaggagcgcaccgggatctcctgggacctgggcgtggaggacgccagcgagtccaagctgctcaccgtgagcgtcatggacctgagccagatgtactcccccgtgttcgagtacctgagcggcgaccgccaggtggaggagtggccgaaggcgacctgcacgggggactgccccgagcggtgcggctgcacctccagcacgtgcctccacaaggagtggccccactcccggaactggcgctgcaaccccacctggtgctggggcgtcgggaccggctgcacgtgctgcgggctggacgtgaaggacctgttcaccgactacatgttcatcaagtggaaggtggagtacatcaagaccgaggccatcgtctgcgtggagctcaccagccaggagcggcagtgcaccctgatcgaggccggcacccgcttcaacctggggccggtgaccatcacgctctccgagccccggaacatccagcagaagctgccgcccgagatcgtcaccctgcacccccgcatcgaggagggcttcttcgacctcatgcacgtgcagaaggtgctgagcgcctccaccgtctgcaagctgcagagctgcacccacggggtgcccggcgacctccaggtgtaccacatcggcaacctgctgaagggggacaaggtcaacggccacctcatccacaagatcgagccccacttcaacacgtcctggatgagctgggacgggtgcgacctggactactactgcaacatgggcgactggccgtcctgcacctacaccggggtgacccagcacaaccacgccgccttcgtgaacatgctgaacatcgagacggactacaccaagaacttccacttccacagcaagcgggtcaccgcgcacggcgacacgccccagctcgacctgaaggcccgccccacctacggcgccggggagatcaccgtgctggtggaggtcgccgacatggagctccacaccaagaagatcgagatctccggcctgaagttcgcgagcctgacctgcacggggtgctacgcctgctccagcggcatctcctgcaaggtgcggatccacgtggacgagcccgacgagctcaccgtccacgtcaagagcgaggacccggacatcgtggccgccagctccagcctgatggcccgcaagctggagttcgggaccgactccaccttcaaggcgttcagcgccatgcccaagacgtccctctgcttctacatcgtggagcgggagtactgcaagagctgctccaaggaggacacccagaagtgcgtgaacaccaagctggagcagccccagagcatcctgatcgagcacaagggcaccatcatcggcaagcagtccaacacgtgcaccgccaaggccagctgctggctcgagtccgtcaagagcttcttctacgggctgaagaacatgctgtccggcatcttcgggaacgtgttcatcggcgtgttcctcttcttcgcccccttcatcctgctgatcctcttcttcatgttcgggtggcgcatcctgttctgcttcaagtgctgccggcgcacccgcggcctgttcaagtaccggcacctcaaggacgacgaggagaccggctaccgcaagatcatcgagcggctgaacaacaagaaggggaagaacaagctgctcgacggcgagcgcctggcggaccggaagatcgccgagctgttcagcaccaagacgcacatcggg

SEQ ID NO: 12089 - RNA, 3495 nt, synthetic construct
  misc_feature 1..3495: note = derived and/or modified CDS sequence (opt1) from CCHVF(CCHVF 88166)__AB069675.1__Gn-NSm-Gc
  source 1..3495: mol_type = other RNA
agcgaggagtccggcgacgactgcatcagccgcacccagctgctccggaccgagacggccgagatccactccgacaactacgggggccccggggacaagatcaccatctgcaacggcagcaccgtggtcgaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggtcatcttctacctcctgatcgtggtggggaccctgggcaagaagttcaagcagtaccgcgagctcaagccccagacgtgcaccatctgcgagaccacccccgtcaacgccatcgacgccgagatgcacgacctgaactgctcctacaacatctgcccctactgcgccagccggctgacgtccgacgggctcgcgcgccacgtgatgcagtgcccgaagcggaaggagaagatcgaggagaccgagctgtacctgaacctcgagcgcatcccctgggtggtccggaagctgctccaggtgagcgagagcaccggcgtggccctcaagcgctccagctggctggtcgtgctgctcgtgctgctgaccgtctccctcagccccgtgcagtccgcccccatcgggcacggcaagacggtggagacctaccagacccgggagggctacaccagcatctgcctgttcgtcctggggtccatcctcttcatcgtgagctgcctgatgaagggcctggtcgactccgtggggaacagcttcttcccgggcctctccatctgcaagacgtgcagcatcgggtccgtgaacggcttcgagatcgagagccacaagtgctactgctccctgttctgctgcccctactgccgccactgcagcgccgaccgggagatccaccgcctgcacctctccatctgcaagaagcggaagacctggagcaacgtcatgctggcggtgtgcaagcgcatgtgcttccgggccaccgtggaggtctccaacaaggccctgctcatccgcaacatcatcaacaccacgttcgtgctgtgcatcctgatcctcgccgtgtgcgtcgtgagcaccagcgccgtggagatggagtccctgcccgcgggcacctgggagcgcgaggaggacctgaccaacttctgccaccaggagtgccaggtcacggagaccgagtgcctgtgcccctacgaggccctcgtgctgcggaagccgctgttcagcgactccatcgtgaaggggatgaagaacctcctgaacagcacctccctggagaccagcctctccatcgaggccccctggggcgccatcaacgtccagagcacgttcaagcccaccatgtccgccgcgaacatcgccctgagctggtccagcgtggagcaccgcgggaacaagatcctggtgtccggccggagcgagtccatcatgaagctcgaggagcgcaccgggatcagctggaacctgggcgtcgaggacgcctccgagagcaagctgctcaccgtgagcgtgatggacctgtcccagatgtacagccccgtcttcgagtacctgtccggcgaccgccaggtggaggagtggccgaaggcgacctgcacgggggactgccccgagcggtgcggctgcaccagctccacgtgcctccacaaggagtggccccacagccggaactggcgctgcaaccccacctggtgctggggcgtggggaccggctgcacgtgctgcgggctggacgtcaaggacctgttcaccgactacatgttcatcaagtggaaggtggagtacatcaagaccgaggccatcgtgtgcgtcgagctcacctcccaggagcggcagtgcaccctgatcgaggccggcacccgcttcaacctggggccggtgaccatcacgctcagcgagccccggaacatccagcagaagctgccgcccgagatcgtgaccctgcacccccgcatcgaggagggcttcttcgacctcatgcacgtccagaaggtgctgtccgccagcaccgtgtgcaagctgcagtcctgcacccacggggtccccggcgacctccaggtgtaccacatcggcaacctgctgaagggggacaaggtgaacggccacctcatccacaagatcgagccccacttcaacacgagctggatgtcctgggacgggtgcgacctggactactactgcaacatgggcgactggccgagctgcacctacaccggggtcacccagcacaaccacgccgccttcgtgaacatgctgaacatcgagacggactacaccaagaacttccacttccactccaagcgggtgaccgcccacggcgacacgccccagctcgacctgaaggcgcgccccacctacggcgccggggagatcaccgtcctggtggaggtggccgacatggagctccacaccaagaagatcgagatcagcggcctgaagttcgcctccctgacctgcacggggtgctacgcgtgcagctccggcatcagctgcaaggtccggatccacgtggacgagcccgacgagctcaccgtgcacgtcaagagcgaggacccggacctggtggccgcctccagctccctgatggcccgcaagctcgagttcgggaccgacagcaccttcaaggccttctccgcgatgcccaagacgagcctgtgcttctacatcgtggagcgggagtactgcaagtcctgcagcaaggaggacacccagaagtgcgtcaacaccaagctggagcagccccagtccatcctcatcgagcacaagggcaccatcatcggcaagcagaacaacacgtgcaccgccaaggccagctgctggctggagtccgtcaagagcttcttctacgggctgaagaacatgctctccggcatcttcgggaacgtgttcatcggcgtgttcctgttcttcgcccccttcatcctgctcatcctgttcttcatgttcgggtggcgcatcctgttctgcttcaagtgctgccggcgcacccgcggcctcttcaagtaccggcacctgaaggacgacgaggagaccggctaccgcaagatcatcgagcggctgaacaacaagaaggggaagaacaagctcctggacggcgagcgcctggccgaccggaagatcgcggagctgttcagcaccaagacgcacatcggg

SEQ ID NO: 12090 - RNA, 3495 nt, synthetic construct
  misc_feature 1..3495: note = derived and/or modified CDS sequence (opt1) from CCHVF(CCHVF BA88166)__AF338470.1__Gn-NSm-Gc
  source 1..3495: mol_type = other RNA
agcgaggagtccggcgacgactgcatcagccgcacccagctcctccggaccgagacggccgagatccactccgacaactacgggggccccggggacaagatcaccatctgcaacggcagcaccgtggtcgaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggggatcttctacctcctgatcgtcgtgggcaccctggggaagaagttcaagcagtaccgcgagctcaagccccagacgtgcaccatctgcgagaccacccccgtgaacgccatcgacgccgagatgcacgacctgaactgctcctacaacatctgcccctactgcgccagccggctgacgtccgacggcctcgcgcgccacgtcatgcagtgcccgaagcggaaggagaagatcgaggagaccgagctgtacctgaacctcgagcgcatcccctgggtggtgcggaagctgctgcaggtcagcgagagcaccggggtggccctcaagcgctccagctggctggtggtcctgctcgtgctgctgaccgtgtccctcagccccgtccagtccgcccccatcggccacggcaagacggtggagacctaccagacccgggaggggtacaccagcatctgcctgttcgtgctgggctccatcctcttcatcgtcagctgcctgatgaaggggctggtggactccgtcggcaacagcttcttcccggggctctccatctgcaagacgtgcagcatcggctccgtgaacggcttcgagatcgagagccacaagtgctactgctccctgttctgctgcccctactgccgccactgcagcgccgaccgggagatccaccgcctgcacctctccatctgcaagaagcggaagacctggagcaacgtgatgctggcggtctgcaagcgcatgtgcttccgggccaccgtggaggtgtccaacaaggccctgctcatccgcaacatcatcaacaccacgttcgtcctgtgcatcctgatcctcgccgtgtgcgtggtcagcaccagcgccgtggagatggagtccctgcccgcggggacctgggagcgcgaggaggacctgaccaacttctgccaccaggagtgccaggtgacggagaccgagtgcctgtgcccctacgaggccctcgtcctgcggaagccgctgtacctcgacagcatcgtgaagggcatgaagaacctgctgaactccaccagcctcgagacctccctgagcatcgaggccccctggggcgccatcaacgtgcagtccacgttcaagcccaccatgagcgccgcgaacatcgccctgtcctggagctccgtcgagcaccgcgggaacaagatcctcgtgagcgggcggtccgagagcatcatgaagctggaggagcgcaccggcatctcctggaacctgggcgtggaggacgccagcgagtccaagctcctgaccgtcagcgtgatggacctgagccagatgtactcccccgtgttcgagtacctcagcggggaccggcaggtcgaggagtggccgaaggcgacctgcacgggcgactgccccgagcgctgcgggtgcacctccagcacgtgcctgcacaaggagtggccccactcccggaactggcgctgcaaccccacctggtgctggggcgtgggcaccgggtgcacgtgctgcggcctggacgtgaaggacctcttcaccgactacatgttcatcaagtggaaggtcgagtacatcaagaccgaggccatcgtgtgcgtggagctgaccagccaggagcggcagtgcaccctgatcgaggccgggacccgcttcaacctcggcccggtcatcatcaccctgtccgagccccggaacatccagcagaagctgccgcccgagatcgtgacgctccacccccgcatcgaggaggggttcttcgacctgatgcacgtgcagaaggtcctgagcgcctccaccgtgtgcaagctccagagctgcacccacggcgtgcccggcgacctgcaggtctaccacatcgggaacctgctcaagggcgacaaggtgaacgggcacctgatccacaagatcgagccccacttcaacacctcctggatgagctgggacggctgcgacctggactactactgcaacatgggggactggccgtcctgcacgtacaccggcgtgacccagcacaaccacgccgccttcgtcaacatgctcaacatcgagaccgactacacgaagaacttccacttccacagcaagcgggtgaccgcccacggcgacacgccccagctggacctgaaggcgcgccccacctacggggccggcgagatcaccgtgctcgtcgaggtggccgacatggagctgcacaccaagaagatcgagatctccgggctgaagttcgccagcctgacctgcaccggctgctacgcgtgctccagcgggatctcctgcaaggtgcggatccacgtcgacgagcccgacgagctcacggtgcacgtcaagagcgaggacccggacatcgtggccgccagctccagcctgatggcccgcaagctcgagttcggcaccgactccaccttcaaggccttcagcgcgatgcccaagacctccctgtgcttctacatcgtggagcgggagtactgcaagagctgctccaaggaggacacgcagaagtgcgtgaacaccaagctggagcagccccagagcatcctcatcgagcacaagggcaccatcatcgggaagcagaacaacacgtgcaccgccaaggcctcctgctggctggagagcgtcaagtccttcttctacggcctgaagaacatgctcagcgggatcttcggcaacgtgttcatcggggtgttcctgttcttcgcccccttcatcctgctcatcctgttcttcatgttcggctggcgcatcctgttctgcttcaagtgctgccggcgcacccgcggcctcttcaagtaccggcacctgaaggacgacgaggagaccgggtaccgcaagatcatcgagcggctgaacaacaagaagggcaagaacaagctcctggacggggagcgcctggccgaccggaagatcgcggagctgttctccaccaagacccacatcggc

SEQ ID NO: 12091 - RNA, 3495 nt, synthetic construct
  misc_feature 1..3495: note = derived and/or modified CDS sequence (opt1) from CCHVF(CCHVF BA66019)__AF350448.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtcgaccagcgcctgggcagcgagctgggctgctacaccatcaaccgggtgaagtccttcaagctctgcgagaacagcgggacgggcaagtcctgcaagatcgacaagcacccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagaccacgatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccaccaacgccatcgacgccgagatgcacgacctcaagtgctcctacaacatctgcccctactgcgccagccggctgacgtccgacggcctggcgcgccacgtgacccagtgcccgaagcggaaggagaaggtcgaggagaccgagctctacctgaacctggagcgcatcccctggatcgtgcggaagctcctccaggtgagcgagtccaccggggtcgccctgaagcgcagcagctggctcatcgtgctgctggtgctcctgacggtctccctgagccccgtgcagtccgcccccatcggccacggcaagaccatcgaggcctaccagacccgggaggggtacaccagcgtgtgcctcttcatgctgggcgggatcctgttcgtcgtgtcctgcctcatgaagggcctggtggacagcgtctccaacagcttcttcccggggctgtccatctgcaagacgtgcagcatcggctccgtgaacggcttcgagatcgagagccacaagtgctactgctccctcctgtgctgcctgtactgccgccactgcagcgcggaccgggagatccaccagctccacctgtccatctgcaagaagcgccgggccgggggcaacgtcatgctggccgtgtgcaagcgcatgtgcctccgggccaccatggaggtgagcaacaaggtcctgttcatccgctccatcatcaacaccaccttcgtgatctgcatcctggtgctcgccgtctgcatcgtgagcacgtccgcggtggagatggagagcctgcccgccgggacctgggagcgcgaggaggacctgaccaacttctgccaccaggagtgccaggtcaccgagacggagtgcctgtgcccctacgaggccctcgtgctgcggaagcccctgttcagcgactccatcgtgaagggcatgaagaacctcctgaacagcacctccctggagaccagcctctccatcgaggccccgtggggcgccatcaacgtccagagcaccttcaagcccacggtgtccaccgcgaacatcgccctgagctggtccagcgtggagcaccgcgggaacaagatcctggtctccggccggagcgagtccatcatgaagctcgaggagcgcaccgggatcagctgggacctgggcgtggaggacgcctccgagagcaagctgctcaccgtgtccgtcatggacctgagccagatgtacagccccgtgttcgagtacctgtccggggaccgccaggtggaggagtggcccaaggcgacctgcacgggcgactgcccggaccggtgcggctgcaccagctccacgtgcctccacaaggagtggccccacagccggaactggcgctgcaaccccacctggtgctggggcgtcgggaccgggtgcacgtgctgcggcctggacgtgaaggacctgttcaccgactacatgttcgtgaagtggaaggtcgagtacatcaagaccgaggccatcgtgtgcgtggagctcaactcccaggagcggcagtgcagcctgatcgaggccgggacccgcttcaacctgggccccgtcaccatcaccctctccgagccgcggaacatccagcagaagctgccgcccgagatcatcaccctgcacccccgcatcgaggagggcttcttcgacctcatgcacgtgcagaaggtgctgagcgcctccacggtctgcaagctgcagagctgcacccacggggtgcccggcgacctccagatctaccacatcgggaacctgctgaagggcgaccgggtgaacgggcacctcatccacaagatcgagccccacttcaacacctcctggatgagctgggacggctgcgacctggactactactgcaacatgggcgactggccctcctgcacctacacgggggtcacccagcacaaccacgccgccttcgtgaacctgctcaacatcgagaccgactacaccaagaacttccacttccacagcaagcgcgtgacggcccacggcgacaccccgcagctggacctgaaggcgcggcccacctacggggccggcgagatcaccgtcctcgtggaggtggccgacatggagctgcacacgaagaagatcgccatctccgggctgaagttcgcgagcctgacctgcaccggctgctacgcctgctccagcggcatctcctgcaaggtccgcatccacgtggacgagcccgacgagctgaccgtgcacgtcaagagcgaggaccccgacatcgtggccgccagctccagcctgatggcccggaagctcgagttcgggacggactccaccttcaaggcgttcagcgccatgccgaagacctccctgtgcttctacatcgtggagcgcgagtactgcgagagctgctccaaggaggacacccagaagtgcgtcaacacgaagctggagcagccccagagcatcctcatcgagcacaagggcaccatcatcgggaagcagaacgacacgtgcaccgccaaggcctcctgctggctggagagcgtgaagtccttcttctacggcctgaagaacatgctcagcgggatcttcggcaacgtgttcatcggcatcttcctgttcctggcccccttcatcctcctgatcctgttcttcatgttcgggtggcggatcctcttctgcttcaagtgctgccgccgcacccggggcctgttcaagtaccgctacctgaaggacgacgaggagtccgggtaccggcgcatcatcgagcggctcaacaacaagaagggcaagaacaagctgctggacggcgagcgcctcgcggaccggcgcatcgccgagctgttcagcaccaagacccacatcggg

SEQ ID NO: 12092 - RNA, 3495 nt, synthetic construct
  misc_feature 1..3495: note = derived and/or modified CDS sequence (opt1) from CCHVF(CCHVF BA8402)__AF350449.1__Gn-NSm-Gc
  source 1..3495: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaactccttcaacctctgcgagaacacggccaccggcaagagctgcgagatcgactccaccccggtgaagtgccgccaggggttctgcctgaagatcacccaggagggccgggggcacgtcaagctgagccgcggctccgaggtggtgctcgacgcgtgcgagagctcctgcgagatcatgatccccaaggggacgggcgacatcctggtcgactgcagcggcgggcagcagcacttcctgaaggacaacctcatcgacctgggctgccccaacatccccctgctcgggaagatggccatctacatctgccggatgtccaaccacccgaagaccaccatggccttcctgttctggttcagcttcggctacgtggtgacctgcatcctgtgcaaggtcatcttctacctcctgatcgtggtgggcacgctggggaagaagttcaagcagtaccgcgagctcaagccccagacctgcaccatctgcgagaccacgcccgtcaacgccatcgacgccgagatgcacgacctgaactgctcctacaacatctgcccctactgcgcgagccggccgacctccgacggcctggcccgccacgtgatgcagtgccccaagcggaaggagaagatcgaggagaccgccctctacctgaacctggagcgcatcccctgggtggtccggaagctcctccaggtgagcgagtccaccggggtggccctgaagcgcagcagctggctcgtcgtgctgctggtgctcctgacggtctccctgagccccgtgcagtccgcgccgatcggccacgggaagaccgtggagacctaccagacccgggagggctacacgagcatctgcctcttcgtcctgggctccatcctgttcatcgtgagctgcctcatgaaggggctggtcgactccgtgggcaacagcttcttccccgggctgtccatctgcaagacctgcagcatcggctccgtgaacgggttcgagatcgagagccacaagtgctactgctccctcttctgctgcccctactgccgccactgcagcgccgaccgggagatccaccgcctgcacctgtccatctgcaagaagcggaagaccggcagcaacgtcatgctcgccgtgtgcaagcgcatgtgcttccgggccaccgtggaggtctccaacaaggccctgctgatccgcaacatcatcaacacgaccttcgtgctctgcatcctgatcctggcggtgtgcgtcgtgagcacctccgccgtggagatggagagcctccccgccggcacctgggagcgcgaggaggacctgacgaacttctgccaccaggagtgccaggtcaccgagaccgagtgcctgtgcccgtacgaggccctggtgctccggaagcccctgttcagcgactccatcgtgaaggggatgaagaacctgctcaacagcacctccctggagacgagcctgtccatcgaggccccctggggcgcgatcaacgtccagagcaccttcaagcccaccgtgtccgccgccaacatcgccctcagctggtccagcgtggagcaccgcgggaacaagatcctggtctccggccggagcgagtccatcatgaagctggaggagcgcaccgggatcagctgggacctcggcgtggaggacgcctccgagagcaagctgctgaccgtgtccgtcatggacctcagccagatgtacagcccggtgttcgagtacctgtccggcgaccgccaggtggaggagtggcccaaggcgacgtgcaccggggactgccccgagcggtgcggctgcaccagctccacgtgcctgcacaaggagtggccccacagccggaactggcgctgcaacccgacctggtgctggggcgtcgggaccggctgcacgtgctgcgggctcgacgtgaaggacctgttcaccgactacatgttcatcaagtggaaggtggagtacatcaagaccgaggccatcgtctgcgtggagctgacctcccaggagcggcagtgcaccctcatcgaggccggcacccgcttcaacctggggcccgtgacgatcaccctgagcgagccccggaacatccagcagaagctgcccccggagatcgtcaccctgcacccccgcatcgaggagggcttcttcgacctgatgcacgtgcagaaggtgctctccgccagcaccgtctgcaagctgcagtcctgcacgcacggggtgcccggcgacctccaggtgtaccacatcggcaacctgctgaagggggacaaggtcaacggccacctgatccacaagatcgagccgcacttcaacaccagctggatgtcctgggacgggtgcgacctccactactactgcaacatgggcgactggcccagctgcacctacaccggggtgacgcagcacaaccacgccgcgttcgtgaacatgctgaacatcgagaccgactacaccaagaacttccacttccactccaagcgggtcaccgcccacggcgacacgccccagctggacctcaaggcccgccccacctacggcgccggggagatcaccgtgctggtggaggtcgcggacatggagctgcacaccaagaagatcgagatcagcggcctcaagttcgcctccctgacgtgcaccgggtgctacgcctgcagctccggcatcagctgcaaggtgcggatccacgtggacgagccggacgagctgaccgtccacgtgaagtccgaggaccccgacatcgtggccgccagcagctccctcatggcgcgcaagctggagttcgggaccgacagcacgttcaaggccttctccgccatgcccaagaccagcctgtgcttctacatcgtcgagcgggagtactgcgagtcctgcagcaaggaggacacccagaagtgcgtgaacaccaagctcgagcagccccagtccatcctgatcgagcacaagggcacgatcatcggcaagcagagcaacacgtgcaccgccaaggcctcctgctggctggagagcgtgaagtccttcttctacgggctcaagaacatgctgagcggcatcttcgggaacgtcttcatcggcgtgttcctgttcttcgcgccgttcatcctcctgatcctgttcttcatgttcgggtggcgcatcctcttctgcttcaagtgctgccggcgcacccgcggcctgttcaagtaccggcacctgaaggacgacgaggagaccggctaccgcaagatcatcgagcggctcaacaacaagaaggggaagaacaagctgctggacggcgagcgcctcgccgaccggaagatcgccgagctgttctccaccaagacccacatcggg

SEQ ID NO: 12093 - RNA, 3495 nt, synthetic construct
  misc_feature 1..3495: note = derived and/or modified CDS sequence (opt1) from CCHVF(CCHVF Matin)__AF467769.2__Gn-NSm-Gc
  source 1..3495: mol_type = other RNA
agcgaggagtccggcgacgactgcatcagccgcacccagctgctccggaccgagacggccgagatccactccgacagctacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggtgttcctgttctggttctccttcggctacgtgatcacctgcatcctgtgcaaggtcatcttctacctcctgatcgtggtgggcaccctggggaagaagttcaagcagtaccgcgagctcaagccccagacgtgcaccatctgcgagaccacccccgtcaacgccatcgacgccgagatgcacgacctgaactgcagctacaacatctgcccctactgcgcctcccggctgacgagcgacggcctcgcgcgccacgtgatgcagtgcccgaagcggaaggagaagatcgaggagaccgagctgtacctgaacctcgagcgcatcccctgggtggtccggaagctgctgcaggtgagcgagtccaccggggtggccctcaagcgcagctcctggctggtcgtgctgctcgtgctgctgaccgtcagcctctcccccgtgcagagcgcccccatcggccacgggaagacggtggagacctaccagatccgggagggctacacctccgtctgcctgttcgtgctgggcagcatcctcttcatcgtctcctgcctgatgaaggggctggtggacagcgacggcaactccttcttcccggggctcagcatctgcaagacctgctccatcggcagcatcaacgggttcgagatcgagtcccacaagtgctactgcagcctgttctgctgcccctactgccgccactgctccacggaccgggagatccacaagctgcacctcagcatctgcaagaagcgcaagaccggctccaacgtgatgctggccgtctgcaagcggatgtgcttccgcgcgaccgtggaggtgagcaacaaggccctgctcatccggagcatcatcaacaccacgttcgtcgtgtgcatcctgatcctggccgtgtgcgtcgtgtccaccagcgccgtggagatggagtccctccccgccggcacctgggagcgcgaggaggacctgatcaacttctgccaccaggagtgccaggtcaccgagacggagtgcctgtgcccctacgaggcgctggtgctccgcaagccgctgttcctggacagcatcatcaaggggatgaagaacctcctgaactccaccagcctggagacctccctcagcatcgaggccccctggggcgccatcaacgtgcagtccaccttcaagcccacgatgagcgccgccaacatcgcgctgtcctggagctccgtcgagcaccgggggaacaagatcctggtgagcggccgctccgagagcatcatgaagctcgaggagcggaccgggatctcctgggacctgggcgtggaggacgccagcgagagcaagctgctcaccgtctccgtgatggacctgagccagatgtactcccccgtgttcgagtacctgagcggcgaccgccaggtcgaggagtggccgaaggccacctgcaccggggactgccccgagcggtgcggctgcacgtccagcacctgcctccacaaggagtggccccactcccgcaactggcggtgcaaccccacctggtgctggggggtgggcaccggctgcacgtgctgcgggctggacgtgaaggacctgttcaccgactacatgttcgtcaagtggaaggtggagtacatcaagaccgaggtgatcgtctgcgtggagctcaccagccaggagcgccagtgctccctgatcgaggccggcacgcggttcaacctggggccggtgaccatcaccctcagcgagccccgcaacatccagcagaagctgccccccgagatcgtcaccctgcacccgcggatcgaggagggcttcttcgacctcatgcacgtgcagaaggtgctgtccgccagcacggtctgcaagctgcagtcctgcacccacggggtgcccggcgacctccaggtgtaccacatcggcaacctgctgaagggggacaaggtcaacggccacctcatccacaagatcgagccccacttcaacaccagctggatgtcctgggacgggtgcgacctggactactactgcaacatgggcgactggccgagctgctcctacaccggggtgacgcagcacaaccacgcggccttcgtgaacatgctgagcatcgagaccgactacaccaagaacttccacttccactccaagcgcgtcaccgcccacggcgacacgccccagctcgacctgaaggcccggcccacctacggcgccggggagatcaccgtgctggtggaggtcgcggacatggagctccacaccaagaagatcgagatcagcggcctgaagttcgccagcctgacgtgcaccgggtgctacgcctgctccagcggcatctcctgcaaggtgcgcatccacgtggacgagcccgacgagctcaccgtccacgtgaagagcgaggacccggacatcgtggccgcgtccagctccctgatggcccggaagctggagttcgggaccgacagcacgttcaaggccttctccgccatgcccaagaccagcctctgcttctacatcgtcgagcgcgagtactgcaagtcctgcagcaaggaggacacccagaagtgcgtgaacaccaagctggagcagccccagtccatcctgatcgagcacaagggcacgatcatcggcaagcagaacgacacctgcaccgccaaggcgagctgctggctcgagtccgtgaagagcttcttctacgggctgaagaacatgctgtccggcatcttcgggaacgtcttcatcggcatcttcctcttcctggcccccttcgccctgctcatcctgttcttcatgttcgggtggcggatcctgttctgcttcaagtgctgccgccggacccgcggcctcttcaagtaccgccacctgaaggacgacgaggagacgggctaccggaagatcatcgagcgcctgaacaacaagaaggggaagaacaagctcctggacggcgagcggctggccgaccgcaagatcgccgagctcttcagcaccaagacccacgtgggg

SEQ ID NO: 12094 - RNA, 3495 nt, synthetic construct
  misc_feature 1..3495: note = derived and/or modified CDS sequence (opt1) from CCHVF(CCHVF Baghdad 12)__AJ538197.2__Gn-NSm-Gc
  source 1..3495: mol_type = other RNA
agcgaggagtccggcgacgactgcatcagccgcacccggctgctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacggggaagagctgcaagatcgactccatcccggtgaagtgccggcagggctactgcctcaagatcacccaggaggggcgcggccacgtgaagctgagccgggggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccgcatgtccaaccacccgaagaccacgatggccttcctcttctggttcagcttcggctacgtgatcacctgcatcctgtgcaaggccatcttctacctgctcatcatcgtggggaccctgggcaagcggttcaagcagtaccgcgagctgaagccccagacctgcacgatctgcgagaccacccccgtcaacgccatcgacgcggagatgcacgacctcaactgctcctacaacatctgcccctactgcgccagccggctgacctccgacgggctggcccgccacgtgacgcagtgcccgaagcggaaggagaaggtggaggagaccgagctctacctgaacctggagcgcatcccctgggtcgtgcggaagctcctgcaggtgagcgagagcaccggcgtcgccctgaagcgctccagctggctcatcgtgctgctggtgctcctggcggtctccagctcccccgtgcagagcgcccccatcgggtacggcaagaccatcgagacgtaccaggcccgggagggctacacctccatctgcctgttcgtgctcgggagcatcctgttcatcgtctcctgcctgaccaagggcctcgtggacagcatcgggaacatcttcttcccgggcctgtccatctgcaagacctgcagcatcgggtccatcaacggcttcgaggtggagagccacaagtgctactgctccctgctctgctgcccctactgccgccactgcagcgccgaccgggagatccaccagctgcacctgtccatctgcaagaagcgcaagacgggcagctccgtcatgctcgccgtgtgcaagcggatgtgcttccgcgcgaccatggaggtcagcaacaaggccctgctgatccgcagcatcatcaacaccaccttcgtggtgtgcatcctcacgctggccgtctgcgtggtgtccaccagcgccgtcgagatggagtccctgcccgccgggacctgggagcgggaggaggacctcaccaacttctgccaccaggagtgccaggtgacggagaccgagtgcctgtgcccctacgaggcgctggtgctgcgcaagccgctcttcctggacagcatcgtcaagggcaccaagaacctgctcaactccaccagcctggagacgtccctgagcatcgaggccccctggggggccatcaacgtgcagtccacctacaagcccaccgtgagcaccgccaacatcgccctctcctggagctccgtcgagcaccggggcaacaagatcctggtgagcgggcgctccgagagcatcatgaagctggaggagcggaccggcatctcctgggacctcggcgtggaggacgcgagcgagagcaagctgctgacggtctccgtgatggacctcagccagatgtactcccccgtgttcgagtacctgagcggggaccgccaggtcgaggagtggccgaaggccacctgcaccggcgactgccccgagcggtgcgggtgcaccacgtccacctgcctgcacaaggagtggccccacagccgcaactggcggtgcaaccccacctggtgctggggcgtgggcaccgggtgcacgtgctgcggcctcgacgtgaaggacctgttcaccgactacatgttcgtcaagtggaaggtggagtacatcaagaccgacgccatcgtgtgcgtcgagctgacctcccaggagcgccagtgcagcctcatcgaggccgggacgcggttcaacctgggctccgtgaccatcaccctgagcgagccgcgcaacatccagcagaagctcccccccgagatcatcaccctgcacccccggatcgaggaggggttcttcgacctgatgcacgtgcagaaggtcctctccgccagcacggtgtgcaagctgcagtcctgcacccacggcgtgccgggcgacctgcaggtctaccacatcgggaacctcctgaagggcgacaaggtgaacgggcacctgatccacaagatcgagccccacttcaacaccagctggatgtcctgggacggctgcgacctcgactactactgcaacatgggggactggcccagctgcacctacacgggcgtgacccagcacaaccacgcgtccttcgtcaacctgctgaacatcgagaccgactacaccaagagcttccacttccactccaagcgcgtgacggcccacggcgacaccccgcagctcgacctgaaggtgcggcccacctacggggccggcgagatcaccgtcctggtggaggtggccgacatggagctccacacgaagaagatcgagatcagcgggctgaagttcgcgagcctgacctgcaccggctgctacgcctgctccagcgggatctcctgcaaggtccgcatccacgtggacgagcccgacgagctcaccgtgcacgtcaagagcgacgaccccgacgtggtggccgcctccagctccctgatggcccggaagctggagttcggcacggacagcaccttcaaggcgttctccgccatgccgaagaccagcctctgcttctacatcgtcgagcgcgagtactgcaagtcctgcagcaaggaggacacccagaagtgcgtgaacacgaagctggagcagccccagtccatcctgatcgagcacaagggcaccatcatcgggaagcagaacaacacctgcaccgccaagaccagctgctggctcgagtccgtgaagagcttcttctacggcctgaagaacatgctgtccgggatcttcggcaacttcttcatggggatcttcctcttcctggcccccttcatcctgctcatcctgttcttcatgttcggctggcggatcctgttctgcttcaagtgctgccgccgcacgcggggcctcttcaagtaccgccacctgaaggacgacgaggagaccgggtaccggcgcatcatcgagcggctgaacaacaagaagggcaagaacaagctcctggacggggagcgcctggccgaccggcgcatcgcggagctcttcagcaccaagacccacatcggc

SEQ ID NO: 12095 - RNA, 3495 nt, synthetic construct
  misc_feature 1..3495: note = derived and/or modified CDS sequence (opt1) from CCHVF(CCHVF VLG/TI29414)__AY179961.1__Gn-NSm-Gc
  source 1..3495: mol_type = other RNA
agcgaggagcccggcgacgactgcatctcccgcacccagctcctccgggccgagccggccgagatccacgacgacaactacgggggccccggggacaagatcaccatctgcaacggcagcacgatcgtggaccagcgcctggggtccgagctgggctgctacaccatcaaccgggtcaagagcttcaagctctgcgagaactccgcgaccggcaagacctgcgagatcgacagcacgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccgcacatccccctgctcgggaagatggccatctacatctgccggatgagcaaccacccccgcaccacgatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcgccggtgaacgccatcgacgccgagatgcacgacctcaactgctcctacaacatctgcccctactgcgccagccgcctgacctccgacggcctggcgcggcacgtcccccagtgccccaagcgcaaggagaaggtggaggagaccgagctctacctgaacctggagcggatcccgtggaacgtgcgcaagctcctgcaggtcagcgagtccacgggggtggccctgaagcggagcagctggctcatcgtgctgctggtcctcctgaccgtgtccctgagccccgtgcagtccgcccccgtcggccacgggaagaccatcgagacctaccagacgcgcgagggcttcaccagcatctgcctcttcatgctgggctccatcctgttcctcgtgagctgcctggtgaaggggctggtcgactccgtgagcgactccttcttccccggcctcagcgtgtgcaagacctgctccatcgggagcatcaacggcttcgagatcgagtcccacaagtgctactgcagcctgttctgctgcccgtactgccggcactgctccgccgaccgcgagatccaccagctgcacctcagcatctgcaagaagcggaagatggggtccaacgtcatgctggccgtgtgcaagcgcatgtgcttccgggcgaccatcgaggccagccgccgcgccctgctcatccggtccatcatcaacacgaccttcgtcatctgcatcctgaccctgaccatctgcgtggtgagcacgagcgccgtcgagatggagaacctcccctccggcacctgggagcgcgaggaggacctgaccaacttctgccaccaggagtgccaggtgaccgagacggagtgcctgtgcccctacgaggccctggtgctccggaagcccctgttcctggacagcatcgtcaagggcatgaagaacctcctgaactccaccaacctggagaccagcctctccatcgaggcgccgtggggcgccatcaacgtgcagagcaccttcaagcccacggtgtccaccgccaacatcgccctgagctggtccagcgtcgagcaccgcgggaacaagatcctggtgaccgggcggtccgagagcatcatgaagctcgaggagcgcaccggcgtgtcctgggacctgggggtcgaggacgccagcgagtccaagctgctcaccgtgagcatcatggacctgtcccagatgtacagccccgtgttcgagtacctgagcggcgaccggcaggtcgaggagtggcccaaggcgacgtgcaccggcgactgcccggagcgctgcgggtgcacctccagcacgtgcctccacaaggagtggccccactcccggaactggcgctgcaaccccacctggtgctgggaggtgggcaccgggtgcacgtgctgcggctggaacgtgaaggacctgttcaccgaccacatgttcgtcaagtggaaggtggagtacatcaagaccgaggccatcgtgtgcgtcgagctgaccagccaggagcggcagtgctccctcatcgaggccggcacccgcttcaacctggggcccgtgaccatcacgctgagcgagccgcggaacatccagcagaagctcccgcccgagatcatcaccctgcaccccaaggtggaggagggcttcttcgacctgatgcacgtccagaaggtgctctccgccagcaccgtgtgcaagctgcagtcctgcacccacgggatccccggcgacctgcaggtctaccacatcgggaacctcctgaagggcgaccgcgtgaacggccacctgatccacaagatcgagccccacttcaacacgagctggatgtcctgggacgggtgcgacctcgactactactgcaacatgggcgactggcccagctgcacctacaccgggatgacccagcacaaccacgccgcgttcgtgaacctgctgaacatcgagacggactacaccaagaccttccacttccactccaagcgggtcaccgcccacggcgacacgccgcagctcgacctgaaggcccgccccacctacggggccggcgagatcaccgtgctggtggaggtcgcggacatggagctccacaccaagaaggtggagatcagcggcctgaagttcgcctccctggcctgcacggggtgctacgcctgcagctccggcatcagctgcaaggtgcggatccacgtcgacgagcccgacgagctcaccgtgcacgtgaagtccaacgaccccgacgtcatcgccgcgagcaccagcctgatggcccgcaagctggagttcgggaccgactccacgttcaaggccttcagcgccatgccgaagacctccctctgcttctacatcgccgagcgggagtactgcaagagctgctccgaggaggacacccagaagtgcgtggacaccaagctggagcagccccagagcatcctgatcgagcacaagggcacgatcatcgggaagcagaacgacacgtgcaccgcgaaggcctcctgctggctcgagagcgtgaagtccttcttctacggcctgaagaacatgctgggcagcgtcttcgggaacttcttcatcggcatcctcctgttcctggcccccttcgtgctcctggtgctgttcttcatgttcgggtggaagatcctcttctgcttcaagtgctgccgccgcacccggggcctgctgaagtaccgcctcctgaaggacgacgaggagaccgggtaccggcgcatcatcgagcggctgaacaacaagaagggcaagaaccgcctcctggacggcgagcggctggccgaccgcaagatcgccgagctgttctccaccaagacccacatcggg

SEQ ID NO: 12096 - RNA, 3495 nt, synthetic construct
  misc_feature 1..3495: note = derived and/or modified CDS sequence (opt1) from CCHVF(CCHVF TADJ/HU8966)__AY179962.1__Gn-NSm-Gc
  source 1..3495: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagaactgcgagatcgactccgtgccggtgaagtgccgccagggctactgcctgaagatcacccaggaggggcggggccacgtcaagctgagccgcgggtccgaggtggtgctcgacgcgtgcgacagctcctgcgaggtcatgatccccaagggcaccggcgacatcagcgtggactgctccgggggccagcagcacttcctgaaggacaacctgatcgacctcgggtgccccaagatccccctgctgggcaagatggccatctacatctgccggatgagcaaccacccgaagaccacgatggccttcctcttctggttctccttcggctacgtgatcacccgcatcctgtgcaaggccatcttctacctgctcatcatcgtcgggaccctgggcaagcggttcaagcagtaccgcgagctgaagccccagacctgcacgatctgcgagaccacccccgccaacgcgatcgacgccgagatgcacgacctcaactgcagctacaacatctgcccctactgcgcctcccggctgaccagcgacgggctggcccgccacgtgacgcagtgcccgaagcggaaggagcgcgtggaggagaccgagctctacctgaacctggagcggatcccctggatcgtccgcaagctcctccaggtgtccgagagcaccggcgtggcgctgaagcggagctcctggctcatcgtcctgctggtcctcttcaccgtgagcctgtcccccgtgcagagcgcccccatcgggtacggcaacacgatcgagacctaccaggcccgcgaggagtacacctccatctgcctgttcgtgctcggcagcatcctgttcatcgtgtcctgcctgatgaaggggctcgtcgacagcatcggcaacatcttcttcccggggctgaccatctgcaagacgtgctccatcggcagcatcaacgggttcgagatcgagtcccacaagtgctactgcagcctgctctgctgcccctactgccggcactgctccgccgaccgcgagatccaccagctgcacctgagcatctgcaagaagcggaagaccggctccaacgtgatgctcgccgtgtgcaagcgcatgtgcttccgcgcgaccatggaggtcagcaacaaggccctgctgatccggtccatcatcaacaccacgttcgtggtctgcatcctcatcctggccgtgtgcatcgtgagcacctccgccgtcgagatggagagcctgcccgccggcacctgggagcgcgaggaggacctcaccaacttctgccaccaggagtgccaggtgacggagaccgagtgcctgtgcccctacgaggcgctggtgctgcggcgccccctcttcctggacagcatcgtcaaggggatgaagaaccccctgaactccaccagcctcgagacctccctgagcatcgaggccccctggggcgccatcaacgtgcagtccacgtacaagcccaccgtgagcaccgccaacatcgccctgtcctggagctccatcgagcaccgggggaacaacatcctcgtcagcggccgctccgagagcatcatgaagctggaggagcggaccgggatctccggcgacctgggcgtggaggacgcgagcgagtccaagctcctgaccgtgagcgtcatggacctgtcccagatgtacagcccggtgttcgagtacctcagcggggaccgccaggtggaggagtggcccaaggccacgtgcaccggcgactgccccgagcggtgcgggtgcacctccagcacgtgcctgcacaaggagtggccccactcccgcaactggcggtgcaacccgacgtggtgctggggcgtcggcaccgggtgcacgtgctgcggcctggacgtgaaggacctcttcatcgactacatgttcgtgaagtggaaggtcgactacatcaagaccgaggccatcgtgtgcgtggagctgaccagccaggagcgccagtgctccctggtcgaggccgggacccggttcaacctcggccccgtgaccatcaccctgagcgagccccgcaacatccagcagaagctgcccccggagatcatcacgctccacccccggatcgaggaggggttcttcgacctgatgcacgtgcagaaggtcctgtccgccagcaccgtgtgcaagctccagtcctgcacccacggcgtgcccggcgacctgcaggtctaccacatcgggaacctgctcaagggcgacaaggagaacgggcacctgatccacaagatcgagccgcacttcaacaccagctggatgtcctgggacggctgcgacctggactactactgcaacatgggggactggcccagctgcacgtacaccggcgtgacccagcacaaccacgcgtccttcgtgaacctcctgaacatcgagaccgactacaccaagagcttccacttccactccaagcgcgtcaccgcccacggcgacaccccgcagctggacctcaaggcccggcccacctacggggccggcgagatcacggtgctggtggaggtcgcggacatggagctgcacaccaagaagatcgagatcaccgggctcaagttcgccagcctgacctgcacgggctgctacgcctgctccagcgggatctcctgcaaggtgcgcatccacgtggacgagccggacgagctgaccgtccacgtcaagagcgacgaccccgacgtggtggccgccagctccagcctcatggcgcggaagctggagttcggcaccgactccaccttcaaggccttcagcgccatgcccaagacgtccctgtgcttctacatcgtggagcgcgagtaccgcaagagctgctccaaggaggacacccagaagtgcgtgaacaccaagctcgagcagccccagagcatcctgatcgagcacaagggcaccatcatcgggaagcagaacaacacgtgcaccgccaaggcctcctgctggctggagagcgtcaagtccttcttctacggcctcaagaacatgctgagcgggatcttcggcaacgtgttcgtggggatcttcctgttcctcgcgccgttcatcctgctgatcctcttcttcatgttcggctggcggatcctgtcctgcttcaagtgctgccgccggacccgcggcctgctcaagcaccggcacctgaaggacgacgaggagaccgggtaccgccggatcatcgagcgcctgaacaacaagaagggcaagaacaagctcctggacggggagcggctggccgaccgccggatcgccgagctgttcagcaccaagacgcacatcggc

SEQ ID NO: 12097 - RNA, 3495 nt, synthetic construct
  misc_feature 1..3495: note = derived and/or modified CDS sequence (opt1) from CCHVF(CCHVF Hodzha)__AY223476.1__Gn-NSm-Gc
  source 1..3495: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcaagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccgaagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcgggcacggcaagacgatcgagacctaccaggcccgggaggactacacctccatctgcctcttcgtcctgggcagcatcctgttcatcgtgtcctgcctcatgaaggggctggtggacagcatcggcaacatcttcttcccggggctgaccatctgcaagacgtgctccatcggcagcatcaacgggttcgagatcgagtcccacaagtgctactgcagcctcctgtgctgcccctactgccgccactgctccgccgaccgggagatccaccagctgcacctcagcatctgcaagaagcgcaagaccggctccaacgtcatgctggcggtgtgcaagcggatgtgcttccgcgccaccatggaggtgagcaacaaggccctgctcatccgctccatcatcaacaccacgttcgtcgtgtgcatcctgatcctggccgtctgcgtggtgagcacctccgccgtcgagatggagagcctccccgcgggcacctgggagcgggaggaggacctgaccaacttctgccaccaggagtgccaggtgacggagaccgagtgcctgtgcccctacgaggccctggtgctccgccggccgctgttcctggacagcatcgtcaaggggaccaagaacctcctgaactccaccagcctggagacgtccctcagcatcgaggccccctggggcgccatcaacgtgcagtccacctacaagcccaccgtgagcaccgccaacatcgcgctgtcctggagctccgtcgagcaccgcgggaacaagatcctggtgagcggccggtccgagagcatcatgaagctcgaggagcgcaccgggatctcctgggacctgggcgtggaggacgccagcgagtccaagctgctcacggtcagcgtgatggacctgtcccagatgtacagccccgtgttcgagtacctgagcggcgaccggcaggtcgaggagtggccgaaggcgacctgcaccggggactgccccgagcgctgcggctgcacctccagcacgtgcctccacaaggagtggccccactcccggaactggcgctgcaaccccacctggtgctggggcgtggggaccggctgcacgtgctgcgggctggacgtgaaggacctgttcaccgactacatgttcgtcaagtggaaggtggactacatcaagaccgaggccatcgtgtgcgtcgagctcaccagccaggagcggcagtgctccctggtggaggccggcacccgcttcaacctggggccggtgacgatcaccctcagcgagccccggaacatccagcagaagctgccgcccgagatcatcaccctgcacccccgcatcgaggagggcttcttcgacctcatgcacgtccagaaggtgctgtccgccagcaccgtgtgcaagctgcagtcctgcacgcacggggtccccggcgacctccaggtgtaccacatcggcaacctgctgaagggggacaaggtgaacggccacctcatccacaagatcgagccccacttcaacaccagctggatgtcctgggacgggtgcgacctggactactactgcaacatgggcgactggccgagctgcacctacaccggggtcacgcagcacaaccacgcctccttcgtgaacctgctcaacatcgagaccgactacaccaagagcttccacttccactccaagcgggtgaccgcccacggcgacacgccccagctggacctgaaggcccgccccacctacggcgcgggggagatcaccgtcctcgtggaggtggccgacatggagctgcacaccaagaagatcgagatcacgggcctgaagttcgccagcctgacctgcaccgggtgctacgcctgctccagcggcatctcctgcaaggtccggatccacgtggacgagcccgacgagctcaccgtgcacgtcaagagcgacgacccggacgtggtggccgcgagctccagcctgatggcccgcaagctcgagttcgggacggactccaccttcaaggccttcagcgccatgcccaagacctccctgtgcttctacatcgtcgagcgggagtactgcaagagctgctccaaggaggacacccagaagtgcgtgaacacgaagctggagcagccccagagcatcctcatcgagcgcaagggcaccatcatcggcaagcagaacaacacgtgcaccgccaaggcgtcctgctggctggagagcgtgaagtccttcttctacgggctgaagaacatgctcagcggcatcttcgggaacgtcttcgtgggcatcttcctgttcctggcccccttcatcctcctgatcctgttcttcatgttcgggtggcgcatcctcttctgcttcaagtgctgccggcgcacccggggcctgttcaagtacaagcacctgaaggacgacgaggagaccggctaccgccggatcatcgagcgcctcaacaacaagaaggggaagaacaagctgctggacggcgagcggctcgccgaccgccggatcgccgagctgttctccaccaagacccacatcggg

SEQ ID NO: 12098 - RNA, 3495 nt, synthetic construct
  misc_feature 1..3495: note = derived and/or modified CDS sequence (opt1) from CCHVF(CCHVF Kosovo/9553/2001)__AY675511.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatcgcccggatgagcaaccaccccaagaccaccatggccttcctgttctggttctccctgggctacgtgatcacgtgcatcctctgcaaggccctgttctacagcctgatcatcatcggcaccctcgggaagaagatcaagcagtaccgcgagctgaagccccagacctgcaccatctgcgagaccgcgcccgtgaacgccatcgacgccgagatgcacgacctgaactgctcctacaacatctgcccgtactgcgccagccggctcacgtccgacggcctggcgcgccacgtcaagcagtgccccaagcggaaggagaaggtggaggagaccgagctgtacctcaacctggagcgcatcccctgggtggtccggaagctgctccaggtgagcgagtccaccggggtggccctgaagcgcagcagctggctgatcgtcctcctggtgctgctcaccgtgtccctgagccccgtccagtccgccccggtgggccacgggaagacgatcgagacctaccagacccgggagggcttcaccagcatctgcctgttcatgctcggctccatcctgttcatcgtgagctgcctggtcaaggggctcgtggactccgtgagcgactccttcttccccggcctgagcgtctgcaagacgtgctccatcgggagcatcaacggcttcgagatcgagtcccacaagtgctactgcagcctgttctgctgcccctactgccgccactgctccgccgaccgggagatccaccagctccacctgagcatctgcaagaagcgcaagaccgggtccaacgtgatgctggccgtctgcaagcggatgtgcttccgcgcgaccatcgaggccagccggcgcgccctcctgatccgctccatcatcaacaccacgttcgtgatctgcatcctgaccctcaccatctgcgtggccagcaccagcgccgtcgagatggagacgctgcccgcggccacctgggagcgggaggaggacctgaccaacttctgccaccaggagtgccaggtgccggagaccgagtgcctgtgcccctacgaggccctcgtgctgcgcaagcccctgttcctcgactccatcgtcaagggcatgaagaacctgctgaacagcacgtccctcgagaccagcctgtccatcgaggccccctggggcgccatcaacgtgcagagcaccttcaagccgaccgtgtccaccgcgaacatcgccctgagctggtccagcgtcgagcaccgggggaacaagatcctcgtgacgggccgctccgagagcatcatgaagctggaggagcggaccggggtgtcctgggacctgggcgtcgaggacgccagcgagtccaagctcctgaccgtgagcatcatggacctgtcccagatgtacagccccgtgttcgagtacctcagcggggaccgccaggtcgaggagtggcccaaggcgacctgcacgggcgactgccccgagcggtgcggctgcacctccagcacgtgcctgcacaaggagtggccgcactcccgcaactggcggtgcaaccccacctggtgctggggcgtggggaccgggtgcacgtgctgcggcgtggacgtcaaggacctgttcaccgaccacatgttcgtgaagtggaaggtggagtacatcaagaccgaggccatcgtctgcgtggagctcaccagccaggagcgccagtgctccctgatcgaggccggcacccggttcaacctggggcccgtgaccatcaccctcagcgagccccgcaacatccagcagaagctgccgcccgagatcatcacgctgcaccccaagatcgaggagggcttcttcgacctcatgcacgtccagaaggtgctgtccgccagcaccgtgtgcaagctgcagtcctgcacccacgggatcccgggcgacctccaggtctaccacatcgggaacctgctgaagggcgaccgggtgaacggccacctcatccacaagatcgagccccacttcaacaccagctggatgtcctgggacgggtgcgacctggactactactgcaacatgggcgactggcccagctgcacgtacaccggggtgacccagcacaaccacgccgccttcgtcaacctgctcaacatcgagaccgactacacgaagaccttccacttccactccaagcgcgtgaccgcgcacggcgacacgccccagctggacctgaaggcccggccgacctacggggccggcgagatcaccgtgctcgtcgaggtggccgacatggagctgcacaccaagaaggtggagatcagcggcctgaagttcgcctccctcgcgtgcaccgggtgctacgcctgcagctccggcatcagctgcaaggtccgcatccacgtggacgagcccgacgagctgacggtgcacgtcaagtccagcgaccccgacgtggtggccgccagcacctccctgatggcccggaagctcgagttcgggaccgacagcaccttcaaggcgttctccgccatgcccaagacgagcctgtgcttctacatcgtcgagaaggagtactgcaagtcctgcagcgaggacgacaccaagaagtgcgtggacaccaagctggagcagccgcagtccatcctcatcgagcaccgcggcaccatcatcgggaagcccaacgacacgtgccccgccaagaccagctgctggctggagtccgtcaagagcttcttctacggcctgaagaacatgctcggctccgtgttcgggaacttcttcatcggcatcctgctgttcctcgcccccttcttcctgtggatgctgagcttcatgttcgggtggaagatcctcttctgcttcaagtgctgccggcgcacccgcggcctgttcaagtaccggcacctgaaggacgacgaggagaccgggtaccgccggatcatcgagcgcctcaacaacaagaagggcaagaaccggctgctggacggcgagcgcctcgccgaccggaagatcgcggagctgttctccaccaagacgcacatcggg

SEQ ID NO: 12099 - RNA, 3495 nt, synthetic construct
  misc_feature 1..3495: note = derived and/or modified CDS sequence (opt1) from CCHVF(CCHVF SPU41/84)__AY900142.1__Gn-NSm-Gc
  source 1..3495: mol_type = other RNA
agcgaggagtccagcgacgactgcatctcccgcacccagctgctccggaccgagacggccgagatccacggcgacaactacgggggccccggggacaagatcaccatctgcaacggcagcaccgtggtcgaccagcgcctggggtccgagctgggctgctacaccatcaaccgggtgaagacgttcaagctctgcgagaacagcgccaccggcaagtcctgcgagatcgacagcgtgccggtcaagtgccgccaggggtactgcctgaagatcacccaggagggccgggggcacgtgaagctgtcccgcggcagcgaggtggtcctcgacgcgtgcgacacctcctgcgaggtgatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtcatcacgtgcatcatctgcaaggtgatcttctacctgctcatcatcgtgggcaccctggggaagcgcttcaagcagtaccgggagctgaagccccagacctgcaccatctgcgagaccacgcccgtcaacgccatcgacgccgagatgcacgacctcaactgctcctacaacatctgcccctactgcgcgagccgcctgacctccgacggcctggcccggcacgtgacccagtgcccgaagcgcaaggagaaggtggaggagaccgagctctacctgaacctggagcggatcccctgggtcgtgcgcaagctcctccaggtgagcgagtccacgggggtcgccctgaagcggagcagctggctcgtggtgctgctggtcctcctgaccgtgtccctgagccccgtgcagtccgcccccatcagccacggcaagaccgtcgaggcgtaccgcgcccgggaggggtacacctccatgtgcctcttcgtgctgggcagcgtcctgttcctcgtgtcctgcctgatgaagggcctggtggacagcgtcgggaacacgttcttcccgggcctctccatctgcaagacctgcagcatctccagcatcaacgggttcgagatcgagtcccaccgctgctactgcagcctgttctgctgcccctactgccggcactgctccgccaacaaggagatccaccagctgcacctcagcatctgcaagaagcgcaaggccggctccaacgtgatgctggccgtgtgcaagcggatgtgcttccgcgcgaccatggaggtcagcaaccgcgccctgttcatccggtccatcatcaacaccacgttcgtgctctgcatcctgatcctggccgcctgcgtggtcagcaccagcgccgtggagatggagtccctccccgcggggacctgggagcgcgaggaggacctgaccaacttctgccaccaggagtgccaggtggccgacacggagtgcctgtgcccctacgaggccctggtcctccggcgcccgctgttcctggacagcatcgtgaagggcatgaagaacctcctgaactccaccagcctggagacctccctcagcatcgaggccccctggggcgccatcaacgtgcagtccacctacaagcccacggtcagcaccgcgaacatcgccctgtcctggagctccgtggagcaccgggggaacaagatcctggtgagcggccgctccgagagcatcatgaagctcgaggagcggaccgggatctcctgggacctgggcgtcgaggacgccagcgagtccaagctgctcaccgtgagcgtgatggacctgagccagatgtactcccccgtcttcgagtacctgagcggggaccgccaggtggaggagtggccgaaggcgacctgcacgggcgactgccccgagcggtgcggctgcacctccagcacgtgcctccacaaggagtggccccactcccgcaactggcggtgcaaccccacctggtgctggggcgtggggaccgggtgcacgtgctgcggcctggacgtcaaggacctgttcaccgactacatgttcgtgaagtggaaggtggagtacatcaagaccgaggccatcgtctgcgtggagctcaccagccaggagcgccagtgctccctgatcgaggccggcacccggttcaacctggggccggtgaccatcaccctcagcgagccccgcaacatccagcagaagctgccgcccgagatcatcacgctgcacccccggatcgaggagggcttcttcgacctcatgcacgtccagaaggtgctgtccgccagcaccgtgtgcaagctgcagtcctgcacccacggggtccccggcgacctccaggtgtaccacatcgggaacctgctgaagggcgacaaggtgaacggccacctcgtccacaagatcgagccccacttcaacaccagctggatgtcctgggacgggtgcgacctggactactactgcaacatgggcgactggccgagctgcacgtacaccggggtgacccagcacaaccacgcctccttcgtgaacatgctgaacatcgagaccgactacacgaagaacttccacttccacagcaagcgcgtcaccgcccacggcgacacgccccagctcgacctgaaggcgcggcccacctacggggccggcgagatcaccgtgctggtggaggtcgccgacatggagctccacaccaagaagatcgagatctccggcctgaagttcaccagcctgacctgcacggggtgctacgcctgctccagcggcatcagctgcaaggtgcgcatccacgtggacgagcccgacgagctcaccgtccacgtgaagtccgaggacccggacgtggtcgccgcgagctccagcctgatggcccggaagctggagttcgggaccgactccaccttcaaggccttcagcgccatgcccaagacgtccctctgcttctacatcgtggagcgcgagtactgcaagagctgctccgaggaggacacccagaagtgcgtgaacaccaagctggagcagccccagagcatcctgatcgagcgcaagggcaccatcatcgggaagcagaacaacacgtgcaaggccaaggcgggctgctggctcgagtccgtcaagagcttcttctacggcctgaagaacatgctgtccgggatcttcggcaacgtgttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggggagcgcctggccgaccggcgcatcgccgagctgttcagcaccaagacccacatcggc

SEQ ID NO: 12100 - RNA, 3495 nt, synthetic construct
  misc_feature 1..3495: note = derived and/or modified CDS sequence (opt1) from CCHVF(CCHVF UG3010)__AY900143.1__Gn-NSm-Gc
  source 1..3495: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcatcgtgtgcaaggtgctgttctacctcctgatcgtcatcggcaccctgagcaagaagctcaagcagtaccgcgagctgaagccccagacctgcatcgtgtgcgagtccacccccgtgaacgccatcgacgccgagatgcacgagctgaactgcaactacaacatctgcccctactgcgcgagccggctcacctccgacgggctggtccgccacgtgaaccagtgcccgaagcggaaggagaaggtggaggagacggagctgtacctcaacctggagcgcatcccctggctggtccggcgcctcctccaggtgagcgagtccaccggcatggccctgaagcggagctgctggatgaccaccctcctgatcctgctcgtggtctccctgagccccgtgcagagcgcccccgtcgggcagggcaaggccgtggaggtgtaccgcgtccgggagtcctacacgagcatctgcctgttcgtgctcgggtccgtgctgttcgcggtcagctggctgatcaagggcctcatcgacggcatcgggaactccttcttcccgggcctgagcgtgtgcaagacctgctccatcgggagcatcaacggcttcgagatcgagtcccacaagtgctactgcagcctgttctgctgcccctactgccgcgcctgctccagcgacaagatcacccaccggatgcacctcaacgtgtgcaagaagcgcaaggccgggtccaacgtcatgctggccgtgtgcaagcggatgtgcttcaaggccaccgtggaggcgagcaacacggccctgctcatccgcggcatcatcaactccaccttcgtcatctgcgtgctgatcctggtgatctgcgtcgtgagcacctccgccgtggacatggagaacctccccgccggcatctgggagcgggaggaggacctgaccaacttctgccaccaggagtgccaggtcacggagaccgagtgcctgtgcccctacgaggccctgatcctccgcaagccgctgtacctggacagcatcgcgaaggggatgaagtccctcctgaacagcaccaacctggagaccagcctctccatcgaggccccctggggcgccatcaacgtgcagagcacgttcaagcccaccgtgtccgccgccaacatcgcgctgagctggtccagcgtcgagcaccgcgggaacaagatcctggtgtccggccggagcgagtccatcatgaagctcgaggagcgcaccgggatcagctggtccctgggcgtggaggacgccagcgagtccaagaccctgacggtcagcgtgatggacctctcccagatgtacagccccgtgttcgagtacctgtccggcgaccggcaggtcgaggagtggccgaaggcgacctgcaccggggactgccaggagcgctgcggctgcaccagcagcacgtgcctgcacaaggagtggccccactcccggaactggcgctgcaaccccacctggtgctggggcgtggggaccggctgcacgtgctgcgggctcgacgtgcgggacctgttcaccgactacatgatggtcaagtggaaggtggagtacgtgaagaccgaggccatcatgtgcgtcgagctgaccagccaggagcgccagtgctccctcatcgaggccggcacccggttcaacctggggcccgtgaccatcacgctgagcgagccgcgcaacatccagcagcggctcccctccgagatcgtgaccctgcaccccaagatcgaggagggcttcttcgacctgatgcacgtccagaaggtgctcagcgcctccaccgtgtgcaagctgcagagctgcacccacggggtccccggcgacctccaggtgtaccacgtgggcaacctgctgaagggggacaaggtcaacggccactccatccacaagatcgagagccacttcaacacgtcctggatgagctgggacgggtgcgacctggactacttctgcaacatgggcgactggccgtcctgcacctacaccggggtgacccagcacaaccgcgccgccttcatcaacatgctcaacatcgagacggactacaccaagaccttccacttccacagcaagcgggtgaccgcccacggcgacacgccccagctggacctgaaggcgcgccccacctacggcgccggggaggtcaccgtgctcgtggaggtcgccgacctggagctgcacaccaagaagatcgaggtgtccggcctcaagttcgccagcctgacgtgctccgggtgctacgcctgcagctccggcatcagctgcaaggtgcggatccacgtcaacgagccggacgagttcaccgtgcacgtcaagagctccgaccccgacgtggtggcggccgggagctccctgatggcccgcaagatcgagttcggcgccgacagcaccttcaaggccttctccagcatgcccaagaactccctctgcttctacatcgtcgagcgggactactgcagctcctgcaccaacgacgacacgcagaagtgcgtggacaccaagctggagcacccccagagcatcctgatcgagcacaagggcaccatcatcgggaagcagaacgacacgtgctccaccaagaccagctgctggctcgagtccgtcaagagcttcttctacggcctgaagaacatgctcgggggcatcttcgggaacgtgttcctgggcatcttcctgttcctggcgccgttcgccctcctgatcttcttcttcttcttcggctggcgcctgctgttctgcctgaagtgctgccggcgcacccgcgggctgctcaagtacaagcagctgaaggacgaggaggaggccggctacaagaagatcatcgagcggctgaacgacaagaaggggaagtcccgcctcttcgacggcgagcggctggccgaccgcaagatcgccgagctgttcagcaccaagacgcacatcggc

SEQ ID NO: 12101 - RNA, 3495 nt, synthetic construct
  misc_feature 1..3495: note = derived and/or modified CDS sequence (opt1) from CCHVF(CCHVF Hy13)__AY900145.1__Gn-NSm-Gc
  source 1..3495: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacgtgcatcctgtgcaaggtcatcttctacctgctcatcgtggtgggcaccctggggaagaagttcaagcagtaccgcgagctgaagccccagacctgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctccaggtgagcgagtccaccggggtcgccctgaagcgcagctcctggctcgtggtgctgctggtcctcctgaccgtgagcctgtcccccgtgcagagcgcccccatcggccacgggaagacggtcgagacctaccagacccgggagggctacacctccatctgcctcttcgtgctgggcagcatcctgttcatcgtgtcctgcctcatgaaggggctggtcgacagcgtgggcaactccttcttcccggggagctccatctgcaagacgtgcagcatcggctccatcaacgggttcgagatcgagagccacaagtgctactgctccctgttctgctgcccctactgccgccactgcagcgcggaccgggagatccacaagctccacctgtccatctgcaagaagcgcaagaccggcagcaacgtcatgctggccgtgtgcaagcggatgtgcttccgcgccaccgtggaggtcagcaacaaggccctcctgatccggaacatcatcaacaccacgttcgtggtgtgcatcctgatcctcgccgtctgcgtggtgtccaccagcgcggtcgagatggagtccctgcccgccggcacctgggagcgcgaggaggacctgaccaacttctgccaccaggagtgccaggccacggagaccgagtgcctctgcccctacgaggccctggtgctgcgcaagccgctgttcagcgactccatcgtgaaggggatgaagaacctcctgaacagcacctccctggagaccagcctctccatcgaggccccctggggcgcgatcaacgtccagagcacgttcaagcccaccgtgtccgccgccaacatcgccctgagctggtccagcgtggagcaccgggggaacaagatcctggtctccggccgcagcgagtccatcatgaagctcgaggagcggaccgggatcagctgggacctgggcgtggaggacgccagcgagtccaagctgctcaccgtgagcatcatggacctgtcccagatgtacagccccgtcttcgagtacctgtccggcgaccgccaggtggaggagtggccgaaggcgacctgcacgggggactgccccgagcggtgcggctgcaccagctccacgtgcctccacaaggagtggccccacagccgcaactggcggtgcaaccccacctggtgctggggcgtggggaccggctgcacgtgctgcgggctggacgtcaaggacctgttcaccgaccacatgttcgtgaagtggaaggtggagtacatcaagaccgaggccatcgtctgcgtggagctcacctcccaggagcgccagtgcagcctgatcgaggccggcacccggttcaacctggggccggtgaccatcaccctctccgagccccgcaacatccagcagaagctgccgcccgagatcgtcacgctgcacccccggatcgaggagggcttcttcgacctcatgcacgtgaagaaggtgctgagcgcctccaccgtctgcaagctgcagagctgcacccacggggtgcccggcgacctccaggtgtaccacatcggcaacctgctgaagggggacaaggtcaacggccacctcatccacaagatcgagccccacttcaacacctcctggatgagctgggacgggtgcgacctggactactactgcaacatgggcgactggccgtcctgcagctacacgggggtgacccagcacaaccacgccgcgttcgtgaacatgctgaacatcgagaccgactacaccaagatcttccacttccactccaagcgcgtcacggcccacggcgacacgccccagctcgacctgaaggcccggcccacctacggcgccggggagatcaccgtgctggtggaggtcgcggacatggagctccacaccaagaagatcgagatcagcggcctgaagttcgccagcctgacctgcaccgggtgctacgcctgctccagcggcatctcctgcaaggtgcgcatccacgtggacgagcccgacgagctcaccgtccacgtcaagagcgaggacccggacatcgtggccgcctccagctccctgatggcgcggaagctggagttcgggacggacagcaccttcaaggccttctccgccatgcccaagaccagcctctgcttctacatcgtggagcgcgagtactgcaagtcctgcagcaaggaggacacccagaagtgcgtgaacacgaagctggagcagccccagtccatcctgatcgagcacaagggcaccatcatcggcaagcagaacgacacgtgcaccagcaaggccgggtgctggctcgagtccgtcaagagcttcttctacggcctgaagaacatgctgtccgggatcttcggcaacgtgttcatcgggatcttcctcttcctggcccccttcatcctgctcatcctgttcttcatgttcggctggcggatcctgttctgcttcaagtgctgccgccggacccgcggcctcttcaagtaccgccacctgaaggacgacgaggagaccgggtaccggaagatcatcgagcgcctgaacaacaagaagggcaagaacaagctcctggacggggagcggctggcggaccgcaagatcgccgagctgttcagcaccaagacccacatcggc

SEQ ID NO: 12102 - RNA, 3495 nt, synthetic construct
  misc_feature 1..3495: note = derived and/or modified CDS sequence (opt1) from CCHVF(CCHVF Semunya)__DQ094832.1__Gn-NSm-Gc
  source 1..3495: mol_type = other RNA
gccgagggcgtgagcaacgactgcgtgtcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgccatcgacgccgagatgcacgagctgaactgcaactacaacatctgcccctactgcgcgtcccggctcaccagcgacggcctggtgcgccacgtgacccagtgcccgaagcggaaggagaaggtcgaggagacggagctgtacctcaacctggagcgcatcccctggctggtgcggcgcctcctccaggtgtccgagagcaccgggatggccctgaagcggtcctgctggatgaccaccctcctgatcctgctcgtcgtgagcctgtcccccgtccagagcgcccccgtgggccaggagaaggccatcgaggtgtaccaggtccgcgagagctacacgtccatctgcctgttcgtgctcgggagcgtgctgttcgcggtctcctggctggtgaagggcctcatcgacggcatcgggaacagcttcttcccgggcctgtccgtgtgcaagacctgcagcatcgggtccatcaacggcttcgagatcgagagccacaagtgctactgctccctgttctgctgcccctactgccgggcctgcagctccgacaagatcacccaccgcatgcacctcaacatctgcaagcggcgcaaggtcgggagcaacgtgatgctggccgtgtgcaagcggatgtgcttcaaggccaccgtcgaggcctccaacagcgcgctgctcatccgctccatcatcaacagcacgttcgtgatctgcgtgctgatcctggtcatctgcgtggtgtccaccagcgccgtcgacatggagaacctccccgccggcatctgggagcgggaggaggacctgaccaacttctgccaccaggagtgccaggtgaccgagacggagtgcctgtgcccctacgaggccctgatcctccgcaagccgctgttcctggactccatcgccaagggcaagaagtccctcctgaacagcaccaacctggagaccagcctcagcatcgaggcgccctggggcgccatcaacgtgcagtccaccttcaagcccacggtcagcgccgccaacatcgccctgtcctggagctccgtggagcaccgcgggaacaagatcctggtgagcgggcggtccgagagcatcatgaagctcgaggagcgcaccggcatctcctggagcctgggggtcgaggacgcgtccgagagcaagaccctgaccgtgtccgtgatggacctcagccagatgtactcccccgtcttcgagtacctgagcggcgaccgccaggtggaggagtggccgaaggccacgtgcaccggcgactgccccgagcggtgcgggtgcaccagctccacgtgcctgcacaaggagtggccccacagccggaactggcgctgcaaccccacctggtgctggggcgtggggaccggctgcacgtgctgcggcctcgacgtccgggacctgttcaccgactacatgatggtgaagtggaaggtggagtacgtcaagaccgaggccatcatgtgcgtggagctgacctcccaggagcgccagtgcagcctcatcgaggccgggacccggttcaacctgggcccggtgaccatcaccctgtccgagccccgcaacgtccagcagcggctccccagcgagatcgtgacgctgcaccccaagatcgaggaggggttcttcgacctgatgcacgtgcagaaggtcctcttctgcaagtactccctgcaggccaccagctgcacccacggcgtgccgggggacctccaggtgtaccacgtcggcaacctgctgaagggcgacaaggtgaacgggcactccatccacaagatcgagagccacttcaacacctcctggatgagctgggacggctgcgacctggactacttctgcaacatgggggactggccctcctgcacgtacaccggcgtgacccagcacaaccgcgcggccttcgtcaacatgctcaacatcgagaccgactacacgaagaccttccacttccacagcaagcgggtgaccgcccacggggacacgccccagctggacctgaaggcccgcccgacctacggcgcgggcgaggtgaccgtcctcgtggaggtggccgacctggagctgcacaccaagaagatcgaggtctccgggctcaagttcgccagcctgacctgctccggctgctacgcctgcagctccgggatcagctgcaaggtgcggatccacgtcaacgagcccgacgagttcacggtgcacgtcaagagcaacgaccccgacgtggtggccgcgggctccagcctgatggcccgcaagatcgagttcggggccgactccaccttcaaggccttcagctccatgcccaagaacagcctctgcttctacatcgtggagcgggactactgctccagctgcaccgacgacgacacccagaagtgcgtcaacatcaagctggagcacccgcagtccatcctgatcgagcacaagggcacgatcatcggcaagcagaacgacacgtgccccaccaagaccagctgctggctcgagtccgtcaagagcttcttctacgggctgaagaacatgctgggcgggatcttcggcaacgtgttcctcgggatcttcctgttcctggcccccttcgcgctcctgatcctgttcttcttcttcggctggcgcctcctgttctgcctgaagtgctgccggcgcacccgcggcctcctgaagtacaagcagctgaaggacgaggaggaggccgggtacaagaagatcatcgagcggctcaacgacaagaagggcaagtcccgcctgttcgacggggagcggctggccgaccgcaagatcgccaagctgttcagcaccaagacccacatcggc

SEQ ID NO: 12103 - RNA, 3495 nt, synthetic construct
  misc_feature 1..3495: note = derived and/or modified CDS sequence (opt1) from CCHVF(CCHVF SPU128/81/7)__DQ157174.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgagagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctcaagcgcagcagctggctgatcgtcctgctcgtgctgttcacggtgtccctgagccccgtccagtccgcgccgatcggccacgggaagaccatcgaggcctaccgggcccgcgagggctacaccagcatctgcctcttcgtgctgggctccatcctgttcatcgtgagctgcctcatgaaggggctggtcgactccgtgggcaacagcttcttccccgggctgtccatctgcaagacctgcagcatctccagcatcaacggcttcgagatcgagtcccacaagtgctactgcagcctcttctgctgcccctactgccggcactgctccgccgacaaggagatccacaagctgcacctgagcatctgcaagaagcgcaagacggggtccaacgtgatgctcgccgtctgcaagcggatgtgcttccgcgcgaccatggaggtgagcaaccgcgccctgttcatccggtccatcatcaacaccaccttcgtcctgtgcatcctcatcctggccgtgtgcgtggtcagcacgagcgccgtggagatggagaacctgcccgccggcacctgggagcgcgaggaggacctcaccaacttctgccaccaggagtgccaggtgaccgagacggagtgcctgtgcccgtacgaggcgctggtcctgcggaagcccctcttcctggactccatcgtgaagggcatgaagaacctgctcaacagcacctccctggagaccagcctgtccatcgaggccccctggggcgccatcaacgtgcagagcacctacaagcccacggtctccaccgccaacatcgccctcagctggtccagcgtggagcaccgcgggaacaagatcctggtgtccgggcggagcgagtccatcatgaagctggaggagcgcaccggcatcagctgggacctcggggtcgaggacgcgtccgagagcaagctgctgaccgtgtccgtgatggacctcagccagatgtacagcccggtcttcgagtacctgtccggcgaccgccaggtggaggagtggcccaaggcgacctgcacgggcgactgccccgagcggtgcgggtgcaccagctccacgtgcctgcacaaggagtggccccacagccggaactggcgctgcaacccgacctggtgctggggcgtggggaccggctgcacgtgctgcggcctcgacgtcaaggacctgttcaccgactacatgttcgtgaagtggaaggtggagtacatcaagaccgaggccatcgtctgcgtggagctgacctcccaggagcggcagtgcagcctcatcgaggccgggacccgcttcaacctgggccccgtgaccatcaccctgtccgagccccggaacatccagcagaagctgcccccggagatcatcacgctgcacccccgcatcgaggaggggttcttcgacctgatgcacgtccagaaggtgctcagcgcctccaccgtgtgcaagctgcagagctgcacccacggcgtccccggggacctccaggtgtaccacatcggcaacctgctgaagggcgacaaggtgaacgggcacctgatccacaagatcgagccgcacttcaacacctcctggatgagctgggacggctgcgacctcgactactactgcaacatgggggactggccctcctgcacgtacaccggcgtcacccagcacaaccacgccagcttcgtgaacctgctgaacatcgagaccgactacacgaagaacttccacttccactccaagcgggtgaccgcccacggggacacgccccagctcgacctgaaggcccgccccacctacggcgccggcgagatcaccgtcctggtggaggtggcggacatggagctccacaccaagaagatcgagatcagcgggctgaagttcgcctccctgacctgcaccggctgctacgcctgcagctccgggatcagctgcaaggtccggatccacgtggacgagccggacgagctcacggtgcacgtcaagagcgacgaccccgacgtggtggccgcctccagctccctgatggcgcgcaagctggagttcggcaccgacagcaccttcaaggccttctccgccatgcccaagaccagcctctgcttctacatcgtcgagcgggagcactgcaagtcctgcagcgaggaggacacgaagaagtgcgtgaacaccaagctggagcagccccagtccatcctgatcgagcacaaggggaccatcatcggcaagcagaacagcacgtgcaccgccaaggcctcctgctggctcgagagcgtgaagtccttcttctacggcctgaagaacatgctgagcgggatcttcggcaacgtcttcatcgggatcttcctcttcctgggcccgttcatcctgctcatcctgttcttcatgttcgggtggcgcatcctgttctgcttcaagtgctgccgccggacccgcggcctcctgaagtaccggcacctgaaggaggacgaggagaccggctaccgccggatcatcgagcgcctcaacaacaagaaggggaagaacaagctgctggacggcgagcggctcgcggaccgccggatcgccgagctgttctccaccaagacccacatcggg

SEQ ID NO: 12104 - RNA, 3495 nt, synthetic construct
  misc_feature 1..3495: note = derived and/or modified CDS sequence (opt1) from CCHVF(CCHVF ROS/HUVLV-100)__DQ206448.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagaccgggtccaacgtcatgctggccgtgtgcaagcgcatgtgcttccgggccaccatcgaggcgagccgccgcgccctgctcatccggtccatcatcaacaccacgttcgtcatctgcatcctgaccctgaccatctgcgtggtgagcaccagcgccgtcgagatggagaacctcccgtccggcacgtgggagcgcgaggaggacctgaccaacttctgccaccaggagtgccaggtgaccgagaccgagtgcctgtgcccctacgaggccctggtgctccggaagcccctgttcctggacagcatcgtcaagggcatgaagaacctcctgaactccacgagcctggagacctccctcagcatcgaggccccctggggcgcgatcaacgtgcagtccaccttcaagccgaccgtgagcaccgccaacatcgccctgtcctggagctccgtcgagcaccgcgggaacaagatcctggtgacggggcggagcgagtccatcatgaagctcgaggagcgcaccggcgtgagctgggacctgggggtcgaggacgcctccgagagcaagctgctcaccgtgtccatcatggacctgagccagatgtacagccccgtgttcgagtacctgtccggcgaccggcaggtcgaggagtggcccaaggcgacctgcacgggcgactgccccgagcgctgcgggtgcaccagctccacgtgcctccacaaggagtggccgcacagccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgacctcccaggagcggcagtgcagcctcatcgaggccgggacccgcttcaacctgggccccgtgaccatcaccctgtccgagccccggaacatccagcagaagctcccgcccgagatcatcacgctgcaccccaaggtcgaggaggggttcttcgacctgatgcacgtgcagaaggtgctcagcgcctccaccgtctgcaagctgcagagctgcacccacggcatcccgggggacctccaggtgtaccacatcggcaacctcctgaagggcgaccgcgtgaacgggcacctgatccacaagatcgagccccacttcaacacctcctggatgagctgggacggctgcgacctcgactactactgcaacatgggggactggccctcctgcacgtacaccggcgtcacccagcacaaccacgccgccttcgtgaacctgctgaacatcgagaccgactacacgaagaccttccacttccacagcaagcgggtgaccgcgcacggggacacgccccagctcgacctgaaggcccgcccgacctacggcgccggcgagatcaccgtcctggtggaggtggccgacatggagctccacaccaagaaggtcgagatctccgggctgaagttcgcgagcctggcctgcaccggctgctacgcctgctccagcgggatctcctgcaaggtgcggatccacgtggacgagcccgacgagctcacggtccacgtcaagagcagcgaccccgacgtggtggccgcctccaccagcctgatggcgcgcaagctggagttcggcaccgactccaccttcaaggccttcagcgccatgcccaagacgtccctctgcttctacatcgtggagcgggagtactgcaagagctgctccgaggaggacacccagaagtgcgtggacaccaagctggagcagccgcagagcatcctgatcgagcacaaggggaccatcatcggcaagcagaacgacacgtgcaccgccaaggcctcctgctggctcgagagcgtcaagtccttcttctacggcctgaagaacatgctggggagcgtgttcggcaacttcttcatcgggatcctcctgttcctggcgcccttcgtgctcctggtcctgttcttcatgttcggctggaagatcctcttctgcttcaagtgctgccgccgcacccgggggctgctgaagtaccgcctcctgaaggacgacgaggagaccggctaccggcgcatcatcgagcggctgaacaacaagaagggcaagaaccgcctcctggacggggagcggctggccgaccgcaagatcgccgagctgttctccaccaagacgcacatcggc

SEQ ID NO: 12105 - RNA, 3495 nt, synthetic construct
  misc_feature 1..3495: note = derived and/or modified CDS sequence (opt1) from CCHVF(CCHVF AP92)__DQ211625.1__Gn-NSm-Gc
  source 1..3495: mol_type = other RNA
agcgagggcggggacggcgggtgcatctcccgcacccagctgatcaagaccgagacggccgaggtgcacggcgacgactacgggggccccggcgagaagatcaccatctgcaacgggagcaccatcgtcgaccagcggctcggctccgagctggggtgctacaccatcaaccgcatcaagagcttcaagctgtgcgagaactccgcccagggcaagaactgcgagatcgacagcgcgccggtgcagtgccggcaggggtactgcctcaagatctcccaggagggccgcggccacgtgaagctgagccgggggtccgagatcgtcctggacgtgtgcgacacgagctgcgagatcatgatccccaagggcaccggggacatcctcgtggactgctccggcggccagcagcacttcctgcagagcaacctggtcgacctcgggtgccccaacatccccctgctgggcaagatggccatctacatctgccgcatgtccaaccacccgaagaccaccatggccttcctcttctggttcagcttcgggtacgtgatcacgtgcatcctgtgcaagaccctgttctacatcctcatcatcatcggcaccctggggaagaagctgaagcagtaccgggagctcaagccccagacctgcacgatctgcgagtccgtgcccgtcaacgccatcgacgccgagatgcacgacctgaactgcagctacaacatctgcccctactgcgcgtcccgcctgaccagcgagggcctcacccggcacgtgaaccagtgcccgaagcgcaaggagaaggtggaggagaccgagctgtacctgaacctcgagcggatcccctggatcgtccgcaagctgctgcaggtgtccgagagcacgggcgtggccctcaagcggagctcctggatgatcgtcctgctgatcctcctgatcgtgagcatgtcccccgtgcagagcgcccccatctcccaggagcgcaccgtcgccctgtaccagagccgggaggactacatggggatctgcctcgtgatcatgggctccgtgctgctggcggtcagcctcctggtgcgcgggctgatcgactccatcagctccaccttcttcccgggcctcagcgtgtgccggacctgccacatcgggtccatcaacggcttcgagatcgagagccacaagtgctactgcggcctgctgtgctgcccctactgccgcgcctgctccacggaccaggacgcccaccagttccacctcagcgtctgcaagaagcggaaggccgggtccaacgtgatgctggccgtctgcaagcgcatgtgcttcaaggcgatcatcgaggccagcaacaaggtgctgttcatccggaacgtgatcaacaccaccttcgtcgtgtgcatcctcgtgatggtcgcctgcatcgcctccagcgccgcggtggagatggagaacctgcccgccggcacctgggagcgcgaggaggagctgacgaacttctgccaccaggagtgccaggtgaccgagaccgagtgcctctgcccctacgagagcttcatcctgcgcaagccgctgttcctggactccatcgccaagggggtcaagaacctcctgaacagcacctccctggagacgagcctctccatcgaggccccctggggcgccatcaacgcgcagagcacctacaagcccaccgcctccagcgccaacatcgccctgacctggtccagcgtggagcaccgggggaacaagatcctggtgtccggccgcagcgagtccatcatgaagctcgaggagcggacgggcatcagctggaacctgggggtcgaggacgcctccgagagccgcaccctgaccatctccgtgatggacctcagccagatgtacagccccgtgttcgagtacctgtccggcgaccggcaggtcgaggagtggccgaaggcgacctgcacggggaactgccccgagcgctgcggctgcaccagctccacctgcctgtacaaggagtggccccacagccggaactggcgctgcaaccccacctggtgctggggcgtggggaccggctgcacgtgctgcgggctcgacgtgaaggagctgttcaccgaccacatgctggtcaagtggaaggtggagtacatcaagaccgaggccatcgtgtgcgtcgagctcacctcccaggagcggcagtgcagcctgatcgaggccggcacgcgcttctccctggggccggtgaccatcaccctcagcgagccccggaacatccagcagaagctgccccccgagctgatcaccctccacccgaagatcgaggacggctacttcgacctgatgcacgtgcagaaggtcatgtccgccagcacggtgtgcaagctgcagtcctgcacccacggcgtgcccggggacctccagatctaccacgtcggcaacctgctgaagggggaccgcgtgaacggccacctcatccacaaggtggagccccacctgaacaccagctggatgtcctgggacgggtgcgacctggactacttctgcaacatgggcgactggccgagctgcacctacacgggcgtcacccagcacaaccacgcggccttcgccaacctcctgaacatcgagaccgactacaccaagacgttccacttccactccaagcgggtgaccgcccacggggacaccccccagctggacctcaaggcccgcccccggtacggcgcgggggagatcaccgtgctggtcgaggtggccgacatggagctgcacacgaagaaggtggaggtcaccggcctcaagttcgccagcctgacctgctccgggtgctacgcctgcagctccggcatcagctgcaaggtgcgcatccacgtggacgagcccgacgagctgaccgtccacgtgaagagctccgacccggacatcgtggccgcgagctccagcctcatggcccggaagatcgagttcggcgtcgactccacgttcaaggccttcagctccatgcccaaggacagcctgtgcttctacatcgtggagcgcgactactgcaactcctgcaagaacgaggagacccagcggtgcgtgaacgccaagctggagcagccccagagcatcctcatcgagcacaccgggaccatcatcggcaagcagaacgacacgtgcgggtcccgcaccagctgctggctggactccttcaagagcttcttctacggcctgaagtccatgctcagcgggatcttcggcaacgtcttcctgggcatcttcctgttcctcgcccccttcgcgctgctgctcttcttcttcttcttcgggtggcgcatcctgttctgcttcaagtgctgccggcgcacccggggcctgttcaagtaccgccacatcaaggacgacgaggaggtggggtacaagaagatcatcgagcggctcaacaacaagaagggcaagcaccgcctgctggacggcgagcggctcgccgaccgcaagatcgccgagctgttctccaccaagacgcacatcggg

SEQ ID NO: 12106 - RNA, 3495 nt, synthetic construct
  misc_feature 1..3495: note = derived and/or modified CDS sequence (opt1) from CCHVF(CCHVF ArD8194)__DQ211626.1__Gn-NSm-Gc
  source 1..3495: mol_type = other RNA
gccgagggcgggagcaacgactgcgtgtcccgcacccagctggtcaagaccgaggtggccgagatccacgaggacagctacggcgggcccggcgagaagatcacgatctgcaacgggtccaccatcgtggaccagcggctcggcagcgagctgggctgctacaccatcaaccgcgtccggacctacaagctgtgcgagaactccgcgacggagaagtcctgcgagatcgacagcgtgccggtgaagtgcaagcaggggttctgcctcaagatcacccaggagggccgcgggcacgtcaagctgagccggggcaccgagatcgtgctggacgtgtgcgacacctcctgcgagctcatgatccccaaggggacgggcgacatcctggtcgactgcagcggcgggcagcagcacttcctgcaggacaacctcatcgacctgggctgccccaacatccccctgctcgggcgcaccgccatctacgtgtgccggatgtccaaccacccgaagaccaccatggccttcctgttctggttcagcttcggctacgtgatcacgtgcgtcgtgtgcaaggtgctgttctacctcctgatcgtcatcggcaccctggggaagcgcctcaagcagtaccgggagctgaagccccagacctgcatcgtgtgcgagtccatccccgtgaacgccatcgacgccgagatgcacgacctgaactgcaactacaacatctgcccctactgcgcgagccgcctcacctccgacggcctggtccggcacgtgacgcagtgcccgaagcgcaaggagaaggtggaggagaccgagctgtacctcaacctggagcggatcccctggctggtccgcaagctcctccaggtgagcgagtccaccggggtggccctgaagcggagctgctggatgatcaccctcctgatcctgctcacggtctccatgagccccgtgcagagcgcccccgtcggccacaagcgcgccgtggaggtgtaccagatgcgggagtcctacaccgggatctgcctgttcgtcctgggcagcgtgctgttcgcggtgtcctggctggtcaaggccctgatcgacagcatcggcaactccttcttcccggggctcagcatctgcaagacctgctccatcggcagcatcaacgggttcgagatcgagtcccacaagtgctactgcagcctgttctgctgcccctactgccgcgcctgctccagcgacaagatcacccaccggatgcacctgaacgtgtgcaagaagcgcaaggtgggctccaacgtcatgctcgccgtgtgcaagcggatgtgcttcaaggccacgatcgaggcgagcaaccgcgccaccttcatccgcaacatcatcaactccaccttcgtgatctgcatcctgatcctggtcatctgcgtggtgagcacctccgccgtcgacatggagaacctccccgccgggatctgggagaaggaggaggacctgacgaacttctgccaccaggagtgccaggtgaccgagaccgagtgcctgtgcccctacgaggccctcatgctgcggaagccgctgttcctggaccgcatcgcgaagggcatgaagtccctcctgaacagcaccagcctggagacgagcctctccatcgaggccccctggggcgccatcaacgtgcagagcaccttcaagcccaccgtctccgccgccaacatcgcgctgagctggtccagcgtggagcacaaggggaacaagatcctggtgtccggccggagcgagtccatcatgaagctcgaggagcgcaccgggatcagctggtgcctgggcgtcgaggacgcctccgagagcaagacgctgaccgtgtccgtgatggacctcagccagatgtactcccccgtcttcgagtacctgagcggggaccgccaggtggaggagtggccgaaggcgacctgcaccggcgactgccccgagcggtgcggctgcacctccagcacgtgcctgcacaaggagtggccccacagccggaactggcgctgcaaccccacctggtgctggggcgtggggaccgggtgcacgtgctgcggcctcgacgtcaaggacctgttcaccgactacatgctggtgaagtggaaggtggagtacatcaagaccgaggccatcatctgcgtcgagctcacctcccaggagcggcagtgcagcctgatcgaggccggcacccgcttcaacctggggccggtgacgatcaccctctccgagccccggaacgtgcagcagcgcctgccgcccgagatcatcaccctgcaccccaagatcgaggagggcttcttcgacctcatgcacgtccagaaggtgatgagcgcctccaccgtgtgcaagctgcagagctgcacgcacggggtccccggcgacctccaggtgtaccacgtggggaacctcctgaagggcgacaaggtcaacggccactccatccacaagatcgagagccacctgaacacctcctggatgagctgggacgggtgcgacctcgactacttctgcaacatgggcgactggccctcctgcacctacaccggggtgacgcagcacaaccacgccgccttcatcaacatgctgaacatcgagaccgactacaccaagaccttccacttccacagcaagcgggtgacggcccacggcgacaccccgcagctggacctcaaggcgcgccccgcctacggggccggcgagatcaccgtcctggtggaggtggccgacctggagctccacaccaagaagatcgaggtctccggcctgaagttcgccagcctgtcctgcagcgggtgctacgcgtgctccagcggcatctcctgcaaggtgcggatccacgtgaacgagcccgacgagttcacggtccacgtcaagagcaacgaccccgacgtggtggccgccgggagctccctcatggcccgcaagatcgagagcggcgccgactccaccttcaaggcgttcagctccatgccgaagaacagcctgtgcttctacatcgtggagcgggactactgctccagctgcaccgacgacgacacccagaagtgcgtcgacatcaagctggagcacccccagtccatcctcatcgagcacaaggggacgatcatcggcaagcagaacgacacgtgccccaccaagaccagctgctggctggagtccatcaagagcttcttctacggcctgaagaacatgctctccgggatcttcggcaacgtgttcctggggatgctgctgttcctggcccccttcatcctgctcatcctgttcttcttcttcggctggcgcctgctgttctgcctgaagtgctgccggcgcacccgcaagctgctcaagtacaagcacctccgggacgaggaggagagcgggtacaagaagatcatcgagcgcctgaacgacaagaagggcaagtcccgcctcttcgacggcgagcggctggccgaccggaagatcgccgagctgttcagcaccaagacccacatcggg

SEQ ID NO: 12107 - RNA, 3495 nt, synthetic construct
  misc_feature 1..3495: note = derived and/or modified CDS sequence (opt1) from CCHVF(CCHVF ArD15786)__DQ211627.1__Gn-NSm-Gc
  source 1..3495: mol_type = other RNA
gccgagggcgggagcaacgactgcgtgtcccgcacccagctggtcaagaccgaggtgacggagatccacgaggacagctacggcgggcccggcgagaagatcaccatctgcaacgggtccaccatcgtggaccagcggctcggcagcgagctgggctgctacaccatcaaccgcgtccggacgtacaagctgtgcgagaactccgccaccgagaagagctgcgagatcgactccgtgccggtgaagtgcaagcaggggttctgcctcaagatcacccaggagggccgcgggcacgtcaagctgagccggggcaccgagatcgtgctggacgtgtgcgacacgtcctgcgagctcatgatccccaaggggaccggcgacatcctggtcgactgcagcggcgggcagcagcacttcctgcaggacaacctcatcgacctgggctgccccaacatccccctgctcgggcagaccgcgatctacgtgtgccgcatgtccaaccacccgaagaccacgatggccttcctgttctggttcagcttcggctacgtgatcacctgcgtcgtgtgcaaggtgctgttctacctcctgatcgtcatcggcaccctggggaagcggctcaagcagtaccgcgagctgaagccccagacctgcatcgtgtgcgagtccatccccgtgaacgccatcgacgccgagatgcacgacctgaactgcaactacaacatctgcccctactgcgccagccggctcacgtccgacggcctggtccgccacgtgacccagtgcccgaagcggaaggagaaggtggaggagaccgagctgtacctcaacctggagcgcatcccctggctggtccggaagctcctgcaggtgagcgagtccaccggggtggcgctgaagcgcagctgctggatcatcacgctcctgatcctgctcaccgtctccatgagccccgtgcagagcgcccccgtcggccacaagcgggccgtggaggtgtaccagatccgcgagtcctacaccgggatctgcctgttcgtcctgggcggcgtgctcttcgccgtgagctggctggtcaaggcgctgatcgactccatcgggaacagcttcttcccgggcctctccatctgcaagacctgcagcatcgggtccatcaacggcttcgagatcgagagccacaagtgctactgctccctgctgtgctgcccctactgccgggcctgcagctccgacaagatcacgcaccgcatgcacctcaacgtgtgcaagaagcggaaggtggggagcaacgtcatgctggccgtgtgcaagcgcatgtgcttcaaggccaccatcgaggccaacaaccgggcgaccttcatccgcaacatcatcaactccaccttcgtgatctgcatcctgatcctcgtcatctgcgtggtgagcacgtccgccgtcgacatggagaacctgcccgccggcatctgggagaaggaggaggacctgaccaacttctgccaccaggagtgccaggtgaccgagaccgagtgcctctgcccctacgaggccctgatgctgcgcaagccgctgagcctcgactccatcgccaagggcatgaagagcctgctgaactccacgagcctcgagaccagcctgtccatcgaggcgccctggggggccatcaacgtgcagagcaccttcaagcccaccatctccgccgccaacatcgccctgagctggtccagcgtcgagcacaagggcaacaagatcctcgtgtccgggcggagcgagtccatcatgaagctggaggagcgcacgggcatcagctggtgcctgggggtggaggacgcgtccgagagcaagaccctcaccgtctccgtgatggacctgagccagatgtactcccccgtgttcgagtacctgagcggcgaccggcaggtcgaggagtggccgaaggccacctgcaccggcgactgccccgagcgctgcgggtgcacgtccagcacctgcctccacaaggagtggccccacagccggaactggcgctgcaaccccacctggtgctggggcgtggggaccggctgcacgtgctgcggcctggacgtgaaggacctgttcaccgactacatgctcgtcaagtggaaggtggagtacatcaagaccgaggccatcatctgcgtggagctgacctcccaggagcggcagtgcagcctgatcgaggccgggacgcgcttcaacctcggcccggtcaccatcaccctgtccgagccccggaacgtgcagcagcgcctgccccccgagatcatcaccctccacccgaagatcgaggaggggttcttcgacctgatgcacgtgcagaaggtcatgagcgcctccacggtgtgcaagctgcagagctgcacccacggcgtgcccggggacctccaggtctaccacgtgggcaacctgctgaagggcgacaaggtgaacgggcactccatccacaagatcgagagccacctcaacacctcctggatgagctgggacggctgcgacctggactacttctgcaacatgggggactggccctcctgcacctacacgggcgtcacccagcacaaccgggcggccttcatcaacatgctgaacatcgagaccgactacaccaagacgttccacttccacagcaagcgcgtgaccgcccacggggacaccccgcagctcgacctgaaggcccggcccacctacggcgcgggcgagatcacggtgctggtcgaggtggccgacctcgagctgcacaccaagaagatcgaggtgtccgggctgaagttcgccagcctcacctgctccggctgctacgcctgcagctccgggatcagctgcaaggtccgcatccacgtgaacgagcccgacgagttcaccgtgcacgtcaagtccaacgaccccgacgtggtggccgcgggcagcagcctgatggcccggaagatcgagtccggggccgacagcacgttcaaggccttctccagcatgccgaagaactccctgtgcttctacatcgtcgagcgcgactactgcagctcctgcaccgacgacgacacccagaagtgcgtggacatcaagctcgagcacccccagagcatcctgatcgagcacaagggcaccatcatcggcaagcagaacgacacgtgccccaccaagacctcctgctggctggagagcatcaagtccttcttctacgggctcaagaacatgctgagcggcatcttcgggaacatcttcctgggcatgctcctgttcctggcccccttcgtcctcctgatcctgttcttcttcttcgggtggcggctcctgttctgcctgaagtgctgccgccggacccgcaagctcctgaagtacaagcacctgcgcgacgaggaggagtccggctacaagaagatcatcgagcggctcaacgacaagaagggcaagagccgcctgttcgacggggagcggctggcggaccgcaagatcgccgagctcttctccacgaagacccacgtgggc

SEQ ID NO: 12108 - RNA, 3495 nt, synthetic construct
  misc_feature 1..3495: note = derived and/or modified CDS sequence (opt1) from CCHVF(CCHVF ArD39554)__DQ211628.1__Gn-NSm-Gc
  source 1..3495: mol_type = other RNA
agcgagtccaacaacaacgactgcgtgagccgcacccagctgatcaagaccgagaacgccgagatccacggcgacgactacgggggccccggggagaagatcacgatctgcaacggctccaccatcgtcgagcagcggctcgggagcgagctgggctgctacaccatcaaccgcatcaagtccttcaagctgtgcgagaacagcgcctccggcaaggggtgcgagatcgacagcaccccggtgaagtgcaagcagggcttctgcctcaagatcacgcaggaggggcggggccacgtgaagctgtcccgcgggagcgagatcatcctggacgtctgcgactccagctgcgagatgatgatccccaagggctccggcgacatcctcgtggactgcagcgggggccagcagcacttcctgcaggacaacctggtggacctcgggtgccccaacgtccccctgctgggcaagatggcgatctacatctgccggatgtccaaccacccgaagaccaccatggccttcctcttctggttcagcttcggctacgtgatcacctgcatcttctgcaaggtgatcttctacgtcctgatcatcatcgggacgctgggcaagcgcatcaagcagtaccgggagctcaagccccagacctgcaccatctgcgaggccacccccgtgaacgccatcgacgccgagatgcacgacctgaactgctcctacaacatctgcccctactgcgcgagccgcctgacgtccgaggggctcgtgcggcacgtcacccagtgcccgaagcgcaaggagaagatcgaggagaccgagctgtacctgaacctcgagcggatcccctggttcgtgcgcaagctgctgcaggtgagcgagagcaccggcgtcgccctcaagcggtccagctggctggtgacgctgctcgtgctgctgaccgtctccctcagccccgtgcagtccgcccccatcgggcaggagcgcaccgtggtcacctaccaggtgcgggagagctacacgggcatgtgcctgttcatcctgggctccgtgctcttcgccatcagctggctgaccaaggggctggtcgactccgtgggcaacatcttcttcccggggctcagcgtctgcaagacctgctccatcggcagcatcaacgggttcgagatcgagtcccacaagtgctactgcagcctgttctgctgcccctactgccgctactgctccgcggaccggggcgcccaccagagccacctgtccgtgtgcaagaagcgcaagaccggcagcaacgtgatgctcgccgtctgcaagcggatgtgcttccgcgccacgctgaaggtgtccagcgaggccctgatcatccggagcatcatcaacaccaccttcgtggtctgcatcctcatcctggtggtgtgcgtcgtgtccaccagcgcggtggagatggagaacctgcccgccgggacgtgggagaaggaggaggacctcaccaacttctgccaccaggagtgccaggtcaccgagaccgagtgcctgtgcccctacgaggccttcgtgctgcgcaagccgctcttcctggactccacggccaagagcatgaagtccctgctgaacagcacctccctcgagaccagcctgtccatcgaggccccctggggcgcgatcaacgtgcagagcaccttcaagcccacggcctccaccgccaacatcgccctgagctggtccagcgtcgagcaccgcgggaacaagatcctcgtgaccggccggtccgagagcatcatgaagctggaggagcgcaccgggatctcctggaacctgggcgtggaggacgccagcgagagcaagaccctcacggtctccgtgatggacctgagccagatgtactccaccgtgttcgagtacctgagcggcgaccggcaggtcgaggagtggcccaaggcgacctgcaccggggactgcccggagcgctgcggctgcacgtccagcacctgcctccacaaggcctggccccactcccggaactggcgctgcaaccccacctggtgctggggggtgggcaccggctgcacgtgctgcgggctggacgtgaagaacctgttcaccgactacatgctcatcaagtggaaggtcgagttcatcaagaccgaggccatcgtgtgcgtggagctgaccagccaggagcggcagtgctccctgatcgaggccggcacgcgcttcaacctcgggcccgtcaccatcaccctgagcgagccgcggaacatccagcagaagctgccccccgagctcgtgaccctgcacccccgcgtggaggagggcttcttcgacctgatgcacgtccagaaggtgctctccgccagcacggtgtgcaagctgcagtcctgcacccacggggtcccgggcgacctgcaggtgtaccacgtgggcaacctcctgaagggggacaagatcaacggcaacagcttccacaagatcgagcccaacctgaacacctcctggatgagctgggacgggtgcgacctcgactactactgcaacatgggcgactggccctcctgcacctacacgggggtcacccagcacaaccacgcggccttcgtgaacctgctgaacatcgagaccgactacaccaagaacttccacttccacagcaagcgggtgacggcccacggcgagaccccgcagctcgacctgaaggcccgccccaagtacggcgcgggggaggtcaccgtgctggtggaggtcgccgacatggagctccacaccaagaagatcgagatctccggcctgaagttcgccagcctgacgtgcaccgggtgctacgcctgcagctccggcatcagctgcaaggtgcggctccacgtggacgagcccgacgagctgaccgtccacgtgaagtccgacgaccccgacgtggtcgccgcgagctccagcctgatggcccgcaagatcgagttcgggaccgactccacgttcaaggccttcagctccatgccgaaggacaagctctgcttctacatcgtggagcgggactactgcagctcctgcagcaaggaggacacccagaagtgcgtgaacgccaagctggagcagccccagtccatcctgatcgagcacaagggcaccatcatcggcaagcagaacgacacctgcacggtcaaggccagctgctggctcgagtccgtgaagagcttcttctacgggctgaagaacatgctgggcgggatcttcggcaacgtcatcctcgggatcatcatgttcctggcgcccttcgccctgctcctgctgttcttcctcttcggctggcgcatcctgttctgcctgcggtgctgccgccggacccgcggcctcttcaagtacaagcacatcaaggacgacgaggagtccgggtacaagcgcatcatcgagcggctgaacaacaagaagggcaagaacaagctgttcgacggggagcgcctcgccgacaagaagatcgccgagctgttcagcaccaagacccacatcggc

SEQ ID NO: 12109 - RNA, 3495 nt, synthetic construct
  misc_feature 1..3495: note = derived and/or modified CDS sequence (opt1) from CCHVF(CCHVF C-68031)__DQ211629.1__Gn-NSm-Gc
  source 1..3495: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacgtgcatcctgtgcaaggtcatcttctacctgctcatcgtggtgggcaccctggggaagaagttcaagcagtaccgcgagctgaagccccagacctgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctccaggtgagcgagtccaccggggtcgccctgaagcgcagctcctggctcgtggtgctgctggtcctcctgaccgtgagcctgtcccccgtgcagagcgcccccatcggccacgggaagacggtcgagacctaccagacccgggagggctacacctccatctgcctcttcgtgctgggcagcatcctgttcatcgtgtcctgcctcatgaaggggctggtcgacagcgtgggcaactccttcttcccggggctgagcatctgcaagacgtgctccatcggcagcatcaacgggttcgagaccgagtcccacaagtgctactgcagcctcttctgctgcccctactgccgccactgctccgcggaccgggagatccacaagctgcacctgagcatctgcaagaagcgcaagaccggctccaacgtcatgctcgccgtgtgcaagcggatgtgcttccgcgccaccgtggaggtcagcaacaaggccctgctgatccggaacatcatcaacacgaccttcgtggtgtgcatcctcatcctggccgtctgcgtggtgagcacctccgcggtcgagatggagagcctgcccgccggcacctgggagcgcgaggaggacctcacgaacttctgccaccaggagtgccaggtgaccgagaccgagtgcctgtgcccctacgaggccctggtgctgcgcaagcccctcttctccgacagcatcgtcaaggggatgaagaacctgctgaactccaccagcctcgagacgtccctgagcatcgaggccccctggggcgccatcaacgtgcagtccaccttcaagcccaccgtgagcgcggccaacatcgccctgtcctggagctccgtcgagcaccgggggaacaagatcctcgtgagcggccgctccgagagcatcatgaagctggaggagcggaccgggatctcctgggacctgggcgtggaggacgccagcgagagcaagctcctgaccgtctccatcatggacctgagccagatgtactcccccgtgttcgagtacctcagcggcgaccgccaggtggaggagtggccgaaggccacgtgcaccggggactgccccgagcggtgcggctgcacctccagcacgtgcctgcacaaggagtggccccactcccgcaactggcggtgcaaccccacctggtgctggggcgtcgggaccggctgcacgtgctgcgggctggacgtgaaggacctcttcaccgactacatgttcgtgaagtggaaggtcgagtacatcaagaccgaggcgatcgtgtgcgtggagctgaccagccaggagcgccagtgctccctgatcgaggccggcacccggttcaacctcgggccggtcaccatcacgctgagcgagccccgcaacatccagcagaagctgccgcccgagatcgtgaccctccacccgcggatcgaggagggcttcttcgacctgatgcacgtgaagaaggtcctgtccgccagcaccgtgtgcaagctccagtcctgcacccacggggtgcccggcgacctgcaggtctaccacatcggcaacctgctcaagggggacaaggtgaacggccacctgatccacaagatcgagccccacttcaacacgagctggatgtcctgggacgggtgcgacctggactactactgcaacatgggcgactggccgagctgctcctacaccggggtgacccagcacaaccacgccgccttcgtcaacatgctcaacatcgagaccgactacacgaagatcttccacttccacagcaagcgcgtgaccgcgcacggcgacacgccccagctggacctgaaggcccggcccacctacggcgccggggagatcaccgtgctcgtcgaggtggccgacatggagctgcacaccaagaagatcgagatctccggcctgaagttcgcgagcctgacctgcaccgggtgctacgcctgcagctccggcatcagctgcaaggtgcgcatccacgtcgacgagcccgacgagctgacggtgcacgtgaagtccgaggacccggacatcgtcgccgccagctccagcctgatggcccggaagctcgagttcgggaccgactccaccttcaaggcgttcagcgccatgcccaagacctccctgtgcttctacatcgtggagcgcgagtactgcaagagctgctccaaggaggacacgcagaagtgcgtgaacaccaagctggagcagccccagagcatcctcatcgagcacaagggcaccatcatcggcaagcagaacgacacgtgcacctccaaggccgggtgctggctggagagcgtcaagtccttcttctacggcctgaagaacatgctcagcgggatcttcggcaacgtgttcatcgggatcttcctgttcctggcccccttcatcctcctgatcctgttcttcatgttcggctggcggatcctcttctgcttcaagtgctgccgccggacccgcggcctgttcaagtaccgccacctgaaggacgacgaggagaccgggtaccggaagatcatcgagcgcctcaacaacaagaagggcaagaacaagctgctggacggggagcggctcgccgaccgcaagatcgcggagctgttctccaccaagacccacatcggc

SEQ ID NO: 12110 - RNA, 3495 nt, synthetic construct
  misc_feature 1..3495: note = derived and/or modified CDS sequence (opt1) from CCHVF(CCHVF Drosdov)__DQ211630.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaagtgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccacgggaagaccatcgagacctaccagacccgggagggcttcacgagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccctactgccgccactactccgccgaccgggagatccaccagctgcacctgagcatctgcaagaagcgcaagaccgggtccaacgtcatgctcgccgtgtgcaagcggatgtgcttcaaggccaccatcgaggcgagccgccgggccctgctgatccgctccatcatcaacacgaccttcgtcatctgcatcctcatcctggccatctgcgtggtgagcaccagcgccgtcgagatggagaacctgcccgccggcacctgggagcgcgaggaggacctcacgaacttctgccaccaggagtgccaggtgaccgagaccgagtgcctgtgcccgtacgaggcgctggtgctgcggaagcccctcttcctggactccaccgtcaagggcatgaagaacctgctcaacagcacgtccctggagaccagcctgtccatcgaggccccctggggcgccatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgcgagcgagtccaagctgctgaccgtgagcatcatggacctctcccagatgtacagcccggtgttcgagtacctgagcggcgaccggcaggtcgaggagtggcccaaggcgacctgcacgggcgactgccccgagcgctgcgggtgcacctccagcacgtgcctgcacaaggagtggccccactcccggaactggcgctgcaacccgacctggtgctggggcgtggggaccggctgcacgtgctgcggcgtggacgtcaaggacctcttcaccgaccacatgttcgtgaagtggaaggtggagtacatgaagaccgaggccatcgtctgcgtggagctgaccagccaggagcggcagtgctccctgatcgaggccgggacccgcttcaacctcggccccgtgaccatcaccctgagcgagccccggaacatccagcagaagctgcccccggagatcatcacgctccaccccaagatcgaggaggggttcttcgacctgatgcacgtccagaaggtgctgtccgccagcaccgtgtgcaagctccagtcctgcacccacggcatccccggggacctgcagatctaccacatcggcaacctgctcaagggcgaccgcgtcaacgggcacctgatccacaagatcgagccgcacttcaacaccagctggatgtcctgggacggctgcgacctggactactactgcaacatggggaactggcccagctgcacgtacaccggcgtgacccagcacaaccacgccgccttcgtgaacctcctgaacatcgagaccgactacacgaagaccttccacttccactccaagcgggtcaccgcccacggggacacgccccagctggacctcaaggcccgccccacctacggcgcgggcgagatcaccgtgctggtggaggtcgccgacatggagctgcacaccaagaaggtggagatcagcgggctcaagttcgcctccctggtgtgcaccggctgctacgcctgcagctccgggatcagctgcaaggtccggatccacgtggacgagccggacgagctgacggtgcacgtcaagtccagcgaccccgacgtggtggccgcgagcacctccctcatggcccgcaagctggagttcggcaccgacagcatcttcaaggccttctccgccatgcccaagaccagcctgtgcttctacatcgtcgagcgggagtactgcaagtcctgcagcgaggacgacacgaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcaacttcttcgtggggatcctcctcttcctggccccgttcgtgctgctcgtcctgttcttcatgttcggctggaagatcctgttctgcttcaagtgctgccgccggacccgcggcctcttcaagtaccgccacctgaaggacgacgaggagaccgggtaccggcgcatcatcgagcggctgaacagcaagaagggcaagaaccgcctcctggacggggagcggctggccgaccgcaagatcgccgagctgttctccaccaagacccacatcggc

SEQ ID NO: 12111 - RNA, 3495 nt, synthetic construct
  misc_feature 1..3495: note = derived and/or modified CDS sequence (opt1) from CCHVF(CCHVF Kashmanov)__DQ211631.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgcaccatcgggtccatcaacggcttcgagatcgagagccacaagtgctactgctccctgttctgctgcccctactgccggcactgcagcgccgaccgcgagatccaccagctgcacctctccatctgcaagaagcggaagaccgggagcaacgtcatgctggccgtgtgcaagcgcatgtgcttccgggccaccatcgaggcgtcccgccgcgccctgctcatccggagcatcatcaacacgaccttcgtcatctgcatcctgaccctgaccatctgcgtggtgtccacgagcgccgtcgagatggagaacctcccgagcggcacctgggagcgcgaggaggacctgaccaacttctgccaccaggagtgccaggtgaccgagacggagtgcctgtgcccctacgaggccctggtgctccggaagcccctgttcctggactccatcgtcaagggcatgaagaacagcctcaactccaccagcctggagacctccctgagcatcgaggccccctggggcgcgatcaacgtgcagtccaccttcaagccgaccgtgagcacggccaacatcgccctctcctggagctccgtcgagcaccgcgggaacaagatcctggtgaccgggcggagcgagtccatcatgaagctggaggagcgcaccggcgtgagctgggacctcggggtcgaggacgcctccgagagcaagctgctgaccgtgtccatcatggacctcagccagatgtacagccccgtgttcgagtacctgtccggcgaccggcaggtcgaggagtggcccaaggccacgtgcaccggcgactgccccgagcgctgcgggtgcaccagctccacgtgcctgcacaaggagtggccgcacagccggaactggcgctgcaaccccacctggtgctggggcgtggggaccggctgcacgtgctgcggcgtggacgtcaaggacctcttcaccgaccacatgttcgtgaagtggaaggtggagtacatcaagaccgaggcgatcgtctgcgtggagctgacctcccaggagcggcagtgcagcctgatcgaggccgggacccgcttcaacctcggccccgtgaccatcacgctgtccgagccccggaacatccagcagaagctgccgcccgagatcatcaccctccaccccaaggtcgaggaggggttcttcgacctgatgcacgtgcagaaggtgctgagcgcctccaccgtctgcaagctccagagctgcacccacggcatcccgggggacctccaggtgtaccacatcggcaacctgctcaagggcgaccgcatcaacgggcacctgatccacaagatcgagccccacttcaacacgtcctggatgagctgggacggctgcgacctggactactactgcaacatgggggactggccctcctgcacctacaccggcgtgacccagcacaaccacgccgccttcgtcaacctcctgaacatcgagacggactacaccaagaccttccacttccacagcaagcgggtgaccgcgcacggggacacgccccagctggacctcaaggcccgcccgacctacggcgccggcgagatcaccgtgctggtcgaggtggccgacatggagctgcacaccaagaaggtggagatctccgggctcaagttcgcgagcctggcctgcacgggctgctacgcctgctccagcgggatctcctgcaaggtccggatccacgtggacgagcccgacgagctgaccgtgcacgtcaagagcagcgaccccgacgtggtggccgcctccaccagcctcatggcgcgcaagctggagttcggcaccgactccacgttcaaggccttcagcgccatgcccaagacctccctgtgcttctacatcgtcgagcgggagtactgcaagagctgctccgaggaggacacccagaagtgcgtggacaccaagctcgagcagccgcagagcatcctgatcgagcacaaggggaccatcatcggcaagcagaacgacacgtgcaccgccaaggcctcctgctggctggagagcgtgaagtccttcttctacggcctcaagaacatgctggggagcgtcttcggcaacttcttcatcgggatcctgctgttcctggcgcccttcgtgctgctcgtgctgttcttcatgttcggctggaagatcctgttctgcttcaagtgctgccgccgcacccgggggctcctgaagtaccgccacctgaaggacgacgaggagaccggctaccggcgcatcatcgagcggctcaacaacaagaagggcaagaaccgcctgctggacggggagcggctcgccgaccgcaagatcgccgagctgttctccacgaagacccacatcggc

SEQ ID NO: 12112 - RNA, 3495 nt, synthetic construct
  misc_feature 1..3495: note = derived and/or modified CDS sequence (opt1) from CCHVF(CCHVF Oman)__DQ211632.1__Gn-NSm-Gc
  source 1..3495: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctcaagcggagcagctggctgatcgtgctgctcgtgctgctgaccgtctccctcagccccgtgcagtccgcccccatcggccacgggaagacgatcgagacctaccagacccgcgagggctacaccagcatctgcctgttcgtgctgggctccatcctcttcatcgtcagccacctgatgaaggggctggtggactccgtgggcaacagcttcttcccggggctctccatctgcaagacgtgcagcatcggctccatcaacgggttcgagatcgagagccacaagtgcttctgctccctgttctgctgcccctactgccggcactgcagcgcggacaaggagatccacaagctgcacctctccatctgcaagaagcgcaaggccggcagcaacgtcatgctggccgtgtgcaagcggatgtgcttccgcgccaccatggaggtctccaacaaggccctgctcatccggagcgtgatcaacaccaccttcgtggtctgcatcctgatcctggcggtgtgcgtggtctccacgagcgccgtggagatggagagcctccccgccggcacctgggagcgcgaggaggacctgaccaacttctgccaccaggagtgccaggtgaccgagacggagtgcctgtgcccctacgaggccctggtcctccggaagccgctgttcctggactccatcgccaaggggatgaagaacctcctgaacagcacctccctggagaccagcctctccatcgaggcgccctggggcgccatcaacgtgcagagcaccttcaagcccacggtgtccaccgccaacatcgccctgagctggtccagcgtcgagcaccgcgggaacaagatcctggtgtccggccgcagcgagtccatcatgaagctcgaggagcggaccgggatcagctgggacctgggcgtggaggacgcctccgagagcaagctgctcaccgtctccgtgatggacctgagccagatgtacagccccgtgttcgagtacctgtccggcgaccgccaggtcgaggagtggccgaaggcgacctgcacgggggactgccccgagcggtgcggctgcaccagctccacgtgcctccacaaggagtggccccacagccgcaactggcggtgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccaggagcgccagtgcagcctgatcgaggccggcacccggttcaacctggggccggtgaccatcaccctctccgagccccgcaacatccagcagaagctgccgcccgagatcgtgacgctgcacccccggatcgaggagggcttcttcgacctcatgcacgtccagaaggtgctgagcgcctccaccgtgtgcaagctgcagagctgcacccacggggtccccggcgacctccaggtgtaccacatcggcaacctgctgaagggggacaaggtgaacggccacctcatccacaaggtcgagccccacttcaacacctcctggatgagctgggacgggtgcgacctggactactactgcaacatgggcgactggccgtcctgcacgtacaccggggtgacccagcacaaccacgccgcgttcgtgaacctgctcaacatcgagaccgactacacgaagaacttccacttccacagcaagcgcgtcaccgcccacggcgacacgccccagctggacctgaaggcccggcccaactacggcgccggggaggtgaccgtgctcgtcgaggtggcggacatggagctgcacaccaagaagatcgagatctccggcctgaagttcgccagcctgacctgcaccgggtgctacgcctgctccagcggcatctcctgcaaggtgcgcatccacgtcgacgagcccgacgagctgaccgtgcacgtcaagagcgaggacccggacatcgtggccgccagctccagcctgatggcgcggaagctcgagttcgggacggactccaccttcaaggccttcagcgccatgcccaagacctccctgtgcttctacatcgtggagcgcgagtactgcaagagctgctccaaggaggacacccagaagtgcgtgaacgccaagctggagcggccccagagcatcctcatcgagcacaagggcacgatcatcggcaagcagaacgacacgtgcaccgccaaggcgtcctgctggctggagagcgtcaagtccttcttctacgggctgaagaacatgctcagcggcatcttcgggaacgtgttcatcggcatcttcctgttcctggcccccttcatcctcctgatcctgttcttcatgttcgggtggcgcatcctcttctgcttcaagtgctgccggcgcacccggggcctgttcaagtaccgccacctgaaggacgacgaggagaccggctaccgcaagatcatcgagcggctcaacaacaagaaggggaagaacaagctgctggacggcgagcgcctcgccgaccggaagatcgccgagctgttctccaccaagacccacatcggg

SEQ ID NO: 12113 - RNA, 3495 nt, synthetic construct
  misc_feature 1..3495: note = derived and/or modified CDS sequence (opt1) from CCHVF(CCHVF SPU97/85)__DQ211633.1__Gn-NSm-Gc
  source 1..3495: mol_type = other RNA
agcgaggagtccgacggcgactgcatcagccgcacccagctgctccggaccgagacggccgagatccactccgacaactacgggggccccggggacaagatcaccatctgcaacggcagcaccatcgtggaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgagatcgtcctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggcggatggccatctacatctgccgcatgtccaaccacccgaagacgaccatggccttcctgttctggttcagcttcggctacgtgatcacgtgcatcctgtgcaaggtcatcttctacctcctgatcgtggccggcaccgtggggaagaagttcaagcagtaccgggagctgcgcccccagacctgcaccatctgcgagaccacccccgtcaacgccatcgacgcggagatgcacgacctcaactgctcctacaacatctgcccctactgcgccagccggctgacgtccgacggcctggcccgccacgtgatgcagtgcccgaagcggaaggagaagatcgaggagaccgagctctacctgaacctggagcgcatcccctgggtggtccggaagctcctccaggtgagcgagagcaccggggtggccctgaagcgctccagctggctgaccgtcctgctggtgctcctgatcgtgtccctgagccccgtccagtccgcgcccatcggccacgggaagacgatcgagacctaccaggcccgggagggctacaccagcttctgcctcttcatcctgggctccatcctgttcatcgtgagctgcctcgtgaaggggctgatcgactccgtcggcaacagcttcttcccggggctgtccatctgcaagacctgcagcatcggctccgtgaacgggttcgagatcgagagccacaagtgctactgctccctcttctgctgcccctactgccgccactgcagcgccgaccgggagatccacaagctgcacctgtccatctgcaagaagcgcaagacgggcagcaacgtgatgctcgccgtctgcaagcggatgtgcttccgcgccaccatcgaggtgtccaaccgcgcgctgctgatccggagcatcatcaacaccaccttcgccgtctgcatcctcacgctggccgtgtgcgtggtcagcacctccgccgtggagatggagagcctgcccgccggcacctgggagcgcgaggaggacctcaccaacttctgccaccaggagtgccaggtgacggagaccgagtgcctgtgcccctacgaggcgctggtcctgcggaagcccctcttcctggactccatcgtgaaggggaagaagaacctgctcaacagcacctccctggagaccagcctgtccatcgaggccccctggggcgccatcaacgtgcagagcacgttcaagcccaccgtctccgccgccaacatcgcgctcagctggtccagcgtggagcaccgcgggaacaagatcctggtgtccggccggagcgagtccatcatgaagctggaggagcgcaccgggatcagctgggacctcggcgtcgaggacgcctccgagagcaagctgctgaccgtgagcgtgatggacctctcccagatgtacagccccgtcttcgagtacctgtccggcgaccgccaggtggaggagtggccgaaggcgacctgcacgggggactgccccgagcggtgcggctgcaccagctccacgtgcctgcacaaggagtggccccacagccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgacctcccaggagcggcagtgcagcctcatcgaggccggcacccgcttcaacctggggccggtgaccatcaccctgtccgagccccggaacatccagcagaagctcccgcccgagatcatcacgctgcacccgcgcatcgaggagggcttcttcgacctgatgcacgtccagaaggtgctcagcgcctccaccgtgtgcaagctgcagagctgcacccacggggtccccggcgacctccaggtgtaccacatcggcaacctgctgaagggggacaaggtgaacggccacctgatccacaagatcgagccccacttcaacacctcctggatgagctgggacgggtgcgacctcgactactactgcaacatgggcgactggccgtcctgcacgtacaccggggtcacccagcacaaccacgccgccttcgtgaacctgctgaacatcgagaccgactacacgaagaacttccacttccacagcaagcgggtgaccgcccacggcgacacgccccagctcgacctgaaggcgcgccccacctacggcgccggggaggtcaccgtgctggtggaggtcgccgacatggagctccacaccaagaagatcgagatctccggcctgaagttcgccagcctgtcctgcaccgggtgctacgcctgcagcagcggcatctcctgcaaggtgcggatccacgtggacgagcccgacgagctcaccgtccacgtcaagagcgaggacccggacatcgtggcggccgggtccagcctgatggcccgcaagctggagttcggcgccgactccacgttcaaggccttcagcgcgatgcccaagacctccctctgcttctacatcgtggagcgggagtactgcaagagctgctcccgcgaggacacccagaagtgcgtgaacaccaagctggagcgcccccagagcatcctgatcgagcacaagggcacgatcatcgggaagcagaacgacacgtgcaccgccaaggcctcctgctggctcgagagcgtgaagtccttcttctacggcctcaagagcatgctgtccgggatcttcggcaacgtcttcatcgggatcttcctgttcatcgcccccttcgtgctgctgatcctcttcttcatgttcggctggcggatcctgttctgcttcaagtgctgccgccggacccgcggcctgttcaagtaccggcacctcaaggacgacgaggagaccgggtaccgcaagatcatcgagcggctgaacaacaagaagggcaagaacaagctgctcgacggggagcgcctggccgaccggaagatcgcggagctgttcagcaccaagtcccacatcggc

SEQ ID NO: 12114 - RNA, 3495 nt, synthetic construct
  misc_feature 1..3495: note = derived and/or modified CDS sequence (opt1) from CCHVF(CCHVF SPU103/87)__DQ211634.1__Gn-NSm-Gc
  source 1..3495: mol_type = other RNA
agcgaggagtccagcgacgactgcatctcccgcacccagctgctccggaccgagacggccgagatccacggcgacaactacgggggccccggggacaagatcaccatctgcaacggcagcaccatcgtggaccagcgcctggggtccgagctgggctgctacaccatcaaccgggtcaagacgttcaagctctgcgagaacagcgccaccggcaagtcctgcgagatcgacagcgtgccggtgaagtgccgccaggggtactgcctgaagatcacccaggagggccgggggcacgtcaagctgtcccgcggcagcgaggtggtgctcgacgcgtgcgacacctcctgcgaggtcatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtgatcacgtgcgtcctgtgcaaggccatcttctacctcctgatcatcgtgggcaccctggggaagcgcctcaagcagtaccgggagctgaagccccagacctgcaccatctgcgagaccacgcccgtgaacgccatcgacgcggagatgcacgacctgaactgctcctacaacatctgcccctactgcgccagccgcctcacctccgacggcctggcccggcacgtcacccagtgcccgaagcgcaaggagaaggtggaggagaccgagctgtacctcaacctggagcggatcccctgggtggtccgccggctgctccaggtgagcgagtccacgggggtggccctgaagcgcagcagctggctgatcgtcctcctggtgctgttcaccgtgtccctcagccccgtccagtccgcgcccatcagccacggcaagaccgtggaggcctaccaggcccgggaggggtacaccggcatgtgcctgttcgtgctgggctccatcctcttcctggtcagctgcctgatgaaggggctcgtggactccgtcggcaacacgttcttcccggggctgagcatctgcaagacctgctccatcagctccatcaacggcttcgagatcgagagccaccgctgctactgctccctgttctgctgcccctactgccggcactgcagcgccaacaaggagatccaccagctccacctgtccatctgcaagaagcgcaagaccgggagcaacgtgatgctggccgtgtgcaagcggatgtgcttccgcgcgaccatggaggtctccaaccgcgccctcttcatccggagcatcatcaacacgaccttcgtgctgtgcatcctgatcctcgccgtgtgcgtcgtgtccaccagcgccgtggagatggagagcctgcccgccggcacctgggagcgcgaggaggacctgacgaacttctgccaccaggagtgccaggtcaccgacaccgagtgcctgtgcccctacgaggcgctcgtgctgcggcgcccgctgttcctcgacaacatcgtgaagggcatgaagaacctgctgaactccaccagcctcgagacgtccctgagcatcgaggccccctggggcgccatcaacgtccagtccacctacaagcccaccgtgagcaccgccaacatcgccctgtcctggagctccgtggagcaccgggggaacaagatcctcgtcagcgggcgctccgagagcatcatgaagctggaggagcggaccggcatctcctgggacctgggggtggaggacgcgagcgagtccaagctcctgacggtgagcgtcatggacctgtcccagatgtacagccccgtgttcgagtacctcagcggcgaccgccaggtggaggagtggccgaaggcgacctgcaccggcgactgccccgagcggtgcgggtgcacctccagcacgtgcctgcacaaggagtggccccactcccgcaactggcggtgcaaccccacctggtgctggggcgtcgggaccggctgcacgtgctgcggcctggacgtgaaggacctcttcaccgactacatgttcgtgaagtggaagatcgagtacatcaagaccgaggccatcgtctgcgtggagctgaccagccaggagcgccagtgctccctgatcgaggccgggacccggttcaacctcggcccggtgacgatcaccctgagcgagccccgcaacatccagcagaagctgccctccgagatcatcaccctccacccccggatcgaggaggggttcttcgacctgatgcacgtccagaaggtgctgagcgcctccaccgtgtgcaagctccagagctgcacgcacggcgtcccgggggacctccaggtgtaccacatcggcaacctgctgaagggcgacaaggtgaacgggcacctggtccacaagatcgagccccacttcaacacctcctggatgagctgggacggctgcgacctggactactactgcaacatgggggactggccctcctgcacctacaccggcgtgacgcagcacaaccacgccagcttcgtgaacctcctgaacatcgagaccgactacaccaagaacttccacttccactccaagcgcgtcaccgcccacggggacacgccgcagctggacctcaaggcccggcccacctacggcgccggcgagatcaccgtgctggtggaggtcgcggacatggagctgcacaccaagaagatcgagatcagcgggctcaagttcacgtccctgacctgcaccggctgctacgcctgcagctccgggatcagctgcaaggtgcgcatccacgtggacgagcccgacgagctgaccgtccacgtcaagagcgacgaccccgacgtggtggccgcctccagctccctcatggcccggaagctggagttcggcacggacagcaccttcaaggcgttctccgccatgccgaagaccagcctgtgcttctacatcgtggagcgcgagtactgcaagtcctgcagcgaggaggacacccagaagtgcgtgaacacgaagctcgagcagccccagtccatcctgatcgagcacaaggggaccatcatcggcaagcagaacaacacgtgcaaggcccgcgccggctgctggctggagagcgtcaagtccttcttctacgggctcaagaacatgctgagcggcatcttcgggaacgtgttcatcggcatcttcctgttcctcgcccccttcatcctgctgatcctcttcttcatgttcgggtggcggatcctgttctgcttcaagtgctgccgccggacccgcggcctgttcaagtaccggcacctcaaggacgacgaggagaccggctaccgcaagatcatcgagcggctgaacaacaagaaggggaagaacaagctgctcgacggcgagcgcctggcggaccggcgcatcgccgagctgttctccaccaagacccacatcggg

SEQ ID NO: 12115 - RNA, 3495 nt, synthetic construct
  misc_feature 1..3495: note = derived and/or modified CDS sequence (opt1) from CCHVF(CCHVF SPU415/85)__DQ211635.1__Gn-NSm-Gc
  source 1..3495: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtggaccagcgcctggggtccgagctgggctgctacacgatcaaccgggtcaagagcttcaagctctgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgacagcaactgcgagatcatgatccccaaggggacgggcgacatcctggtggactgctccggcgggcagcagcacttcctgaaggacaacctcatcgacctgggctgccccaacatccccctgctcgggaagatggcgatctacatctgccggatgagcaaccacccgaagaccaccatggccttcctgttctggttctccttcggctacgtgatcacgtgcatcctgtgcaaggtcatcttctacctcctgatcgtggccggcaccgtggggaagaagttcaagcagtaccgcgagctgcggccccagacctgcaccatctgcgagaccatccccgtcaacgccatcgacgccgagatgcacgacctcaactgcagctacaacatctgcccctactgcgcgtcccgcctgacgagcgacggcctggcccggcacgtgatgcagtgcccgaagcgcaaggagaaggtggaggagaccgagctctacctgaacctggagcggatcccctgggtcgtgcgcaagctcctccaggtgtccgagagcaccggggtcgccctgaagcggagctcctggctgaccgtgctgctggtgctcctgatcgtcagcctgtcccccgtgcagagcgcccccatcggccacgggaagacgatcgagacctaccaggcgcgcgagggctacacctccttctgcctcttcatcctgggcagcatcctgttcgtggtctcctgcctcgtgaaggggctgatcgacagcgtgggcaactccttcttcccggggctgagcatctgcaagacctgctccatcggcagcatcaacgggttcgagatcgagtcccacaagtgctactgcagcctcttctgctgcccctactgccggcactgctccgccgaccgcgagatccacaagctgcacctgagcatctgcaagaagcggaagacgggctccaacgtcatgctcgccgtgtgcaagcgcatgtgcttccgggccaccatcgaggtcagcaaccgcgccctgctgatccgcaacatcatcaacaccaccttcgtggtgtgcatcctcacgctggcggtctgcgtggtgtccaccagcgccgtcgagatggagagcctgcccgccggcacctgggagaaggaggaggacctcaccaacttctgccaccaggagtgccaggtgacggagaccgagtgcctgtgcccctacgaggccctggtgctgcggaagcccctcttcctggactccatcgtcaaggggatgaagaacctgctcaacagcacctccctggagaccagcctgtccatcgaggccccctggggcgcgatcaacgtgcagagcacgttcaagcccaccgtgtccgccgccaacatcgccctcagctggtccagcgtcgagcaccgcgggaacaagatcctggtgtccggccggagcgagtccatcatgaagctggaggagcgcaccgggatcagctgggacctcggcgtggaggacgcctccgagagcaagctgctgaccgtctccgtgatggacctcagccagatgtacagccccgtgttcgagtacctgtccggcgaccggcaggtcgaggagtggccgaaggcgacctgcacgggggactgccccgagcgctgcggctgcaccagctccacgtgcctgcacaaggagtggccccacagccggaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcggcagtgcagcctcatcgaggccggcacccgcttcaacctggggccggtgaccatcaccctgtccgagccccggaacatccagcagaagctcccgcccgagatcatcacgctgcacccgcgcatcgaggagggcttcttcgacctgatgcacgtgcagcgggtcctcagcgcctccaccgtgtgcaagctgcagagctgcacccacggggtgcccggcgacctgcaggtctaccacatcggcaacctcctgaagggggacaaggtgaacggccacctgatccacaagatcgagccccacttcaacacctcctggatgagctgggacgggtgcgacctcgactactactgcaacatgggcgactggccgtcctgcacgtacaccggggtgacccagcacaaccacgccgcgttcgtcaacctgctgaacatcgagaccgactacacgaagaacttccacttccacagcaagcgcgtgaccgcccacggcgacacgccccagctcgacctgaaggcccggcccacctacggcgccggggaggtgaccgtcctggtggaggtggcggacatggagctccacaccaagaagatcgagatctccggcctgaagttcgccagcctgacctgcaccgggtgctacgcctgctccagcggcatctcctgcaaggtcaagatccacgtggacgagcccgacgagctcacggtgcacgtcaagagcgaggacccggacatcgtggccgccgggagctccctgatggcgcgcaagctggagttcggcgccgacagcaccttcaaggccttctccgccatgcccaagaccagcctctgcttctacatcgtggagcgggagtactgcaagtcctgcagccgcgaggacacccggaagtgcgtcaacacgaagctggaccgcccccagtccatcctgatcgagcacaagggcaccatcatcgggaagcagaacaacacgtgcaccgccaaggcgagctgctggctcgagtccgtcaagagcttcttctacggcctgaagaacatgctgtccgggatcttcggcaacgtgttcatcgggatcttcctcttcatcgcccccttcgtgctgctgatcctcttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaacaagctgctcgacggggagcggctggccgaccgcaagatcgccgagctgttcagcaccaagtcccacatcggc

SEQ ID NO: 12116 - RNA, 3495 nt, synthetic construct
  misc_feature 1..3495: note = derived and/or modified CDS sequence (opt1) from CCHVF(CCHVF Turkey200310849)__DQ211636.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcagctgcaaggccctgttctactccctcatcatcatcggcaccctggggaagaagatcaagcagtaccgggagctgaagccccagacctgcaccatctgcgagaccgcccccgtcaacgcgatcgacgccgagatgcacgacctcaactgcagctacaacatctgcccgtactgcgcctcccgcctgacgagcgacggcctggcccggcacgtgacccagtgccccaagcgcaaggagaaggtggaggagaccgagctctacctgaacctggagcggatcccctggatcgtccgcaagctcctccaggtgtccgagagcaccggggtggcgctgaagcggagctcctggctgatcgtcctgctggtgctcctgacggtgagcctgtcccccgtccagagcgccccggtgggccacgggaagaccatcgagatctaccagacccgcgagggcttcgcctccatctgcctcttcatgctgggcagcatcctgttcatcgtgtcctgcctcgtcaaggggctggtggacagcgtgtccgacagcttcttccccggcctgtccgtctgcaagacctgcagcatcgggtccgtgaacggcttcgagatcgagagccacaagtgctactgctccctcttctgctgcccctactgccggcactgcagcgccgaccgcgagatccaccagctgcacctgtccatctgcaagaagcggaagacggggagcaacgtcatgctcgccgtgtgcaagcgcatgtgcttccgggcgaccatcgaggcctcccgccgcgccctgctgatccggagcatcatcaacaccaccttcgtgatctgcatcctcacgctgaccatctgcgtcgtgagcacctccgccgtggagatggagaacctgcccgccggcacctgggagcgcgaggaggacctcacgaacttctgccaccaggagtgccaggtcaccgagaccgagtgcctgtgcccgtacgaggcgctggtgctgcggaagcccctcttcctggacagcatcgtgaagggcatgaagaacctgctcaactccaccagcctggagacgtccctgagcatcgaggccccctggggcgccatcaacgtccagtccaccttcaagcccgccgtgagcaccgccaacatcgcgctctcctggagctccgtggagcaccgcgggaacaagatcctggtcaccgggcggagcgagtccatcatgaagctggaggagcgcaccggcgtgagctgggacctcggggtggaggacgcctccgagagcaagctgctgacggtctccatcatggacctcagccagatgtacagcccggtgttcgagtacctgtccggcgaccgccaggtggaggagtggcccaaggcgacctgcaccggcgactgccccgagcggtgcgggtgcaccagctccacgtgcctgcacaaggagtggccccacagccggaactggcgctgcaacccgacctggtgctggggcgtcgggaccggctgcacgtgctgcggcgtggacgtgaaggacctcttcaccgaccacatgttcgtcaagtggaaggtggagtacatcaagaccgaggccatcgtgtgcgtcgagctgacctcccaggagcggcagtgcagcctgatcgaggccgggacccgcttcaacctcggccccgtgacgatcaccctgtccgagccccggaacatccagcagaagctgcccccggagatcatcaccctccaccccaagatcgaggaggggttcttcgacctgatgcacgtgcagaaggtcctgagcgcctccaccgtgtgcaagctccagagctgcacgcacggcatccccggggacctccaggtgtaccacatcggcaacctgctgaagggcgaccgcgtcaacgggcacctgatccacaagatcgagtcccacttcaacaccagctggatgtcctgggacggctgcgacctggactactactgcaacatgggggactggccgagctgcacctacaccggcgtgacgcagcacaaccacgccgccttcgtgaacctcctgaacatcgagaccgactacaccaagaccttccacttccactccaagcgggtcacggcccacggggacacgccccagctggacctcaaggcgcgccccacctacggcgccggcgagatcaccgtgctggtggaggtcgccgacatggagctgcacaccaagaaggtggagatcagcgggctcaagttcgcctccctggcctgcaccggctgctacgcgtgcagctccgggatcagctgcaaggtgcggatccacgtcgacgagcccgacgagctgaccgtgcacgtcaagagctccgacccggacgtggtggccgccagcacctccctcatggcccgcaagctggagttcggcacggacagcaccttcaaggccttctccgcgatgcccaagaccagcctgtgcttctacatcgtggagcgggagtactgcaagtcctgcagcgaggacgacacccagaagtgcgtcgacacgcgcctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacctgttcatcgggatcctcctgttcctggcccccttcgtgctcctggtgctgttcttcatgttcggctggaagatcctcttctgcttcaagtgctgccgccggacccgcgggctgttcaagtaccggcacctgaaggacgacgaggagaccggctaccgccggatcatcgagcgcctcaacagcaagaagggcaagaaccggctgctggacggggaccgcctcgccgaccggaagatcgcggagctgttctccaccaagacccacatcggc

SEQ ID NO: 12117 - RNA, 3495 nt, synthetic construct
  misc_feature 1..3495: note = derived and/or modified CDS sequence (opt1) from CCHVF(CCHVF Iran-52)__DQ446215.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctgagcgtgtgcaagacgtgctccatcgggagcatcaacggcttcgagatcgagtcccacaagtgctactgcagcctcttctgctgcccctactgccggcactgctccgccgacggcgagatccaccagctgcacctgagcatctgcaagaagcgcaagaccgggtccaacgtcatgctcgcggtgtgcaagcggatgtgcttccgcgccaccatggaggtgagcaacaaggccctgttcatccgctccatcatcaacaccacgttcgtcgtgtgcatcctgatcctcgccgtgtgcgtcgtgagcacctccgccgtggagatggagagcctgcccgcgggcacctgggagcgggaggaggacctgaccaacttctgccaccaggagtgccaggtcacggagaccgagtgcctctgcccctacgaggccctggtgctgcgccggccgctgttcctcgacagcatcgtgaaggggatgaagaacctgctgaactccaccagcctcgagacctccctgagcatcgaggccccctggggcgccatcaacgtccagtccacgtacaagcccaccgtgagcaccgccaacatcgcgctgtcctggagctccgtggagcaccgcgggaacaaggtcctcgtgagcggccggtccgagagcatcatgaagctggaggagcgcaccggcatctcctgggacctgggggtggaggacgccagcgagtccaagctcctgaccgtcagcgtgatggacctgtcccagatgtacagccccgtgttcgagtacctcagcggcgaccggcaggtcgaggagtggccgaaggccacgtgcaccggggactgccccgagcgctgcggctgcacctccagcacgtgcctgcacaaggagtggccccactcccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcggcagtgctccctgatcgaggccggcacccgcttcaacctcgggagcgtgaccatcacgctgtccgagccgcggaacatccagcagaagctgccgcccgagatcatcaccctccaccccaagatcgaggagggcttcttcgacctgatgcacgtgcagaaggtcctgagcgcgtccaccgtgtgcaagctccagagctgcacccacggcgtgcccggggacctgcaggtctaccacatcggcaacctgctcaagggggaccgcgtgaacggccacctgatccacaagatcgagcagcacttcaacacgtcctggatgagctgggacgggtgcgacctggactactactgcaacatgggcgactggccctcctgcacctacaccggcgtgacccagcacaaccacgccagcttcgtcaacctcctgaacatcgagacggactacaccaagaccttccacttccactccaagcgggtgaccgcccacggggacacgccccagctggacctcaaggcccgcccgacctacggcgccggggagatcaccgtgctggtcgaggtggcggacatggagctgcacaccaagaagatcgagatcagcggcctcaagttcgccgggctgacgtgcaccggctgctacgcctgctccagcggcatctcctgcaaggtgcggatccacgtcgaggagcccgacgagctgaccgtgcacgtcaagagcgacgaccccgacgtggtggccgcgagctccagcctcatggcccgcaagctggagttcgggaccgactccacgttcaaggccttcagcgccatgcccaagacctccctgtgcttctacatcgtggagcgggagtactgcaagagctgctccaaggaggacacccagaagtgcgtcaacaccaagctcgagcagccgcagagcatcctgatcgagcacaagggcacgatcatcgggaagcagaacaacacgtgcaccgccaaggcgtcctgctggctggagagcgtgaagtccttcttctacggcctcaagaacatgctcgggggcatcttcggcaacgtcttcatcgggatcttcaccttcctgacccccttcatcctgctgatcctgttcttcatgttcggctggcgcatcctcttctgcttcaagtgctgccgccggacccgcgggctgttcaagtaccggcacctgaaggacgacgaggagaccggctaccgcaagatcatcgagcggctcaacaacaagaagggcaagaaccgcctgctggacggggagcggctcgccgaccgcaagatcgccgagctgttcagcaccaagacccacatcggc

SEQ ID NO: 12118 - RNA, 3495 nt, synthetic construct
  misc_feature 1..3495: note = derived and/or modified CDS sequence (opt1) from CCHVF(CCHVF Iran-53)__DQ446216.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctgagcgtgtgcaagacgtgctccatcgggagcatcaacggcttcgagatcgagtcccacaagtgctactgcagcctcttctgctgcccctactgccggcactgctccgccgacggcgagatccaccagctgcacctgagcatctgcaagaagcgcaagaccgggtccaacgtcatgctcgcggtgtgcaagcggatgtgcttccgcgccaccatggaggtgagcaacaaggccctgttcatccgctccatcatcaacaccacgttcgtcgtgtgcatcctgatcctcgccgtgtgcgtcgtgagcacctccgccgtggagatggagagcctgcccgcgggcacctgggagcgggaggaggacctgaccaacttctgccaccaggagtgccaggtcacggagaccgagtgcctctgcccctacgaggccctggtgctgcgccggccgctgttcctcgacagcatcgtgaaggggatgaagaacctgctgaactccaccagcctcgagacctccctgagcatcgaggccccctggggcgccatcaacgtccagtccacgtacaagcccaccgtgagcaccgccaacatcgcgctgtcctggagctccgtggagcaccgcgggaacaaggtcctcgtgagcggccggtccgagagcatcatgaagctggaggagcgcaccggcatctcctgggacctgggggtggaggacgccagcgagtccaagctcctgaccgtcagcgtgatggacctgtcccagatgtacagccccgtgttcgagtacctcagcggcgaccggcaggtcgaggagtggccgaaggccacgtgcaccggggactgccccgagcgctgcggctgcacctccagcacgtgcctgcacaaggagtggccccactcccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcggcagtgctccctgatcgaggccggcacccgcttcaacctcgggagcgtgaccatcacgctgtccgagccgcggaacatccagcagaagctgccgcccgagatcatcaccctccaccccaagatcgaggagggcttcttcgacctgatgcacgtgcagaaggtcctgagcgcgtccaccgtgtgcaagctccagagctgcacccacggcgtgcccggggacctgcaggtctaccacatcggcaacctgctcaagggggaccgcgtgaacggccacctgatccacaagatcgagcagcacttcaacacgtcctggatgagctgggacgggtgcgacctggactactactgcaacatgggcgactggccctcctgcacctacaccggcgtgacccagcacaaccacgccagcttcgtcaacctcctgaacatcgagacggactacaccaagaccttccacttccactccaagcgggtgaccgcccacggggacacgccccagctggacctcaaggcccgcccgacctacggcgccggggaggtgaccgtcctggtggaggtggcggacatggagctgcacaccaagaagatcgagatcagcggcctcaagttcgccgggctgacgtgcaccggctgctacgcctgctccagcggcatctcctgcaaggtccggatccacgtggacgagcccgacgagctgaccgtgcacgtcaagagcgacgaccccgacgtggtggccgcgagctccagcctcatggcccgcaagctggagttcgggaccgactccacgttcaaggccttcagcgccatgcccaagacctccctgtgcttctacatcgtcgagcgggagtactgcaagagctgctccaaggaggacacccagaagtgcgtgaacaccaagctcgagcagccgcagagcatcctgatcgagcacaagggcacgatcatcgggaagcagaacaacacgtgcaccgccaaggcgtcctgctggctggagagcgtcaagtccttcttctacggcctcaagaacatgctcgggggcatcttcggcaacgtgttcatcgggatcttcaccttcctgacccccttcatcctgctgatcctgttcttcatgttcggctggcgcatcctcttctgcttcaagtgctgccgccggacccgcgggctgttcaagtaccggcacctgaaggacgacgaggagaccggctaccgcaagatcatcgagcggctcaacaacaagaagggcaagaaccgcctgctggacggggagcggctcgccgaccgcaagatcgccgagctgttcagcaccaagacccacatcggc

SEQ ID NO: 12119 - RNA, 3495 nt, synthetic construct
  misc_feature 1..3495: note = derived and/or modified CDS sequence (opt1) from CCHVF(CCHVF Kosova Hoti)__EU037902.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccagaagggccgggggcacgtgaagctgtcccgcggcagcgaggtcgtgctcgacgcgtgcgactccaactgcgaggtgatgatccccaaggggacgggcgacatcctggtcgactgcagcggcgggcagcagcacttcctgaaggacaacctcatcgacctgggctgcccccacatcccgctgctcgggaagatggccatctacatctgccggatgtccaaccaccccaagaccaccatggccttcctgttctggttcagcttcggctacgtgatcacgtgcatcttctgcaaggccctgttctactccctcatcatcatcggcaccctggggaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacggcctggcccgccacgtcaagcagtgccccaagcggaaggagaaggtggaggagaccgagctctacctgaacctggagcgcatcccctgggtggtccggaagctcctccaggtgtccgagagcaccggggtggcgctgaagcgctccagctggctcatcgtcctgctggtgctcctgaccgtgagcctgtcccccgtccagagcgccccggtgggccacgggaagacgatcgagacctaccagacccgggagggcttcacctccatctgcctcttcatgctgggcagcatcctgttcatcgtgtcctgcctcgtcaaggggctggtggacagcgtgtccgacagcttcttccccggcctgtccgtctgcaagacgtgcagcatcgggtccatcaacggcttcgagatcgagagccacaagtgctactgctccctcttctgctgcccctactgccgccactgcagcgccgaccgggagatccaccagctgcacctgaacatctgcaagaagcgcaagaccgggtccaacgtgatgctcgccgtctgcaagcggatgtgcttccgcgccaccatcgaggcgagccggcgcgccctgctgatccgctccatcatcaacaccacgttcgtgatctgcatcctcaccctgaccatctgcgtggtcagcacctccgccgtggagatggagaacctgcccgccggcacgtgggagcgggaggaggacctcaccaacttctgccaccaggagtgccaggtgaccgagaccgagtgcctgtgcccgtacgaggccctggtcctgcgcaagcccctcttcctggacagcatcgtgaagggcatgaagaacctgctcaacagcacgtccctggagaccagcctgtccatcgaggcgccctggggcgccatcaacgtgcagagcaccttcaagcccaccgtctccaccgccaacatcgccctcagctggtccagcgtggagcaccgggggaacaagatcctggtgacggggcgctccgagagcatcatgaagctggaggagcggaccggcatctcctgggacctcggggtcgaggacgccagcgagtccaagctgctgaccgtgagcatcatggacctctcccagatgtacagcccggtgttcgagtacctgtccggcgaccgccaggtcgaggagtggcccaaggcgacctgcacgggcgactgcccccagcggtgcgggtgcaccagcagcacgtgcctgcacaaggagtggccccactcccgcaactggcggtgcaacccgacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccccgcaacatccagcagaagctgcccccggagatcatcacgctccaccccaagatcgaggaggggttcttcgacctgatgcacgtccagaaggtgctgtccgccagcaccgtgtgcaagctccagtcctgcacccacggcatccccggggacctgcaggtctaccacatcggcaacctgctcaagggcgaccgggtgaacgggcacctgatccacaagatcgagccgcacttcaacaccagctggatgtcctgggacggctgcgacctggactactactgcaacatgggggactggcccagctgcacgtacaccggcgtgacccagcacaaccacgccgcgttcgtcaacctcctgaacatcgagaccgactacacgaagaccttccacttccactccaagcgcgtgaccgcccacggggacacgccccagctggacctcaaggcccggcccacctacggcgccggcgagatcaccgtgctggtcgaggtggcggacatggagctgcacaccaagaaggtggagatcagcgggctcaagttcgcctccctggcctgcaccggctgctacgcctgcagctccgggatcagctgcaaggtccgcatccacgtggacgagccggacgagctgacggtgcacgtcaagtccagcgaccccgacgtggtggccgcgggcacctccctcatggcccggaagctggagttcgggaccgacagcaccttcaaggccttcagcgccatgcccaagacgtccctgtgcttctacatcgtcgagaaggagtactgcaagagctgctccgaggacgacaccaagaagtgcgtggacaccaagctcgagcagccccagagcatcctgatcgagcaccgcggcaccatcatcggcaagcagaacgacacgtgcaccgccaaggcgtcctgctggctggagagcgtgaagtccttcttctacgggctcaagaacatgctgggcagcgtcttcgggaacttcttcatcggcatcctcctgttcctggccccgttcgtgctgctcgtgctgttcttcatgttcgggtggaagatcctgttctgcttcaagtgctgccggcgcacccgcggcctcttcaagtaccggcacctgaaggacgacgaggagaccggctaccgccggatcatcgagcgcctgaacaacaagaaggggaagaaccggctcctggacggcgagcgcctggccgaccggaagatcgccgagctgttctccaccaagacgcacatcggg

SEQ ID NO: 12120 - RNA, 3495 nt, synthetic construct
  misc_feature 1..3495: note = derived and/or modified CDS sequence (opt1) from CCHVF(CCHVF YL04057)__FJ562094.1__Gn-NSm-Gc
  source 1..3495: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggccgcgagctgggctgctacaccatcaaccgggtgcgctcctacaagctgtgcgagaacagcgcgtccggcaagagctgcgagatcgactccatcccggtcaagtgcaagcaggggttctgcctcaagatcacccaggaggggcggggccacgtgaagctgagccgcgggacggagatcgtgctggacgtctgcgactccagctgcgagctcatgatccccaagggcaccggcgacatcctggtggactgctccgggggccagcagcacttcctgcagaacaacctcatcgacctggggtgccccaacgtgcccctgctcggcaagatggccatctacgtctgccggatgagcaaccacccgaagaccaccatggccttcctgttctggttctccttcggctacgtgatcacgtgcatcgcctgccgcgtgctgttctacctcctgatcgccatcgggaccgtcggcaagaagctgaagcagtaccgggagctcaagccccagacctgcatcgtgtgcgagagcgtgcccgtcaacgcgatcgacgccgagatgcacgagctgaactgctcctacaacatctgcccctactgcgccagccgcctgtccaccgacgggctcatccggcacgtgacgcagtgcccgaagcgccgggagaaggtggaggagaccgagctgttcctgaacctcgagcgcatcccctggctggtccggaagctgctccaggtgagcgagagcaccggcatggccctgaagcgctcctgctggatgatcaccctgctcatcctgctgctcgtgagcatctcccccgtccagagcgcgcccgtggggaaggagcgggccatcgagacgtaccaggcccgcgagacctacaccggcatctgcctgttcgtgctgggctccgtcctcttcgccgtgagctggctgaccaaggccctgatcgacgggatcggcaactccttcttcccggggctcagcgtctgcaagacgtgctccatcggcagcatcaacgggttcgagatcgagtcccacaagtgctactgcagcctgttctgctgcccctactgccgggcgtgctccagcgacaagaacacccaccgcatgcacctgaacgtgtgcaagaagcggaagatgggctccaacgtgatgctcgccgtctgcaagcgcatgtgcttccgcgccaccatcgaggccagcaacaaggccctgctgatccggtccatcatcaacagcaccttcgtgatctgcatcctcatcctgacgatctgcgtggtctccaccagcgcggtggacatggagaacctgcccgccggcatctgggagaaggaggaggacctcaccaacttctgccaccaggagtgccaggtgaccgagacggagtgcctgtgcccctacgaggccatggtcctgcgcaagccgctgttcctcgacagcatcgccaaggggaagaagtccctgctgaacagcacctccctcgagaccagcctgtccatcgaggccccctggggcgcgatcaacgtgcagagcaccttcaagcccacggtgtccgccgccaacatcgccctgagctggtccagcgtcgagcaccgggggaacaagatcctcgtgtccggccgcagcgagtccatcatgaagctggaggagcggaccggggtgagctggaacctgggcgtcgaggacgcctccgagagcaagaccctcaccgtgtccgtgatggacctgagccagatgtacagccccgtcttcgagtacctgtccggcgaccgccaggtggaggagtggccgaaggcgacgtgcaccggggactgccccgagcggtgcggctgcaccagctccacgtgcctccacaaggagtggccccacagccgcaactggcggtgctcccccacctggtgctggggcgtggggaccggctgcacgtgctgcgggctggacgtcaaggacttcttcaccgactacatgctggtgaagtggaaggtggagtacatcaagaccgaggccatcgtctgcgtggagctcaccagccaggagcgccagtgctccctgatcgaggccggcacccggttcaacctggggccggtgaccatcaccctcagcgagccccgcaacgtccagcagcggctgccgcccgagatcgtgacgctgcaccccaagatcgaggagggcttcttcgacctcatgcacgtgcagaagatcctgtccgccagcaccgtctgcaagctgcagtcctgcacccacggggtgcccggcgacttccaggtgtaccacgtcggcaacctcctgcgcggggacaaggtgaacggccacagcatccacaagatcgagccccacttcaacacctcctggatgagctgggacgggtgcgacctggactacttctgcaacatgggcgactggccgtcctgcacgtacaccggggtgacccagcacaaccgggcggccttcatcaacatgctcaacatcgagaccgactacacgaagaccttccacttccacagcaagcgcgtcaccgcccacggcgacacgccccagctggacctgaaggcccggcccgcctacggcgcgggggaggtgaccgtgctcgtcgaggtggccgacctggagctgcacaccaagaagctcgaggtgtccggcctgaagatcgccagcctgacctgctccgggtgctacgcctgcagcagcggcatctcctgcaaggtccgcatccacgtgaacgagcccgacgagttcaccgtgcacgtccggagctccgacccggacgtggtggccgcggggagctccctcatggcccgcaagatcgagttcggcgccgacagcacgttcaaggccttctccagcatgcccaaggactccctgtgcttctacatcgtcgagaaggactactgcagctcctgcaccgacgacgacacccagaagtgcgtgaacaccaagctggaccacccccagagcatcctcatcgagcacaagggcacgatcatcgggaagcagaacgacacgtgctccaccaagaccagctgctggctggagtccgtgaagggcttcttctacgggctgaagaacatgctcagcggcatcttcgggaacgtcttcctgggcatcctcctgttcctggcccccttcgtgctgctcatcttcttcttcttcttcggctggcgcctgctgttctgcctcaagtgctgccggcgcacccgggggctgctgaagtacaagcacctcaaggacgaggaggaggcgggctacaagaagatcatcgagcgcctgaacgggaagaagggcaagtcccagctgttcgacggcgagcggctcgccgaccgcaagatcgccgagctgttcagcaccaagatccacatcggg

SEQ ID NO: 12121 - RNA, 3495 nt, synthetic construct
  misc_feature 1..3495: note = derived and/or modified CDS sequence (opt1) from CCHVF(CCHVF V42/81)__GU477490.1__Gn-NSm-Gc
  source 1..3495: mol_type = other RNA
agcaaggagcccggcgacgactgcatctcccgcacccagctgatgcggaccgagacggccgagatccacgacgacaactacgggggcccgggggacaagatcaccatctgcaacggcagcaccatcgtggaccagcgcctcgggtccgagctgggctgctacaccatcaaccgggtcaagagcttcaagctgtgcgagaactccgccacgggcaaggcgtgcgaggtggacagcacccccgtgaagtgccgccaggggttctgcctcaagatcacccaggagggccgggggcacgtcaagctgtcccgcggcagcgaggtggtgctggacgcctgcgactccagctgcgaggtcatgatccccaaggggaccggcgacatcctcgtggactgctccggcgggcagcagcacttcctgaaggacaacctgatcgacctcgagtgcccccacatcccgctgctgggcaagctcgccatctacatctgccggatgagcaaccacccccgcacgaccatggccttcctgttctggttcgggttcggctacgtgatcacgtgcatcctgtgcaaggccctcttctactccctgatcatcatcggcaccctggggaagaagatcaagcagtaccgggagctcaagccccagacctgcaccatctgcgagaccgcgcccgtcaacgccatcgacgccgagatgcacgacctgaactgcagctacaacatctgcccgtactgcgcctcccgcctgaccagcgacggcctcgcgcggcacgtgacgcagtgccccaagcgcaaggagaaggtggaggagaccgagctgtacctgaacctcgagcggatcccctggatcgtccgcaagctgctccaggtgtccgagagcaccggggtggtcctcaagcggtccagctggctgatcgtgctgctcgtgctgctgaccgtcagcctctcccccgtgcagagcgccccggtgggccacgggaagacgatcgagacctaccagacccgcgagggcttcacctccatctgcctgttcatgctgggcagcatcctcttcatcgtctcctgcatcgtgaaggggctggtggacagcgtctccgacagcttcttccccggcctgtccgtgtgcaagacgtgcagcatctccagcatcaacgggttcgagatcgagtcccacaagtgctactgcagcctcttctgctgcccctactgccggcactgctccgccgaccgcgagatccaccagctgcacctgagcatctgccggaagcgccggaccggctccaacgtcatgctcgccgtgtgcaagcgcatgtgcttccgcgccaccatcgaggtgagccggcgcgcgctgctgatccggtccatcatcaacaccacgttcgtcatctgcatcctcaccctgaccatctgcgtggtgagcaccagcgccgtcgagatggagaacctgcccgccgggacgtgggagcgcgaggaggacctcaccaacttctgccaccaggagtgccaggtgaccgagaccgagtgcctgtgcccgtacgaggccctggtgctgcggaagcccctcttcctggactccatcgtcaagggcaagaagaacctgctcaacagcacgtccctggagaccagcctgtccatcgaggccccctggggcgcgatcaacatccagagcaccttcaagcccaccgtgtccgccgccaacatcgccctcagctggtccagcgtggagcaccgcgggaacaagatcctggtctccggccggagcgagtccatcatgaagctggaggagcgcaccggggtgagctggaacctcggcgtggaggacgcctccgagagcaagctgctgacggtctccatcatggacctcagccagatgtacagcccggtgttcgagtacctgtccggggaccgccaggtggaggagtggcccaaggcgacctgcaccggcgactgccccgagcggtgcggctgcaccagctccacgtgcctgcacaaggagtggccccacagccggaactggcgctgcaacccgacctggtgctggggcgtcgggaccgggtgcacgtgctgcggcgtggacgtgaaggacctcttcatcgaccacatgttcgtcaagtggaaggtggagtacatcaagaccgaggccatcgtgtgcgtcgagctgacctcccaggagcggcagtgcagcctgatcgaggccggcacccgcttcaacctcgggcccgtgaccatcacgctgtccgagccccggaacatccagcagaagctgcccccggagatcatcaccctccaccccaagatcgaggagggcttcttcgacctgatgcacgtgcagaaggtcctgagcgcctccaccgtgtgcaagctccagagctgcacccacgggatccccggcgacctccaggtgtaccacatcgggaacctgctcaagggcgaccgcgtcaacggccacctgatccacaagatcgagccgcacttcaacacgtcctggatgagctgggacgggtgcgacctggactactactgcaacatgggcgactggccctcctgcacctacaccggggtgacccagcacaaccacgccgcgttcgtgaacctcctgaacatcgagacggactacaccaagaccttccacttccacagcaagcgggtcaccgcccacggcgagacgccccagctggacctcaaggcccgccccgcctacggggcgggcgagatcaccgtgctggtggaggtcgccgacatggagctgcacaccaagaaggtggagatctccggcctcaagttcgccagcctggcctgcaccgggtgctacgcctgctccagcggcatctcctgcaaggtgcggatccacgtcgacgagccggacgagctgacggtgcacgtcaagagcaacgaccccgacgtggtggcggccagcacctccctcatggcccgcaagctggagagcgggaccgactccaccttcaaggccttcagcgccatgcccaagacgtccctgtgcttctacatcgtggagcgcgagtactgcaagagctgctccgaggacgacacccagaagtgcgtcgagaccaagctcgagcagccccagagcatcctgatcgagcacaagggcaccatcatcgggaagcagaacgacacgtgcaccgcgaaggcctcctgctggctggagagcgtgaagtccttcttctacggcctcaagaacatgctgggcagcgtgttcgggaacttcttcatcggcatcctgctgttcctggccccgttcgtcctgctcgtgctgttcttcatgttcgggtggaagatcctgttctgcttcaagtgctgccggcgcacccggggcctcttcaagtaccgccacctgaaggaggacgaggagaccgggtaccggcgcatcatcgagcggctgaactccaagaagggcaagaaccgcctcctggacggcgagcggctggccgaccgcaagatcgccgagctgttcagcaccaagacgcacatcggg

SEQ ID NO: 12122 - RNA, 3495 nt, synthetic construct
  misc_feature 1..3495: note = derived and/or modified CDS sequence (opt1) from CCHVF(CCHVF 79121M18)__GU477493.1__Gn-NSm-Gc
  source 1..3495: mol_type = other RNA
gccgagggcgggagctccgactgcatcagccgcacccagctcgtgaagaccgaggtcgccgagatccacgaggactcctacggcgggcccggcgagaagatcacgatctgcaacgggagcaccatcgtggaccagggcctcggctccgagctggggtgctacaccatcaaccgggtgcgcagctacaagctgtgcgagaactccgcgagcggcaagtcctgcgagatcgacagcatcccggtcaagtgcaagcaggggttctgcctcaagatcacccaggagggccgggggcacgtgaagctgtcccgcggcacggagatcgtgctggacgtctgcgacagctcctgcgagctcatgatccccaagggcaccggggacatcctggtggactgcagcggcgggcagcagcacttcctgcagaacaacctcatcgacctgggctgccccaacgtgcccctgctcggcaagatggccatctacgtctgccggatgtccaaccacccgaagaccaccatggccttcctgttctggttcagcttcgggtacgtgatcacgtgcatcgcctgccgcgtgctgttctacctcctgatcgccatcggcaccgtcgggaagaagctgaagcagtaccgggagctcaagccccagacctgcatcgtgtgcgagtccgtgcccgtcaacgcgatcgacgccgagatgcacgagctgaactgcagctacaacatctgcccctactgcgcctcccgcctgagcaccgacggcctcatccggcacgtgacgcagtgcccgaagcgccgggagaaggtggaggagaccgagctgttcctgaacctcgagcgcatcccctggctggtccggaagctgctccaggtgagcgagtccaccgggatggccctgaagcgcagctgctggatgatcaccctgctcatcctgctgctcgtgtccatcagccccgtccagtccgcgcccgtgggcaaggagcgggccatcgagacgtaccaggcccgcgagacctacaccggcatctgcctgttcgtgctggggagcgtcctcttcgccgtgtcctggctgaccaaggccctgatcgacggcatcgggaacagcttctccccgggcctcagcgtctgcaagacgtgctccatcgggagcatcaacggcttcgagatcgagtcccacaagtgctactgcagcctgttctgctgcccctactgccgggcgtgctccagcgacaagaacacccaccgcatgcacctgaacgtgtgcaagaagcggaagatgggctccaacgtgatgctcgccgtctgcaagcgcatgtgcttccgggccaccatcgaggccagcaacaaggccctgctgatccgctccatcatcaacagcaccttcgtgatctgcatcctcatcctgacgatctgcgtggtcagcacctccgcggtggacatggagaacctgcccgccgggatctgggagaaggaggaggacctcaccaacttctgccaccaggagtgccaggtgaccgagacggagtgcctgtgcccctacgaggccatggtcctgcgcaagccgctgttcctcgacagcaccgccaagggcatgaagtccctgctgaacagcacctccctcgagaccagcctgtccatcgaggccccctggggcgcgatcaacgtgcagagcacgttcaagcccaccgtgtccgccgccaacatcgccctgagctggtccagcgtcgagcaccgggggaacaagatcctcgtgtccgggcgcagcgagtccatcatgaagctggaggagcggaccggcgtgagctggaacctgggcgtcgaggacgcctccgagagcaagaccctcacggtgagcgtgatggacctgtcccagatgtacagccccgtcttcgagtacctgtccggggaccgccaggtggaggagtggccgaaggcgacctgcaccggcgactgccccgagcggtgcgggtgcaccagctccacgtgcctccacaaggagtggccccacagccgcaactggcggtgcaaccccacctggtgctggggcgtgggcaccgggtgcacgtgctgcggcctggacgtcaaggacttcttcaccgactacatgctggtgaagtggaaggtggagtacatcaagaccgaggccatcgtctgcgtggagctcacctcccaggagcgccagtgcagcctgatcgaggccgggacccggttcaacctgggcccggtgaccatcacgctctccgagccccgcaacgtccagcagcggctgccgcccgagatcgtgaccctgcaccccaagatcgaggaggggttcttcgacctcatgcacgtgcagaagatcctgagcgcctccaccgtctgcaagctgcagagctgcacccacggcgtgcccggcgacttccagatctaccacgtggggaacctcctgcgcggcgacaaggtcaacgggcactccatccacaagatcgagccccacttcaacacgagctggatgtcctgggacggctgcgacctggactacttctgcaacatgggggactggccgagctgcacctacaccggcgtgacccagcacaaccgggcggccttcatcaacatgctcaacatcgagacggactacaccaagaccttccacttccactccaagcgcgtgaccgcccacggcgacacgccccagctggacctgaaggcccggcccgcctacggggcgggcgaggtcaccgtgctcgtggaggtcgccgacctggagctgcacaccaagaagctcgaggtgagcgggctgaagatcgcctccctgacctgcagcggctgctacgcctgcagctccgggatcagctgcaaggtgcgcatccacgtcaacgagcccgacgagttcacggtgcacgtgcggtccagcgacccggacgtcgtggccgcgggctccagcctcatggcccgcaagatcgagttcggcgccgactccaccttcaaggccttcagctccatgcccaaggacagcctgtgcttctacatcgtggagaaggactactgctccagctgcaccgacgacgacacccagaagtgcgtcaacacgaagctggaccacccccagtccatcctcatcgagcacaaggggaccatcatcggcaagcagaacgacacgtgcagcaccaagacctcctgctggctggagagcgtgaaggggttcttctacggcctgaagaacatgctctccgggatcttcggcaacgtgttcctgggcatcttcctgttcctcgcccccttcgtcctgctgatcttcttcttcttcttcgggtggcggctcctgttctgcctgaagtgctgccgccgcacccggggcctcctgaagtacaagcacctgaaggacgaggaggaggcggggtacaagaagatcatcgagcgcctcaacggcaagaagggcaagagccagctgttcgacggggagcggctggccgaccgcaagatcgccgagctgttctccaccaagatccacatcggc

SEQ ID NO: 12123 - RNA, 3495 nt, synthetic construct
  misc_feature 1..3495: note = derived and/or modified CDS sequence (opt1) from CCHVF(CCHVF Afg09-2990)__HM452306.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcactacctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctgagcgtgtgcaagacgtgctccatcgggagcatcaacggcttcgagatcgagtcccacaagtgctactgcagcctcttctgctgcccctactgccggcactgctccgccgacggcgagatccaccagctgcacctgagcatctgcaagaagcgcaagaccgggtccaacgtcatgctcgcggtgtgcaagcggatgtgcttccgcgccaccatggaggtgagcaacaaggccctgttcatccgctccatcatcaacaccacgttcgtcgtgtgcatcctgatcctcgccgtgtgcgtcgtgagcacctccgccgtggagatggagagcctgcccgcgggcacctgggagcgggaggaggacctgaccaacttctgccaccaggagtgccaggtcacggagaccgagtgcctctgcccctacgaggccctggtgctgcgccggccgctgttcctcgacagcatcgtgaaggggatgaagaacctgctgaactccaccagcctcgagacctccctgagcatcgaggccccctggggcgccatcaacgtccagtccacgtacaagcccaccgtgagcaccgccaacatcgcgctgtcctggagctccgtggagcaccgcgggaacaaggtcctcgtgagcggccggtccgagagcatcatgaagctggaggagcgcaccggcatctcctgggacctgggggtggaggacgccagcgagtccaagctcctgaccgtcagcgtgatggacctgtcccagatgtacagccccgtgttcgagtacctcagcggcgaccggcaggtcgaggagtggccgaaggccacgtgcaccggggactgccccgagcgctgcggctgcacctccagcacgtgcctgcacaaggagtggccccactcccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcggcagtgctccctgatcgaggccggcacccgcttcaacctcgggagcgtgaccatcacgctgtccgagccgcggaacatccagcagaagctgccgcccgagatcatcaccctccaccccaagatcgaggagggcttcttcgacctgatgcacgtgcagaaggtcctgagcgcgtccaccgtgtgcaagctccagagctgcacccacggcgtgcccggggacctgcaggtctaccacatcggcaacctgctcaagggggaccgcgtgaacggccacctgatccacaagatcgagcagcacttcaacacgtcctggatgagctgggacgggtgcgacctggactactactgcaacatgggcgactggccctcctgcacctacaccggcgtgacccagcacaaccacgccagcttcgtcaacctcctgaacatcgagacggactacaccaagaccttccacttccactccaagcgggtgaccgcccacggggacacgccccagctggacctcaaggcccgcccgacctacggcgccggggagatcaccgtgctggtcgaggtggcggacatggagctgcacaccaagaagatcgagatcagcggcctcaagttcgccgggctgacgtgcaccggctgctacgcctgctccagcggcatctcctgcaaggtgcggatccacgtcgacgagcccgacgagctgaccgtgcacgtcaagagcgacgaccccgacgtggtggccgcgagctccagcctcatggcccgcaagctggagttcgggaccgactccacgttcaaggccttcagcgccatgcccaagacctccctgtgcttctacatcgtggagcgggagtactgcaagagctgctccaaggaggacacccagaagtgcgtcaacaccaagctcgagcagccgcagagcatcctgatcgagcacaagggcacgatcatcgggaagcagaacaacacgtgcaccgccaaggcgtcctgctggctggagagcgtgaagtccttcttctacggcctcaagaacatgctcgggggcatcttcggcaacgtcttcatcgggatcttcaccttcctgacccccttcatcctgctgatcctgttcttcatgttcggctggcgcatcctcttctgcttcaagtgctgccgccggacccgcgggctgttcaagtaccggcacctgaaggacgacgaggagaccggctaccgcaagatcatcgagcggctcaacaacaagaagggcaagaaccgcctgctggacggggagcggctcgccgaccgcaagatcgccgagctgttcagcaccaagacccacatcggc

SEQ ID NO: 12124 - RNA, 3495 nt, synthetic construct
  misc_feature 1..3495: note = derived and/or modified CDS sequence (opt1) from CCHVF(CCHVF Sudan Al-Fulah 3-2008)__HQ378184.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcgtggacctgggctgccccaagatcccgctgctcgggaagatggccatctacatctgccgcatgtccaaccaccccaagacgaccatggccttcctgttctggttcagcttcggctacgtcatcacgtgcatcctgtgcaaggccatcttctacctcctgatcatcatcggcaccctggggaagcggttccgccagtaccgggagctcaagccccagacctgcaccatctgcgagaccacccccgtgaacgccatcgacgcggagatgcacgacctgaactgctcctacaacatctgcccgtactgcgccagccgcctgacgtccgacggcctcgcccggcacgtgacccagtgccccaagcgcaaggagaaggtcgaggagaccgagctgtacctgaacctcgagcggatcccctgggtggtgcgcaagctgctgcaggtcagcgagtccaccggggtggccctcaagcggagcagctggctgatcgtgctgctcgtcctgttcacggtgtccctgagccccgtgcagtccgcgccgatcggccacgggaagaccatcgaggcctaccgcgcccgggagggctacaccagcatctgcctcttcgtcctgggctccatcctgttcatcgtgagctgcctcatgaaggggctggtggactccgtcggcaacagcttcttccccgggctgtccatctgcaagacctgcagcatctccagcatcaacggcttcgagatcgagtcccacaagtgctactgcagcctcttctgctgcccctactgccgccactgctccgccgacaaggagatccacaagctgcacctgagcatctgcaagaagcggaagacggggtccaacgtgatgctcgccgtctgcaagcgcatgtgcttccgcgcgaccatggaggtgagcaaccgggccctgttcatccgctccatcatcaacaccaccttcgtgctgtgcatcctcatcctggccgtctgcgtggtgagcacgagcgccgtcgagatggagaacctgcccgccggcacctgggagcgggaggaggacctcaccaacttctgccaccaggagtgccaggtgaccgagacggagtgcctgtgcccgtacgaggcgctggtgctgcgccggcccctcttcctggactccatcgtcaagggcatgaagaacctgctcaacagcacctccctggagaccagcctgtccatcgaggccccctggggcgccatcaacgtgcagagcacctacaagcccacggtgtccaccgccaacatcgccctcagctggtccagcgtcgagcaccgcgggaacaagatcctggtgtccgggcggagcgagtccatcatgaagctggaggagcgcaccggcatcagctgggacctcggggtggaggacgcgtccgagagcaagctgctgaccgtctccgtgatggacctcagccagatgtacagcccggtgttcgagtacctgtccggcgaccggcaggtcgaggagtggcccaaggcgacctgcacgggcgactgccccgagcgctgcgggtgcaccagctccacgtgcctgcacaaggagtggccccacagccggaactggcgctgcaacccgacctggtgctggggcgtggggaccggctgcacgtgctgcggcctcgacgtgaaggacctgttcaccgactacatgttcgtcaagtggaaggtggagtacatcaagaccgaggccatcgtgtgcgtcgagctgacctcccaggagcggcagtgcagcctcatcgaggccgggacccgcttcaacctgggccccgtgaccatcaccctgtccgagccccggaacatccagcagaagctgcccccggagatcatcacgctccacccccgcatcgaggaggggttcttcgacctgatgcacgtgcagaaggtcctcagcgcctccaccgtgtgcaagctgcagagctgcacccacggcgtgcccggggacctgcaggtctaccacatcggcaacctcctgaagggcgacaaggtgaacgggcacctgatccacaagatcgagccgcacttcaacacctcctggatgagctgggacggctgcgacctcgactactactgcaacatgggggactggccctcctgcacgtacaccggcgtgacccagcacaaccacgccagcttcgtcaacctgctgaacatcgagaccgactacacgaagaacttccacttccactccaagcgggtgaccgcccacggggacacgccccagctcgacctgaaggcccgccccacctacggcgccggcgagatcaccgtgctggtcgaggtggcggacatggagctccacaccaagaagatcgagatcagcgggctgaagttcgcctccctgacctgcaccggctgctacgcctgcagctccgggatcagctgcaaggtgcggatccacgtcgacgagccggacgagctcacggtgcacgtcaagagcgacgaccccgacgtggtggccgcctccagctccctgatggcgcgcaagctggagttcggcaccgacagcaccttcaaggccttctccgccatgcccaagaccagcctctgcttctacatcgtggagaaggagtactgcaagtcctgcagcgaggaggacacgaagaagtgcgtcaacaccaagctggagcagccccagtccatcctgatcgagcacaaggggaccatcatcggcaagcagaacagcacgtgcaccgccaaggtgtcctgctggctcgagagcgccaagtccttcttctacggcctgaaggacatgctgagcgggatcttcggcaacgtgttcatcgggatcttcctcttcctggcgccgttcgtcctgctcgtgctgttcttcatgttcggctggcgcatcctgctctgcttccggtgctgccgccggacccgcgggctgttcaagtaccggcacctgaaggacgacgaggagaccggctaccgccggatcatcgagcgcctcaacaacaagaagggcaagaacaagctgctggacggggagcggctcgccgaccgcaagatcgccgagctgttctccaccaagacccacatcggc

SEQ ID NO: 12125 - RNA, 3495 nt, synthetic construct
  misc_feature 1..3495: note = derived and/or modified CDS sequence (opt1) from CCHVF(CCHVF Sudan AB1-2009)__HQ378187.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacctgatcacgtgcatcctctgcaaggccatcttctacctgctgatcatcatcggcaccctcgggaagcggctgaagcagtaccgcgagctgaagccccagacctgcaccatctgcgagaccacccccgtgaacgccatcgacgcggagatgcacgacctcaactgcagctacaacatctgcccgtactgcgcctcccggctgacgagcgacggcctggcccgccacgtgatccagtgccccaagcggaaggagaaggtcgaggagaccgagctctacctgaacctggagcgcatcccctgggtggtgcggaagctcctgcaggtctccgagagcaccggggtggccctgaagcgctccagctggctcatcgtgctgctggtcctcttcaccgtgagcctgtcccccgtgcagagcgcgccgatcggccaggggaagacgatcgaggcctaccgggcccgcgagggctacacctccatctgcctgttcgtcctcggcagcatcctgttcatcgtgtcctgcctgatgaaggggctcgtggacagcgtcggcaactccttcttccccgggctgagcatctgcaagacctgctccatcagctccatcaacggcttcgagatcgagagccacaagtgctactgctccctgttctgctgcccctactgccggcactgcagcaccgacaaggagatccacaagctccacctgtccatctgcaagaagcgcaagacggggagcaacgtgatgctggccgtgtgcaagcggatgtgcttccgcgccaccatggaggtctccaaccgcgccctcttcatccggagcatcatcaacaccaccttcgtgctgtgcatcctgatcctcgccgtctgcgtggtgtccacgagcgccgtcgagatggagaacctgcccgccggcacctgggagcgcgaggaggacctgaccaacttctgccaccaggagtgccaggtgaccgagacggagtgcctgtgcccgtacgaggccctcgtgctgcggaagcccctgttcctcgacagcatcgcgaagggcatgaagaacctgctgaactccaccagcctcgagacctccctgagcatcgaggccccctggggcgccatcaacgtccagtccacctacaagcccacggtgagcaccgccaacatcgccctgtcctggagctccgtggagcaccgcgggaacaagatcctcgtcagcgggcggtccgagagcatcatgaagctggaggagcgcaccggcatctcctgggacctgggggtggaggacgcgagcgagtccaagctcctgaccgtgagcgtcatggacctgtcccagatgtacagcccggtgttcgagtacctcagcggcgaccgccaggtggaggagtggcccaaggcgacctgcacgggcgactgccccgagcggtgcgggtgcacctccagcacgtgcctgcacaaggagtggccccactcccggaactggcgctgcaacccgacctggtgctggggcgtcgggaccggctgcacgtgctgcggcctggacgtgaaggacctcttcaccgactacatgttcgtgaagtggaaggtcgagtacatcaagaccgaggccatcgtgtgcgtggagctgaccagccaggagcggcagtgctccctgatcgaggccgggacccgcttcaacctcggccccgtcaccatcaccctgagcgagccccggaacatccagcagaagctgcccccggagatcatcacgctccacccccgcatcgaggaggggttcttcgacctgatgcacgtgcagaaggtgctgtccgccagcaccgtctgcaagctccagtcctgcacccacggcgtgcccggggacctccaggtgtaccacatcggcaacctgctgaagggcgacaaggtcaacgggcacctgatccacaagatcgagccgcacttcaacaccagctggatgtcctgggacggctgcgacctggactactactgcaacatgggggactggcccagctgcacgtacaccggcgtgacccagcacaaccacgcgtccttcgtgaacctcctgaacatcgagaccgactacacgaagaacttccacttccacagcaagcgggtcaccgcccacggggacacgccccagctggacctcaaggcccgccccacctacggcgccggcgagatcaccgtgctggtggaggtcgcggacatggagctgcacaccaagaagatcgagatctccgggctcaagttcgccagcctgacctgcaccggctgctacgcctgctccagcgggatctcctgcaaggtgcggatccacgtggacgagccggacgagctgacggtccacgtcaagagcgacgaccccgacgtggtggccgccagctccagcctcatggcgcgcaagctggagttcggcaccgactccaccttcaaggccttcagcgccatgcccaagacctccctgtgcttctacatcgtggagcgggagcactgcaagagctgcaacgaggaggacacgaagaagtgcgtgaacaccaagctcgagcagccccagtccatcctgatcgagcacaaggggaccatcatcggcaagcagaacagcacgtgcaccgcccgcgcctcctgctggctggagagcgtcaagtccttcttctacggcctcaagaacatgctgagcgggatcttcggcaacgtgttcatggggatcttcctgttcctcgcgccgttcatcctgctgatcctcttcttcatgttcggctggcgcatcctgttctgcttcaagtgctgccggcgcacccgggggctgttcaagtaccgccacctcaaggacgacgaggagaccggctaccggcgcatcatcgagcggctgaacaacaagaagggcaagaacaagctgctcgacggggagcgcctggccgaccggcgcatcgccgagctgttctccaccaagacccacatcggc

SEQ ID NO: 12126 - RNA, 3495 nt, synthetic construct
  misc_feature 1..3495: note = derived and/or modified CDS sequence (opt1) from CCHVF(CCHVF NIVA 118595)__JN572083.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacccaggaggggcggggccacgtgaagctgtcccgcgggagcgaggtggtcctcgacgcgtgcgactccagctgcgaggtgatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtcatcacgtgcatcctgtgcaaggtgatcttctacctcctgatcatcttcgggaccctgggcaagcgcttcaagcagtaccgggagctcaagccccagacctgcaccatctgcgagaccacccccgtgaacgccatcgacgccgagatgcacgacctgaactgcagctacaacatctgcccctactgcgcgtcccgcctgaccagcgacgggctcgcccggcacgtcacgcagtgcccgaagcgcaaggagaaggtggaggagaccgagctgtacctgaacctcgagcggatcccctgggtggtccgcaagctgctccaggtgtccgagagcaccggcatcgccctgaagcggagctcctggctgatcgtgctgctcgtcctgttcaccgtgagcatcacgcccgtgcagtccgcccccatcgggcacggcaagaccatcgaggcgtaccgcgcccgggaggagtacaccagcatctgcctgttcgtcctcggctccgtgctgttcgtggtcagctgcctgatgaaggggctcgtggactccgtcggcaacatcttcttcccggggctgttcatctgcaagacctgcagcatcggctccatcaacgggttcgagatcgagagccacaagtgctactgctccctgttctgctgcccctactgccgccactgcagcgccgaccgggagatccaccagctccacctgtccatctgcaagaagcgcaagacgggcagcaacgtgatgctggccgtgtgcaagcggatgtgcttccgcaccaccatggaggtctccaacaaggccctcttcgtgcgcagcatcatcaacaccacgttcgtggtctgcatcctgatcctggcggtgtgcgtggtctccaccagcgccgtggagatggagtccctccccgccggcacctgggagcgggaggaggacctgaccaacttctgccaccaggagtgccaggtgacggagaccgagtgcctgtgcccctacgaggccctcgtcctgcgccggccgctgttcctggacagcatcgtgaaggggatgaagaacctcctgaacagcacctccctggagaccagcctctccatcgaggccccctggggcgcgatcaacgtgcagagcacgtacaagcccaccgtctccgccgccaacatcgccctgagctggtccagcgtggagcaccgcgggaacaagatcctggtgtccggccggagcgagtccatcatgaagctcgaggagcgcaccgggatcagctgggacctgggcgtcgaggacgcctccgagagcaagctgctcaccgtgtccgtgatggacctgagccagatgtactcccccgtcttcgagtacctgagcggcgaccgccaggtggaggagtggccgaaggcgacctgcacgggggactgccccgagcggtgcggctgcaccagctccacgtgcctccacaaggagtggccccacagccggaactggcgctgcaaccccacctggtgctggggcgtggggaccggctgcacgtgctgcgggctggacgtcaaggacctgttcaccgactacatgttcgtgaagtggaaggtggagtacatcaagaccgaggccatcgtctgcgtggagctcacctcccaggagcggcagtgcagcctgatcgaggccggcacccgcttcaacctggggtccgtgaccatcaccctcagcgagccgcggaacatccagcagaagctgccgcccgagatcatcacgctgcacccccgcatcgaggagggcttcttcgacctcatgcacgtccagaaggtgctgtccgccagcaccgtgtgcaagctgcagtcctgcacccacggggtccccggcgacctccaggtgtaccacatcggcaacctgctgaagggggaccgggtgaacggccacctcatccacaagatcgagcagcacctgaacaccagctggatgtcctgggacgggtgcgacctggactactactgcaacatgggcgactggcccagctgcacgtacaccggggtcacccagcacaaccacgcctccttcgtgaacctcctgaacatcgagaccgactacacgaagaccttccacttccacagcaagcgcgtgaccgcgcacggcgacacgccccagctggacctcaaggcccggccgacctacggcgccggggagatcaccgtcctggtggaggtggccgacatggagctgcacaccaagaagatcgagatctccggcctcaagttcgcgagcctgtcctgcaccgggtgctacgcctgcagctccggcatcagctgcaaggtccgcatccacgtggacgagcccgacgagctgacggtgcacgtcaagagcgacgaccccgacgtggtggccgcctccagctccctcatggcccggaagctggagagcgggaccgactccaccttcaaggcgttcagcgccatgcccaagacctccctgtgcttctacatcgtcgagcgcgagtactgcaagggctgcagcaaggaggacacgcagaagtgcgtgaacaccaagctcgagcagccgcagtccatcctgatcgagcacaagggcaccatcatcgggaagcagaacaacacgtgcaccgccaaggccagctgctggctggagtccgtcaagagcttcttctacggcctcaagaacatgctgtccgggatcttcggcaacgtgttcctggggatcttcagcttcctcgcccccttcgtgctgctgatcctcttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaacaagctgctcgacggggagcggctggcggaccgcaagatcgccgagctgttctccaccaagacccacatcggc

SEQ ID NO: 12127 - RNA, 3495 nt, synthetic construct
  misc_feature 1..3495: note = derived and/or modified CDS sequence (opt1) from CCHVF(CCHVF NIV 112143)__JN572085.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacccaggaggggcggggccacgtgaagctgtcccgcgggagcgaggtggtcctcgacgcgtgcgactccagctgcgaggtgatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtcatcacctgcatcctgtgcaaggtgatcttctacctcctgatcatcttcgggaccctgggcaagcgcttcaagcagtaccgggagctcaagccccagacctgcacgatctgcgagaccacccccgtgaacgccatcgacgccgagatgcacgacctgaactgcagctacaacatctgcccctactgcgcgtcccgcctgaccagcgacgggctcgcccggcacgtcacgcagtgcccgaagcgcaaggagaaggtggaggagaccgagctgtacctgaacctcgagcggatcccctgggtggtccgcaagctgctgcaggtgtccgagagcaccggcatcgccctcaagcggagctcctggctgatcgtgctgctcgtcctgttcaccgtgagcatcacgcccgtgcagtccgcccccatcgggcacggcaagaccatcgaggcgtaccgcgcccgggaggagtacaccagcatctgcctgttcgtcctcggctccgtgctgttcgtggtcagctgcctgatgaaggggctcgtggactccgtcggcaacatcttcttcccggggctgttcatctgcaagacctgcagcatcggctccatcaacgggttcgagatcgagagccacaagtgctactgctccctgttctgctgcccctactgccgccactgcagcgccgaccgggagatccaccagctccacctgtccatctgcaagaagcgcaagacgggcagcaacgtgatgctggccgtgtgcaagcggatgtgcttccgcgccaccatggaggtctccaacaaggcgctcttcgtgcgcagcatcatcaacaccaccttcgtggtctgcatcctgatcctggccatctgcgtggtgtccacgagcgccgtcgagatggagtccctccccgccggcacctgggagcgggaggaggacctgaccaacttctgccaccaggagtgccaggtgaccgagacggagtgcctgtgcccctacgaggccctcgtgctgcgccggccgctgttcctggacagcatcgtcaaggggatgaagaacctcctgaacagcacctccctggagaccagcctctccatcgaggcgccctggggcgccatcaacgtgcagagcacctacaagcccacggtgtccgccgccaacatcgccctgagctggtccagcgtcgagcaccgcgggaacaagatcctggtgtccggccggagcgagtccatcatgaagctcgaggagcgcaccgggatcagctgggacctgggcgtggaggacgcgtccgagagcaagctgctcaccgtctccgtgatggacctgagccagatgtactcccccgtgttcgagtacctgagcggcgaccggcaggtcgaggagtggccgaaggccacctgcaccggggactgccccgagcgctgcggctgcacgagctccacctgcctccacaaggagtggccccacagccggaactggcgctgcaaccccacctggtgctggggggtgggcaccggctgcacgtgctgcgggctggacgtgaaggacctgttcaccgactacatgttcgtcaagtggaaggtggagtacatcaagaccgaggccatcgtgtgcgtcgagctcacctcccaggagcggcagtgcagcctgatcgaggccggcacgcgcttcaacctggggtccgtgaccatcaccctcagcgagccgcggaacatccagcagaagctgccccccgagatcatcaccctgcacccccgcatcgaggagggcttcttcgacctcatgcacgtgcagaaggtcctgtccgccagcacggtgtgcaagctgcagtcctgcacccacggggtgccgggcgacctccaggtctaccacatcggcaacctgctgaagggggaccgggtgaacggccacctcatccacaagatcgagcagcacctgaacaccagctggatgtcctgggacgggtgcgacctggactactactgcaacatgggcgactggcccagctgcacctacacgggggtgacccagcacaaccacgcgtccttcgtcaacctcctgaacatcgagaccgactacaccaagacgttccacttccacagcaagcgcgtgaccgcccacggcgacaccccccagctggacctcaaggcccggccgacctacggcgccggggagatcacggtgctggtcgaggtggcggacatggagctgcacaccaagaagatcgagatctccggcctcaagttcgccagcctgtcctgcaccgggtgctacgcctgcagctccggcatcagctgcaaggtgcgcatccacgtcgacgagcccgacgagctgaccgtgcacgtgaagagcgacgaccccgacgtcgtggccgcctccagctccctcatggcgcggaagctggagttcgggacggacagcaccttcaaggccttctccgccatgcccaagaccagcctgtgcttctacatcgtggagcgcgagtactgcaagggctgctccaaggaggacacccagaagtgcgtcaacacgaagctcgagcagccgcagagcatcctgatcgagcacaagggcaccatcatcgggaagcagaacaacacctgcaccgccaaggcctcctgctggctggagagcgtgaagtccttcttctacggcctcaagaacatgctgagcgggatcttcggcaacgtgttcctggggatcttctccttcctcgcgcccttcgtcctgctgatcctcttcttcatgttcggctggcgcatcctgttctgcttcaagtgctgccggcgcacgcggggcctgttcaagtaccgccacctcaaggacgacgaggagaccgggtaccggaagatcatcgagcgcctgaacaacaagaagggcaagaacaagctgctcgacggggagcggctggccgaccgcaagatcgccgagctgttcagcaccaagacccacatcggc

SEQ ID NO: 12128 - RNA, 3495 nt, synthetic construct
  misc_feature 1..3495: note = derived and/or modified CDS sequence (opt1) from CCHVF(CCHVF SCT ex Afghanistan)__KC344856.1__Gn-NSm-Gc
  source 1..3495: mol_type = other RNA
agcgaggagtccggcgacgactgcatcagccgcacccagctgctccggaccgagacggccgaggtgcacaacgacaactacgggggccccggggacaagatcaccatctgcaacggctccaccatcgtcgaccagcgcctggggagcgagctgggctgctacaccatcaaccgggtgaagtccttcaagctctgcgagaacagcgccacgggcaagtcctgcaagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtgatcacctgcatcttctgcaaggtgatcttctacctgctcatcgtcgtgggcaccctggggaagaagttcaagcagtaccgcgagctgaagccccagacgtgcaccatctgcgagaccacccccacgaacgccatcgacgccgagatgcacgacctcaactgcagctacaacatctgcccctactgcgcgtcccggctgaccagcgacggcctggcccgccacgtgacccagtgcccgaagcggaaggagaaggtcgaggagaccgagctctacctgaacctggagcgcatcccctggatcgtgcggaagctcctgcaggtgtccgagagcacgggggtcgccctgaagcgcagctcctggctcatcgtgctgctggtgctcctgaccgtcagcctgtcccccgtgcagagcgcccccatcggccacgggaagaccatcgagacctaccagacgcgggagggctacatctccgtgtgcctcttcgtcctgggcgggatcctgttcgtggtgagctgcctcatcaagggcctggtcgactccgtggggaacagcttcttcccgggcctgtccatctgcaagacctgcagcatcgggtccgtcaacggcttcgagatcgagagccacaagtgctactgctccctcctgtgctgcccctactgccgccactgcagcaccgaccgggagatccaccagctgcacctctccatctgcaagaagcgccggaccggcgggaacgtgatgctggcggtgtgcaagcgcatgtgcttccgggccacgatggaggtcagcaacaaggtgctgttcatccgcaacatcatcaacaccaccttcgtgatctgcatcctcatcctggccgtctgcgtggtgtccaccagcgccgtcgagatggagtccctgcccgccggcacgtgggagcgcgaggaggacctcaccaacttctgccaccaggagtgccaggtgaccgagaccgagtgcctgtgcccctacgaggcgctggtgctgcggaagccgctcttcctgaacagcatcgtcaaggggatgaagaacctgctcaacagcacgaacctggagacctccctgagcatcgaggccccctggggcgccatcaacgtgcagtccaccttcaagcccaccgtgagcaccgccaacatcgccctctcctggagctccgtcgagcaccgcgggaacaagatcctggtgagcggccggtccgagagcatcatgaagctggaggagcgcacgggcatctcctgggacctcggggtggaggacgcgagcgagtccaagagcctgaccgtctccgtgatggacctgagccagatgtactcccccgtgttcgagtacctcagcggcgaccggcaggtcgaggagtggccgaaggccacctgcaccggggactgccccgagcgctgcggctgcacgagctccacctgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcgggccggtgaccatcaccctgtccgagccccggaacatccagcagaagctgccccccgagatcatcaccctccacccgcgcatcgaggagggcttcttcgacctgatgcacgtgcagaaggtcctgagcgcctccacggtgtgcaagctccagagctgcacccacggcgtgcccggggacctgcaggtctaccacatcggcaacctgctcaagggggacaagctgaacggccacatgatccacaagatcgagccccacttcaacacctcctggatgagctgggacgggtgcgacctggactactactgcaacatgggcgactggccgtcctgcacctacacgggcgtgacccagcacaaccacgcggccttcgtgaacctcctgaacatcgagaccgactacaccaagaacttccacttccacagcaagcgggtcacggcccacggggacaccccccagctggacctcaaggcccgccccacctacggcgccggggagatcaccgtgctggtggaggtcgcggacatggagctgcacacgaagaagatcgacatctccggcctcaagttcgccagcctgacctgcgccgggtgctacgcctgctccagcggcatctcctgcaaggtgcggatccacgtggacgagcccgacgagctgaccgtccacgtgaagagcgaggacccggacatcgtggcggcctccaccagcctcatcgcccgcaagctggagctgggcacggacagcaccttcaaggccttctccgccatgcccaagaccagcctctgcttctacatcgtcgagcgggagtactgcaagtcctgcagcaaggaggacacccagaagtgcgtgaacacgaagctggagcacccccaggggatcctgatcgagcacaagggcaccatcatcgggaagcagaacgacacctgcaccgcgaaggccggctgctggctcgagtccgtgaagagcttcttctacgggctgaagaacatgctgtccggcatcttcggcaacgtcttcatcgggatcttcctcttcctggcccccttcgtgctgctcatcctgttcttcatgttcggctggcgcctgctcttctgcttcaagtgctgccggcgcacccgcgggctgttcaagtaccggcacctgaaggaggacgaggagagcggctaccgccggatcatcgagcgcctcaacaacaagaagggcaagaacaagctgctggacggggagcggctcgccgaccgccggatcgccgagctgttctccacgaagacccacatcggc

SEQ ID NO: 12129 - RNA, 3495 nt, synthetic construct
  misc_feature 1..3495: note = derived and/or modified CDS sequence (opt1) from CCHVF(CCHVF Zahedan 2007)__KC867273.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggcttctgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctcaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctgagcgtgtgcaagacgtgctccatcgggagcatcaacggcttcgagatcgagtcccaccggtgctactgcagcctcttctgctgcccctactgccgccactgctccgccgacggcgagatccaccagctgcacctgagcatctgcaagaagcggaagaccgggtccaacgtcatgctcgcggtgtgcaagcgcatgtgcttccgcgccaccatggaggtgagcaacaaggtcctgttcatccggtccatcatcaacaccacgttcgtggtgtgcatcctgatcctcgccgtctgcgtggtgagcacctccgccgtcgagatggagagcctgcccgccggcacctgggagcgcgaggaggacctgaccaacttctgccaccaggagtgccaggtgacggagaccgagtgcctctgcccctacgaggcgctggtgctgcggcgcccgctgttcctcgacagcatcgtcaaggacatgaagaacctgctgaactccaccagcctcgagacctccctgagcatcgaggccccctggggcgccatcaacgtgcagtccacgtacaagcccaccgtgagcaccgccaacatcgccctgtcctggagctccgtcgagcaccgggggaacaaggtgctcgtgagcgggcgctccgagagcatcatgaagctggaggagcggaccggcatctcctgggacctgggcgtcgaggacgcgagcgagtccaagctcctgaccgtgagcgtgatggacctgtcccagatgtacagccccgtcttcgagtacctcagcggggaccgccaggtggaggagtggccgaaggccacgtgcaccggcgactgccccgagcggtgcgggtgcacctccagcacgtgcctgcacaaggagtggccccactcccgcaactggcggtgcaaccccacctggtgctggggcgtgggcaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggcagcgtgaccatcacgctgtccgagccgcgcaacatccagcagaagctgccgcccgagatcatcaccctccaccccaagatcgaggaggggttcttcgacctgatgcacgtccagaaggtgctgagcgcctccaccgtgtgcaagctccagagctgcacccacggcgtccccggcgacctccaggtgtaccacatcgggaacctgctgaagggcgaccgggtgaacgggcacctgatccacaagatcgagcagcacttcaacacgtcctggatgagctgggacggctgcgacctggactactactgcaacatgggggactggccctcctgcacctacaccggcgtcacccagcacaaccacgcgagcttcgtgaacctcctgaacatcgagacggactacaccaagaccttccacttccactccaagcgcgtgaccgcccacggcgacacgccccagctggacctcaaggcccggccgacctacggggccggcgagatcaccgtcctggtggaggtggccgacatggagctgcacaccaagaagatcgagatcagcgggctcaagttcgcgggcctgacgtgcaccgggtgctacgcctgctccagcggcatctcctgcaaggtccgcatccacgtggacgagcccgacgagctgaccgtgcacgtcaagagcgacgaccccgacgtggtggccgccagctccagcctcatggcgcggaagctggagttcggcaccgactccacgttcaaggccttcagcgccatgcccaagacctccctgtgcttctacatcgtcgagcgcgagtactgcaagagctgctccaaggaggacacccagaagtgcgtgaacaccaagctcgagcagccgcagagcatcctgatcgagcacaaggggacgatcatcggcaagcagaacaacacgtgcaccgccaaggcctcctgctggctggagagcgtcaagtccttcttctacgggctcaagaacatgctgggcgggatcttcggcaacgtgttcatcggcatcttcaccttcctgacccccttcatcctcctgatcttcttcttcatgttcgggtggcgcatcctgttctgcttcaagtgctgccggcgcacccggggcctcttcaagtaccgccacctgaaggacgacgaggagaccgggtaccggaagatcatcgagcgcctgaacaacaagaagggcaagaaccggctcctggacggcgagcgcctggcggaccggaagatcgccgagctgttcagcaccaagacccacatcggg

SEQ ID NO: 12130 - RNA, 3495 nt, synthetic construct
  misc_feature 1..3495: note = derived and/or modified CDS sequence (opt1) from CCHVF(CCHVF SPU 44/08)__KJ682805.1__Gn-NSm-Gc
  source 1..3495: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggccatcttctacctgctgatcgtggtcggcaccctcggcaagaagttcaagcagtaccgggagctgaagccccagacctgcaccatctgcgagaccaaccccgtgaacgccatcgacgcggagatgcacgacctgaactgctcctacaacatctgcccctactgcgccagccgcctcacctccgacgggctggcccggcacgtgatgcagtgcccgaagcgcaaggagaagatcgaggagaccgagctgtacctcaacctggagcggatcccctgggtcgtgcgcaagctgctccaggtgagcgagagcacgggcgtcgccctgaagcggtccagctggctggtgatcctcctggtgctgctcaccgtctccctgagccccgtgcagtccgcgcccatcagccacggggagaccgtggaggtctaccagacccgcgagggctacacgtccatctgcctgttcgtgctcgggagcatcctgttcctggtgtcctgcctcatgcggggcctggtcgacagcgtgtccaacagcttcttcccgggcctgtccatctgcaagacctgcagcatcgggtccatcaacggcttcgagatcgagagccacaagtgctactgctccctcttctgctgcccctactgccgccactgcagcgccgacatcgagatccacaagctgcacctgtccatctgcaagaagcggaagaccgggagcaacgtcatgctcgccgtgtgcaagcgcatgtgcttccgggccaccgtggaggtcagcaacaaggccctgctgatccgcaacatcatcaacacgaccttcgtggtgtgcatcctcatcctggcggtctgcgtggtgtccaccagcgccgtcgagatggagaacctgcccgccggcacctgggagaaggaggaggacctgacgaacttctgccaccaggagtgccaggtgaccgagaccgagtgcctctgcccctacgaggccctggtgctgcgcaagcccctcttcctggactccatcgtcaaggggatgaagaacctgctcaacagcacctccctggagacgagcctgtccatcgaggccccctggggcgcgatcaacgtgcagagcaccttcaagcccaccgtgtccgccgccaacatcgccctcagctggtccagcgtcgagcaccggggcaacaagatcctggtgtccgggcgcagcgagtccatcatgaagctggaggagcggaccggcatcagctgggacctcggggtggaggacgcctccgagagcaagctgctgacggtcagcgtgatggacctctcccagatgtacagccccgtgttcgagtacctgtccggcgaccgccaggtcgaggagtggccgaaggcgacctgcaccggggactgccccgagcggtgcggctgcaccagctccacgtgcctgcacaaggagtggccccacagccgcaactggcggtgcaaccccacctggtgctggggcgtggggaccggctgcacgtgctgcgggctcgacgtgaaggacctgttcaccgactacatgttcgtcaagtggaaggtggactacatcaagaccgaggccatcgtgtgcgtcgagctgacctcccaggagcgccagtgcagcctcatcgaggccggcacccggttcaacctgggcccggtgaccatcacgctgtccgagccccgcaacatccagcagaagctcccgcccgagatcgtgaccctgcacccgcggatcgaggaggggttcttcgacctgatgcacatccagaaggtcctcagcgcctccaccgtgtgcaagctgcagagctgcacccacggcgtgcccggggacctgcagatctaccacatcggcaacctcctgaagggggacaaggtcaacggccacctgatccacaagatcgagccccacttcaacacgtcctggatgagctgggacggctgcgacctcgactactactgcaacatgggggactggccgtcctgcagctacaccggcgtgacccagcacaaccacgccgcgttcgtgaacatgctgaacatcgagaccgactacacgaagaacttccacttccactccaagcgcgtcaccgcccacggggacacgccccagctggacctcaaggcccggcccacctacggcgccggggagatcaccgtgctggtggaggtcgcggacatggagctgcacaccaagaagatcgagatcagcggcctcaagttcgcctccctgacctgcaccggctgctacgcctgcagcagcgggatctcctgcaaggtgcgcatccacgtggacgagcccgacgagctgacggtccacgtcaagagcgaggacccggacatcgtggccgcctccagctccctcatggcgcggaagctggagttcggcaccgacagcaccttcaaggccttctccgccatgcccaagaccagcctgtgcttctacatcgtggagcgcgagtactgcaagtcctgcagcaaggaggacacgcagaagtgcgtgaacaccaagctcgagcagccccagtccatcctgatcgagcacaaggggaccatcatcggcaagcagaacgacacgtgcaccgccaaggccagctgctggctggagtccatcaagagcttcttctacgggctcaagaacatgctgtccggcatcttcggcaacgtgttcatcgggatcttcctgttcctcgcgcccttcatcatgctgatcctgttcttcatgttcggctggcggatcctcttctgcttcaagtgctgccgccggacccgcgggctgttcaagtaccgccacctgaaggacgacgaggagatcggctaccggaagatcatcgagcgcctcaacaacaagaaggggaagaacaagctgctggacggcgagcggctcgccgaccgcaagatcgccgagctgttcagcaccaagacccacatcggc

SEQ ID NO: 12131 - RNA, 3495 nt, synthetic construct
  misc_feature 1..3495: note = derived and/or modified CDS sequence (opt1) from CCHVF(CCHVF SPU 383/87)__KJ682806.1__Gn-NSm-Gc
  source 1..3495: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggtgatcttctacctgctggtcgtggtgggcaccctcggcaagaagttcaagcagtaccgggagctgaagccccagacctgcaccatctgcgagaccaaccccgtcaacgccatcgacgccgagatgcacgacctgaactgctcctacaacatctgcccctactgcgcgagccgcctcacctccgacgggctggcccggcacgtgatccagtgcccgaagcgcaaggagaagatcgaggagaccgagctgtacctcaacctggagcggatcccctgggtggtccgcaagctgctccaggtgagcgagagcacgggcgtggccctgaagcggtccagctggctggtcatcctcctggtgctgctcaccgtgtccctgagccccgtccagtccgcccccatcagccacggggagaccgtggaggtgtaccagacccgcgagggctacacgtccatctgcctgttcgtcctcgggagcatcctgttcctggtgtcctgcctcatgaagggcctggtcgacagcgtgggcaactccttcttcccggggctgagcatctgcaagacctgctccatcggcagcatcaacgggttcgagatcgagtcccacaagtgctactgcagcctcttctgctgcccctactgccggcactgctccgcggacatcgagatccaccgcctgcacctgagcatctgcaagaagcggaagaccggctccaacgtgatgctcgccgtctgcaagcgcatgtgcttccgggccaccgtggaggtgagcaacaaggccctgctgatccgcaacatcatcaacacgaccttcgtcgtgtgcatcctcatcctggccgtgtgcgtcgtgagcacctccgcggtggagatggagaacctgcccgccgggacctgggagaaggaggaggacctgacgaacttctgccaccaggagtgccaggtcaccgagaccgagtgcctctgcccctacgaggccctggtgctgcgcaagcccctcttcctggacagcatcgtgaagggcatgaagaacctgctcaactccaccagcctggagacgtccctgagcatcgaggccccctggggcgccatcaacgtccagtccaccttcaagcccaccgtgagcgcggccaacatcgccctctcctggagctccgtggagcaccgggggaacaagatcctggtcagcggccgctccgagagcatcatgaagctggaggagcggaccgggatctcctgggacctcggcgtggaggacgccagcgagtccaagctgctgacggtgagcgtcatggacctcagccagatgtactcccccgtgttcgagtacctgagcggggaccgccaggtggaggagtggccgaaggcgacctgcaccggcgactgccccgagcggtgcggctgcacctccagcacgtgcctgcacaaggagtggccccactcccgcaactggcggtgcaaccccacctggtgctggggcgtcgggaccgggtgcacgtgctgcggcctcgacgtgaaggacctgttcaccgactacatgttcgtgaagtggaaggtcgactacatcaagaccgaggccatcgtgtgcgtggagctgaccagccaggagcgccagtgctccctcatcgaggccggcacccggttcaacctggggccggtcaccatcacgctgagcgagccccgcaacatccagcagaagctcccgcccgagatcgtgaccctgcacccgcggatcgaggagggcttcttcgacctgatgcacatccagaaggtgctctccgccagcaccgtctgcaagctgcagtcctgcacccacggggtgcccggcgacctgcagatctaccacatcgggaacctcctgaagggcgacaaggtgaacggccacctgatccacaagatcgagccccacttcaacacgagctggatgtcctgggacgggtgcgacctcgactactactgcaacatgggcgactggccgagctgctcctacaccggggtcacccagcacaaccacgccgccttcgtgaacatgctgaacatcgagaccgactacacgaagaacttccacttccacagcaagcgcgtgaccgcgcacggcgacacgccccagctggacctcaaggcccggcccacctacggggccggcgagatcaccgtcctggtggaggtggccgacatggagctgcacaccaagaagatcgagatctccggcctcaagttcgcgagcctgacctgcaccgggtgctacgcctgctccagcggcatcagctgcaaggtccgcatccacgtggacgagcccgacgagctgacggtgcacgtcaagtccgaggacccggacatcgtggccgccagctccagcctcatggcccggaagctggagttcgggaccgactccaccttcaaggcgttcagcgccatgcccaagacctccctgtgcttctacatcgtggagcgcgagtactgcaagagctgctccaaggaggacacgcagaagtgcgtcaacaccaagctcgagcagccccagagcatcctgatcgagcacaagggcaccatcttcgggaagcagaacgacacgtgcaccgccaaggcctcctgctggctggagagcgtgaagtccttcttctacggcctcaagaacatgctgagcggcatcttcgggaacgtgttcatcggcgtcttcctgttcctcgcccccttcatcatgctgatcctgttcttcatgttcgggtggcggatcctcttctgcttcaagtgctgccgccggacccgcggcctgttcaagtaccgccacctgaaggacgacgaggagatcgggtaccggaagatcatcgagcgcctcaacaacaagaagggcaagaacaagctgctggacggcgagcggctcgcggaccgcaagatcgccgagctgttctccaccaagacccacatcggg

SEQ ID NO: 12132 - RNA, 3495 nt, synthetic construct
  misc_feature 1..3495: note = derived and/or modified CDS sequence (opt1) from CCHVF(CCHVF SPU 130/89)__KJ682807.1__Gn-NSm-Gc
  source 1..3495: mol_type = other RNA
agcgaggagcccaactacgactgcctgtcccgcacccagctcctgcggaccgagaacgccgagatccacagcgacaactacggcgggccgggcgacaagatcacgatctgcaacgggtccaccatcgtggaccagcgcctgggcagcgagctcgggtgctacaccatcaaccgggtcaagtccttcaagctgtgcgagaacagcgccaccggcaagtcctgcgagatcgacagcacgcccgtgcgctgccggcagggcttctgcctgaagatcacccaggaggggcgcggccacgtgaagctctcccgggggagcgaggtcgtgctggacgcgtgcgactccagctgcgagatcatgatccccaagggcaccggggacatcctggtggactgctccggcggccagcagcacttcctcaaggacaacctggtcgacctggggtgccccaacatcccgctcctgggcaagatggccatctacatctgccgcatgagcaaccaccccaagaccacgatggccttcctgttctggttctccttcgggtacgtgatcacgtgcatcctctgcaaggtgatcttctacctgctgatcgtcgtgggcaccctcggcaagaagttcaagcagtaccgggagctgaagccccagacctgcaccatctgcgagaccaaccccgtgaacgccatcgacgccgagatgcacgacctgaactgcagctacaacatctgcccgtactgcgcgtcccgcctcaccagcgacgggctggcccggcacgtcatgcagtgccccaagcgcaaggagaagatcgaggagaccgagctgtacctcaacctggagcggatcccctgggtggtgcgcaagctgctccaggtctccgagagcacgggcgtggccctgaagcggagctcctggctggtggtcctcctggtgctgctcaccgtgagcctgtcccccgtccagagcgccccgatctcccacggggagaccgtggaggtgtaccagacccgcgagggctacacgagcatctgcctgttcgtcctcgggtccatcctgttcctggtgagctgcctcatgaagggcctggtcgactccgtgggcaacagcttcttccccgggctgtccatctgcaagacctgcagcatcggctccatcaacgggttcgagatcgagagccacaagtgctactgctccctcttctgctgcccctactgccggcactgcagcgcggacatcgagatccacaagctgcacctgtccatctgcaagaagcgcaagaccggcagcaacgtgatgctcgccgtctgcaagcggatgtgcttccgcgccaccgtggaggtgtccaacaaggccctgctgatccggaacatcatcaacacgaccttcgtcgtgtgcatcctcatcctggccgtgtgcgtcgtgagcaccagcgcggtggagatggagaacctgcccgccgggacctgggagaaggaggaggacctgacgaacttctgccaccaggagtgccaggtcaccgagaccgagtgcctctgcccgtacgaggccctggtgctgcgcaagcccctctccctggacagcatcgtgaagggcatgaagaacctgctcaactccaccagcctggagacgtccctgagcatcgaggccccctggggcgccatcaacgtccagtccaccttcaagcccaccgtgagcgcggccaacatcgccctctcctggagctccgtggagcaccgcgggaacaagatcctggtcagcggccggtccgagagcatcatgaagctggaggagcgcaccgggatctcctgggacctcggcgtggaggacgccagcgagtccaagctgctgacggtgagcgtcatggacctcagccagatgtactccccggtgttcgagtacctgagcggggaccgccaggtggaggagtggcccaaggcgacctgcaccggcgactgccccgagcggtgcggctgcacctccagcacgtgcctgcacaaggagtggccccactcccggaactggcgctgcaacccgacctggtgctggggcgtcgggaccgggtgcacgtgctgcggcctcgacgtgaaggacctgttcaccgactacatgttcgtgaagtggaaggtcgactacatcaagaccgaggccatcgtgtgcgtggagctgaccagccaggagcggcagtgctccctcatcgaggccggcacccgcttcaacctggggcccgtcaccatcacgctgagcgagccccggaacatccagcagaagctgcccccggagatcgtgaccctccacccccgcatcgaggagggcttcttcgacctgatgcacatccagaaggtgctctccgccagcaccgtctgcaagctgcagtcctgcacccacggggtgcccggcgacctgcagatctaccacatcgggaacctcctgaagggcgacaaggtgaacggccacctgatccacaagatcgagccgcacttcaacacgagctggatgtcctgggacgggtgcgacctcgactactactgcaacatgggcgactggcccagctgctcctacaccggggtcacccagcacaaccacgccgccttcgtgaacatgctgaacatcgagaccgactacacgaagaacttccacttccacagcaagcgggtgaccgcgcacggcgacacgccccagctggacctcaaggcccgccccacctacggggccggcgagatcaccgtcctggtggaggtggccgacatggagctgcacaccaagaaggtcgagatctccggcctcaagttcgcgagcctgacctgcaccgggtgctacgcctgctccagcggcatcagctgcaaggtgcggatccacgtggacgagccggacgagctgacggtccacgtgaagtccgaggaccccgacatcgtggccgccagctccagcctcatggcccgcaagctggagttcgggaccgactccaccttcaaggcgttcagcgccatgcccaagacctccctgtgcttctacatcgtcgagcgggagcactgcaagagctgctccaaggaggacacgcagcgctgcgtgaacaccaagctcgagcagccccagagcatcctgatcgagcacaagggcaccatcatcgggaagcagaacgacacgtgcaccgccaaggcctcctgctggctggagagcatcaagtccttcttctacggcctcaagaacatgctgagcggcatcttcgggaacgtgttcatcggcgtcttcctgttcctcgccccgttcatcatcctgatcctgttcttcatgttcgggtggcggatcctcttctgcttcaagtgctgccgccggacccgcggcctgctgaagtaccgccacctcaaggacgacgaggagatcgggtaccggaagatcatcgagcgcctgaacaacaagaagggcaagaacaagctgctcgacggcgagcggctggcggaccgcaagatcgccgagctgttctccaccaagacccacatcggg

SEQ ID NO: 12133 - RNA, 3495 nt, synthetic construct
  misc_feature 1..3495: note = derived and/or modified CDS sequence (opt1) from CCHVF(CCHVF SPU 497/88)__KJ682808.1__Gn-NSm-Gc
  source 1..3495: mol_type = other RNA
agcgaggagtccaacgacgactgcctcagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggaagggccacgtgaagctcagccgcgggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccggatgtccaaccacccgaagaccacgatggtgttcctgttctggttcagcttcgggtacgtgatcacgtgcatcctctgcaaggtcatcttctacctgctgatcgtggtgggcaccctcggcaagaagttcaagcagtaccgcgagctgaagccccagacctgcaccatctgcgagaccaaccccgtcaacgccatcgacgccgagatgcacgacctgaactgctcctacaacatctgcccctactgcgccagccggctcacctccgacgggctggcgcgccacgtgatgcagtgcccgaagcggaaggagaagatcgaggagaccgagctgtacctcaacctggagcgcatcccctgggtggtccggaagctgctccaggtgagcgagagcacgggcgtggccctgaagcgctccagctggctggtcatcctcctggtgctgctcaccgtgtccctgagccccgtccagtccgcccccatcagccacggggagaccgtggaggtgtaccagacccgggagggctacacgtccatctgcctgttcgtcctcgggggcatcctgttcctggtgagctgcctcatgaagggcctggtcgactccgtggggaacagcttcttcccgggcctgtccatctgcaagacctgcagcatcgggtccatcaacggcttcgagatcgagagccacaagtgctactgctccctcttctgctgcccctactgccgccactgcagcgccgacatcgagatccacaagctgcacctgtccatctgcaagaagcggaagacctggagcaacgtgatgctcgcggtctgcaagcgcatgtgcttccgggccaccgtggaggtgtccaacaaggccctgctgatccgcaacatcatcaacacgaccttcgtcgtgtgcatcctcatcctggccatctgcgtggtcagcaccagcgccgtggagatggagaacctgcccgcggggacctgggagaaggaggaggacctgacgaacttctgccaccaggagtgccaggtgaccgagaccgagtgcctctgcccctacgaggccctggtcctgcggaagcccctcttcctggactccatcgtgaagggcatgcgcaacctgctcaacagcacctccctggagacgagcctgtccatcgaggccccctggggcgccatcaacgtgcagagcaccttcaagcccaccgtctccgccgcgaacatcgccctcagctggtccagcgtggagcaccgcgggaacaagatcctggtgtccggccggagcgagtccatcatgaagctggaggagcgcaccgggatcagctgggacctcggcgtcgaggacgcctccgagagcaagctgctgacggtgtccgtgatggacctcagccagatgtacagccccgtcttcgagtacctgtccggggaccgccaggtggaggagtggccgaaggcgacctgcaccggcgactgccccgagcggtgcggctgcaccagctccacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggactacatcaagaccgaggccatcgtctgcgtggagctgacctcccaggagcggcagtgcagcctcatcgaggccggcacccgcttcaacctggggccggtgaccatcacgctgtccgagccccggaacatccagcagaagctcccgcccgagatcgtcaccctgcacccgcgcatcgaggagggcttcttcgacctgatgcacatccagaaggtgctcagcgcctccaccgtgtgcaagctgcagagctgcacccacggggtccccggcgacctgcagatctaccacatcgggaacctcctgaagggcgacaaggtgaacggccacctgatccacaagatcgagccccacttcaacacgtcctggatgagctgggacgggtgcgacctcgactactactgcaacatgggcgactggccgtcctgcagctacaccggggtgacccagcacaaccacgccgccttcgtcaacatgctgaacatcgagaccgactacacgaagaacttccacttccactccaagcgggtgaccgcccacggcgacacgccccagctggacctcaaggcgcgccccacctacggggccggcgagatcaccgtgctggtcgaggtggccgacatggagctgcacaccaagaagatcgagatcagcggcctcaagttcgcctccctgacctgcaccgggtgctacgcgtgcagctccggcatcagctgcaaggtgcggatccacgtcgacgagcccgacgagctgacggtgcacgtcaagagcgaggacccggacatcgtggccgcctccagctccctcatggcccgcaagctggagttcgggaccgacagcaccttcaaggccttctccgcgatgcccaagaccagcctgtgcttctacatcgtggagcgggagtactgcaagtcctgcagcaaggaggacacgcagaagtgcgtgaacaccaagctcgagcagccccagtccatcctgatcgagcacaagggcaccatcatcgggaagcagaacgacacgtgcaccgcccgcgccagctgctggctggagtccatcaagagcttcttctacggcctcaagaacatgctgtccggcatcttcgggaacgtcttcatcggcatcttcctgttcttcgcccccttcatcatgctcatcctgttcttcatgttcgggtggcggatcctgttctgcttcaagtgctgccgccggacccgcggcctcttcaagtaccgccacctgaaggacgacgaggaggtggggtaccggaagatcatcgagcgcctgaacaacaagaagggcaagaacaagctcctggacggcgagcggctggccgaccgcaagatcgcggagctgttcagcaccaagacccacatcggg

SEQ ID NO: 12134 - RNA, 3495 nt, synthetic construct
  misc_feature 1..3495: note = derived and/or modified CDS sequence (opt1) from CCHVF(CCHVF SPU 18/88)__KJ682810.1__Gn-NSm-Gc
  source 1..3495: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggggttcctgttctggttcagcttcggctacgtgatcacgtgcatcctctgcaaggtgatcttctacctgctgatcgtcgtgggcaccctcgggaagaagttcaagcagtaccgggagctgaagccccagacctgcaccatctgcgagaccaaccccgtgaacgccatcgacgccgagatgcacgacctgaactgctcctacaacatctgcccctactgcgccagccgcctcacctccgacggcctggcgcggcacgtcatgcagtgcccgaagcgcaaggagaagatcgaggagaccgagctgtacctcaacctggagcggatcccctgggtggtgcgcaagctgctccaggtcagcgagagcacgggggtggccctgaagcggtccagctggctggtgatcctcctggtcctgctcaccgtgtccctgagccccgtgcagtccgcccccatcagccacggcgagaccgtcgaggtgtaccagacccgcgaggggtacacgtccatctgcctgttcgtgctcggcagcatcctgttcctggtctcctgcctcatgaagggcctggtggacagcgtcgggaactccttcagcccgggcctgtccatctgcaagacctgcagcatcgggtccatcaacggcttcgagatcgagagccacaagtgctactgctccctcttctgctgcccctactgccggcactgcagcgccgacatcgagatccacaagctgcacctgtccatctgcaagaagcgcaagaccgggagcaacgtgatgctcgcggtgtgcaagcggatgtgcttccgcgccaccgtcgaggtgagcaacaaggccctgctgatccggaacatcatcaacacgaccttcgtggtctgcatcctcatcctggccgtgtgcgtggtctccaccagcgccgtggagatggagaacctgcccgcgggcacctgggagaaggaggaggacctgacgaacttctgccaccaggagtgccaggtgaccgagaccgagtgcctctgcccctacgaggccctggtcctgcgcaagcccctcttcctggactccatcgtgaagggcaagaagaacctgctcaacagcacctccctggagacgagcctgtccatcgaggccccctggggcgccatcaacgtgcagagcaccttcaagcccaccgtctccgccgcgaacatcgccctcagctggtccagcgtggagcaccgcgggaacaagatcctggtgtccgggcggagcgagtccatcatgaagctggaggagcgcaccggcatcagctgggacctcggggtcgaggacgcctccgagagcaagctgctgacggtgagcgtgatggacctctcccagatgtacagccccgtcttcgagtacctgtccggcgaccgccaggtggaggagtggccgaaggcgacctgcaccggcgactgccccgagcggtgcgggtgcaccagctccacgtgcctgcacaaggagtggccccacagccggaactggcgctgcaaccccacctggtgctggggcgtggggaccggctgcacgtgctgcggcctcgacgtcaaggacctgttcaccgactacatgttcgtgaagtggaaggtggactacatcaagaccgaggccatcgtctgcgtggagctgacctcccaggagcggcagtgcagcctcatcgaggccgggacccgcttcaacctgggcccggtgaccatcacgctgtccgagccccggaacatccagcagaagctcccgcccgagatcgtcaccctgcacccgcgcatcgaggaggggttcttcgacctgatgcacatccagaaggtgctcagcgcctccaccgtgtgcaagctgcagagctgcacccacggcgtccccggggacctgcagatctaccacatcggcaacctcctgaagggcgacaaggtgaacgggcacctgatccacaagatcgagccccacttcaacacgtcctggatgagctgggacggctgcgacctcgactactactgcaacatgggggactggccgtcctgcagctacaccggcgtgacccagcacaaccacgccgccttcgtcaacatgctgaacatcgagaccgactacacgaagaacttccacttccactccaagcgggtgaccgcccacggggacacgccccagctggacctcaaggcgcgccccacctacggcgccggcgagatcaccgtgctggtcgaggtggccgacatggagctgcacaccaagaagatcgagatcagcgggctcaagttcgcctccctgacctgcaccggctgctacgcgtgcagcagcgggatctcctgcaaggtgcggatccacgtcgacgagcccgacgagctgacggtgcacgtcaagagcgaggacccggacatcgtggccgcctccagctccctcatggcccgcaagctggagttcggcaccgacagcaccttcaaggccttctccgcgatgcccaagaccagcctgtgcttctacatcgtggagcgggagtactgcaagtcctgcagcaaggaggacacgcagaagtgcgtgaacaccaagctcgagcagccccagtccatcctgatcgagcacaaggggaccatcatcggcaagcagaacgacacgtgcaccggcaaggccgggtgctggctggagagcatcaagtccttcttctacggcctcaagaacatgctgagcgggatcttcggcaacgtcttcatcgggatcttcctgttcctcgcccccttcatcatgctgatcctgttcttcatgttcggctggcgcatcctcttctgcttcaagtgctgccggcgcacccggggcctgttcaagtaccgccacctgaaggacgacgaggagatcgggtaccgcaagatcatcgagcggctcaagaacaagaagggcaagaacaagctgctggacggggagcgcctcgccgaccggaagatcgccgagctgttctccaccaagacccacatcggc

SEQ ID NO: 12135 - RNA, 3495 nt, synthetic construct
  misc_feature 1..3495: note = derived and/or modified CDS sequence (opt1) from CCHVF(CCHVF SPU 556/87)__KJ682811.1__Gn-NSm-Gc
  source 1..3495: mol_type = other RNA
agcgaggagtccgacggcgactgcatcagccgcacccagctgctccggaccgagacggccgagatccactccgacaactacgggggccccggggacaagatcaccatctgcaacggcagcaccatcgtggaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgagatcgtcctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggcggatggccatctacatctgccgcatgtccaaccacccgaagacgaccatggccttcctgttctggttcagcttcggctacgtgatcacgtgcatcctgtgcaaggtcatcttctacctcctgatcgtggccggcaccgtggggaagaagttcaagcagtaccgggagctgcgcccccagacctgcaccatctgcgagaccacccccgtcaacgccatcgacgcggagatgcacgacctcaactgctcctacaacatctgcccctactgcgccagccggctgacgtccgacggcctggcccgccacgtgatgcagtgcccgaagcggaaggagaagatcgaggagaccgagctctacctgaacctggagcgcatcccctgggtggtccggaagctcctccaggtgagcgagagcaccggggtggccctgaagcgctccagctggctgaccgtcctgctggtgctcctgatcgtgtccctgagccccgtccagtccgcgcccatcggccacgggaagacgatcgagacctaccaggcccgggagggctacaccagcttctgcctcttcatcctgggctccatcctgttcatcgtgagctgcctcgtgaaggggctgatcgactccgtcggcaacagcttcttcccggggctgtccatctgcaagacctgcagcatcggctccgtgaacgggttcgagatcgagagccacaagtgctactgctccctcttctgctgcccctactgccgccactgcagcgccgaccgggagatccacaagctgcacctgtccatctgcaagaagcgcaagacgggcagcaacgtgatgtccgccgtctgcaagcggatgtgcttccgcgccaccatcgaggtgagcaaccgcgcgctcctgatccggagcatcatcaacaccaccttcgccgtctgcatcctgacgctcgccgtgtgcgtggtctccaccagcgccgtggagatggagtccctgcccgccggcacctgggagcgcgaggaggacctgaccaacttctgccaccaggagtgccaggtgacggagaccgagtgcctctgcccctacgaggcgctggtcctgcggaagccgctgttcctcgacagcatcgtgaaggggaagaagaacctgctgaactccaccagcctcgagacctccctgagcatcgaggccccctggggcgccatcaacgtgcagtccacgttcaagcccaccgtcagcgccgccaacatcgcgctgtcctggagctccgtggagcaccgcgggaacaagatcctcgtgagcggccggtccgagagcatcatgaagctggaggagcgcaccgggatctcctgggacctgggcgtcgaggacgccagcgagagcaagctcctgaccgtgtccgtgatggacctgagccagatgtactcccccgtcttcgagtacctcagcggcgaccgccaggtggaggagtggccgaaggcgacctgcacgggggactgccccgagcggtgcggctgcacctccagcacgtgcctgcacaaggagtggccccactcccggaactggcgctgcaaccccacctggtgctggggcgtggggaccggctgcacgtgctgcgggctggacgtcaaggacctcttcaccgactacatgttcgtgaagtggaaggtggagtacatcaagaccgaggccatcgtctgcgtggagctgaccagccaggagcggcagtgctccctgatcgaggccggcacccgcttcaacctcgggccggtgaccatcaccctgagcgagccccggaacatccagcagaagctgccgcccgagatcatcacgctccacccccgcatcgaggagggcttcttcgacctgatgcacgtccagaaggtgctgtccgccagcaccgtgtgcaagctccagtcctgcacccacggggtccccggcgacctccaggtgtaccacatcggcaacctgctgaagggggacaaggtgaacggccacctgatccacaagatcgagccccacttcaacaccagctggatgtcctgggacgggtgcgacctggactactactgcaacatgggcgactggccgagctgcacgtacaccggggtcacccagcacaaccacgccgccttcgtgaacctcctgaacatcgagaccgactacacgaagaacttccacttccactccaagcgggtgaccgcccacggcgacacgccccagctggacctcaaggcgcgccccacctacggcgccggggaggtcaccgtgctggtggaggtcgccgacatggagctgcacaccaagaagatcgagatcagcggcctcaagttcgcctccctgagctgcaccgggtgctacgcctgcagctccggcatcagctgcaaggtgcggatccacgtggacgagcccgacgagctgaccgtccacgtgaagtccgaggacccggacatcgtggcggccgggagctccctcatggcccgcaagctggagttcggcgccgacagcacgttcaaggccttctccgcgatgcccaagaccagcctgtgcttctacatcgtcgagcgggagtactgcaagtcctgcagccgcgaggacacccagaagtgcgtgaacaccaagctcgagcgcccccagtccatcctgatcgagcacaagggcacgatcatcgggaagcagaacgacacgtgcaccgccaaggccagctgctggctggagtccgtcaagagcttcttctacggcctcaagtccatgctgagcgggatcttcggcaacgtgttcatcgggatcttcctgttcatcgcccccttcgtgctcctgatcctgttcttcatgttcggctggcggatcctcttctgcttcaagtgctgccgccggacccgcggcctgttcaagtaccggcacctgaaggacgacgaggagaccgggtaccgcaagatcatcgagcggctcaacaacaagaagggcaagaacaagctgctggacggggagcgcctcgccgaccggaagatcgcggagctgttctccaccaagagccacatcggc

SEQ ID NO: 12136 - RNA, 3495 nt, synthetic construct
  misc_feature 1..3495: note = derived and/or modified CDS sequence (opt1) from CCHVF(CCHVF SPU 431/85)__KJ682812.1__Gn-NSm-Gc
  source 1..3495: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtggaccagcgcctggggtccgagctgggctgctacacgatcaaccgggtcaagagcttcaagctctgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgacagcaactgcgagatcatgatccccaaggggacgggcgacatcctggtggactgctccggcgggcagcagcacttcctgaaggacaacctcatcgacctgggctgccccaacatccccctgctcgggaagatggcgatctacatctgccggatgagcaaccacccgaagaccaccatggccttcctgttctggttctccttcggctacgtgatcacgtgcatcctgtgcaaggtcatcttctacctcctgatcgtggccggcaccgtggggaagaagttcaagcagtaccgcgagctgcggccccagacctgcaccatctgcgagaccatccccgtcaacgccatcgacgccgagatgcacgacctcaactgcagctacaacatctgcccctactgcgcgtcccgcctgacgagcgacggcctggcccggcacgtgatgcagtgcccgaagcgcaaggagaaggtggaggagaccgagctctacctgaacctggagcggatcccctgggtcgtgcgcaagctcctccaggtgtccgagagcaccggggtcgccctgaagcggagctcctggctcaccgtgctgctggtgctcctgatcgtcagcctgtcccccgtgcagagcgcccccatcggccacgggaagacgatcgagacctaccaggcgcgcgagggctacacctccttctgcctcttcatcctgggcagcatcctgttcgtggtctcctgcctcgtgaaggggctgatcgacagcgtgggcaactccttcttcccggggctgagcatctgcaagacctgctccatcggcagcatcaacgggttcgagatcgagtcccacaagtgctactgcagcctcttctgctgcccctactgccggcactgccccgccgaccgcgagatccacaagctgcacctgtccatctgcaagaagcggaagacgggcagcaacgtcatgctcgccgtgtgcaagcgcatgtgcttccgggccaccatcgaggtctccaaccgcgccctgctgatccgcaacatcatcaacaccaccttcgtggtgtgcatcctcacgctggcggtctgcgtggtgagcacctccgccgtcgagatggagagcctgcccgccggcacctgggagaaggaggaggacctcaccaacttctgccaccaggagtgccaggtgacggagaccgagtgcctgtgcccgtacgaggccctggtgctgcggaagcccctcttcctggacagcatcgtcaaggggcgcaagaacctgctcaactccaccagcctggagacctccctgagcatcgaggccccctggggcgcgatcaacgtgcagtccacgttcaagcccaccgtgagcgccgccaacatcgccctctcctggagctccgtcgagcaccgggggaacaagatcctggtgagcggccgctccgagagcatcatgaagctggaggagcggaccgggatctcctgggacctcggcgtggaggacgccagcgagtccaagctgctgaccgtcagcgtgatggacctctcccagatgtacagcccggtgttcgagtacctgagcggcgaccgccaggtcgaggagtggcccaaggcgacctgcacgggggactgccccgagcggtgcggctgcacctccagcacgtgcctgcacaaggagtggccccactcccgcaactggcggtgcaacccgacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaccagccaggagcgccagtgctccctcatcgaggccggcacccggttcaacctggggcccgtgaccatcaccctgagcgagccccgcaacatccagcagaagctgcccccggagatcatcacgctgcacccccggatcgaggagggcttcttcgacctgatgcacgtgcagcgcgtcctctccgccagcaccgtgtgcaagctgcagtcctgcacccacggggtgcccggcgacctgcaggtctaccacatcggcaacctcctgaagggggacaaggtgaacggccacctgatccacaagatcgagccgcacttcaacaccagctggatgtcctgggacgggtgcgacctcgactactactgcaacatgggcgactggcccagctgcacgtacaccggggtgacccagcacaaccacgccgcgttcgtcaacctgctgaacatcgagaccgactacacgaagaacttccacttccactccaagcgggtgaccgcccacggcgacacgccccagctcgacctgaaggcccgccccacctacggcgccggggaggtgaccgtcctggtggaggtggcggacatggagctccacaccaagaagatcgagatcagcggcctgaagttcgcctccctgacctgcaccgggtgctacgcctgcagctccggcatcagctgcaaggtcaagatccacgtggacgagccggacgagctcacggtgcacgtcaagtccgaggaccccgacatcgtggccgccgggagcagcctgatggcgcggaagctggagttcggcgccgactccaccttcaaggccttcagcgccatgcccaagacctccctctgcttctacatcgtggagcgcgagtactgcaagagctgctcccgggaggacacccgcaagtgcgtcaacacgaagctggaccgcccccagagcatcctgatcgagcacaagggcaccatcatcgggaagcagaacaacacgtgcaccgccaaggcgtcctgctggctcgagagcgtgaagtccttcttctacggcctgaagaacatgctgagcgggatcttcggcaacgtgttcatcgggatcttcctcttcatcgccccgttcgtcctgctgatcctcttcttcatgttcggctggcggatcctgttctgcttcaagtgctgccgccggacccgcggcctgttcaagtaccggcacctcaaggacgacgaggagaccgggtaccgcaagatcatcgagcggctgaacaacaagaagggcaagaacaagctgctcgacggggagcgcctggccgaccggaagatcgccgagctgttctccaccaagagccacatcggc

SEQ ID NO: 12137 - RNA, 3495 nt, synthetic construct
  misc_feature 1..3495: note = derived and/or modified CDS sequence (opt1) from CCHVF(CCHVF SPU 48/90)__KJ682813.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcatcgacctgggctgccccaagatcccgctgctcgggaagatggccatctacatctgccgcatgtccaaccaccccacgaccaccatggccttcctgttctggttcagcttcggctacgtgatcacgtgcatcctgtgcaaggccatcttctacctcctgatcatcatcggcaccctggggaagcggttccgccagtaccgggagctcaagccccagacctgcaccatctgcgagaccacgcccgtcaacgccatcgacgcggagatgcacgacctgaactgctcctacaacatctgcccgtactgcgccagccgcctgacctccgacggcctcgcccggcacgtgacccagtgccccaagcgcaaggagaaggtggaggagaccgagctgtacctgaacctcgagcggatcccctgggtcgtgcgcaagctgctccaggtgagcgagtccacgggggtcgccctcaagcggagcagctggctgatcgtgctgctcgtgctgttcaccgtctccctgagccccgtgcagtccgcgccgatcggccacgggaagaccatcgaggcctaccgcgcccgggagggctacaccagcatctgcctcttcgtgctgggctccatcctgttcgtcgtgagctgcctcatgaagcgcctggtggactccgtcgggaacagcttcttccccggcctgtccatctgcaagacgtgcagcatctccagcatcaacgggttcgagatcgagtcccacaagtgctactgcagcctcttctgctgcccctactgccggcactgctccgccgacaaggagatccacaagctgcacctgagcatctgcaagaagcgcaagaccggctccaacgtgatgctcgccgtctgcaagcgcatgtgcttccgggcgaccatggaggtgagcgaccgcgccctgttcatccggtccatcatcaacaccacgttcgtgctgtgcatcctcatcctggccgtctgcgtggtgagcaccagcgccgtcgagatggagaacctgcccgccgggacctgggagcgcgaggaggacctcaccaacttctgccaccaggagtgccaggtgacggagaccgagtgcctgtgcccgtacgaggcgctggtgctgcggaagcccctcttccgcgactccatcgtcaagggcatgaagaacctgctgaacagcacctccctcgagaccagcctgtccatcgaggccccctggggcgccatcaacgtgcagagcacgtacaagcccaccgtgtccaccgccaacatcgccctgagctggtccagcgtcgagcaccgggggaacaagatcctcgtgtccggccgcagcgagtccatcatgaagctggaggagcggaccgggatcagctgggacctgggcgtggaggacgcgtccgagagcaagctcctgaccgtctccgtgatggacctgagccagatgtacagcccggtgttcgagtacctctccggggaccgccaggtcgaggagtggcccaaggccacgtgcaccggcgactgccccgagcggtgcggctgcaccagctccacgtgcctgcacaaggagtggccccacagccgcaactggcggtgcaacccgacctggtgctggggcgtggggaccgggtgcacgtgctgcggcctggacgtgaaggacctcttcaccgactacatgttcgtcaagtggaaggtggagtacatcaagaccgaggccatcgtgtgcgtcgagctgacctcccaggagcgccagtgcagcctgatcgaggccggcacccggttcaacctcgggcccgtgaccatcacgctgtccgagccccgcaacatccagcagaagctgcccccggagatcatcaccctccacccccggatcgaggagggcttcttcgacctgatgcacgtgcagaaggtcctgagcgcctccaccgtgtgcaagctccagagctgcacccacggggtgcccggcgacctgcaggtctaccacatcgggaacctgctcaagggcgacaaggtgaacggccacctgatccacaagatcgagccgcacttcaacacgtcctggatgagctgggacgggtgcgacctggactactactgcaacatgggcgactggccctcctgcacctacaccggggtgacccagcacaaccgcgcgagcttcgtcaacctcctgaacatcgagacggactacaccaagaacttccacttccactccaagcgggtgaccgcccacggcgacacgccccagctggacctcaaggcccgccccacctacggggccggcgagatcaccgtgctggtcgaggtggcggacatggagctgcacaccaagaagatcgagatcagcggcctcaagttcgcctccctgacctgcacggggtgctacgcctgcagctccggcatcagctgcaaggtgcgcatccacgtcgacgagccggacgagctgaccgtgcacgtcaagagcgacgaccccgacgtggtggccgcctccagctccctcatggcgcggaagctggagttcgggaccgacagcaccttcaaggccttctccgccatgcccaagacgagcctgtgcttctacatcgtggagaaggagtactgcaagtcctgcagcgaggaggacaccaagaagtgcgtcaacaccaagctcgagcagccccagtccatcctgatcgagcacaagggcaccatcatcgggaagcagaacagcacgtgcaccgccaaggtgtcctgctggctggagagcgccaagtccttcttctacggcctcaaggacatgctgagcggcatcttcgggaacgtgttcatcggcatcttcctgttcctcgcgccgttcatcctgctgatcctcttcttcatgttcgggtggcgcatcctgctgtgcttcaagtgctgccggcgcacccggggcctcttcaagtaccgccacctgaaggacgacgaggagaccgggtaccggcgcatcatcgagcggctgaacaacaagaagggcaagaacaagctcctggacggcgagcgcctggccgaccggcgcatcgccgagctgttctccaccaagacgcacatcggg

SEQ ID NO: 12138 - RNA, 3495 nt, synthetic construct
  misc_feature 1..3495: note = derived and/or modified CDS sequence (opt1) from CCHVF(CCHVF SPU 187/90)__KJ682814.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgacagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctcaagcgcagcagctggctgatcgtcctgctcgtgctgttcacggtgtccctgagccccgtccagtccgcgccgatcggccacgggaagaccatcgaggcctaccgggcccgcgagggctacaccagcatctgcctcttcgtgctgggctccatcctgttcgtggtcagctgcctcatgaaggggctggtggactccgtgggcaacagcttcttccccgggctgtccatctgcaagacctgcagcatcggctccatcaacgggttcgagatcgagagccacaagtgctactgctccctcttctgctgcccctactgccggcactgcagcgccgacaaggagatccacaagctgcacctgtccatctgcaagaagcgcaagacgggcagcaacgtcatgctcgccgtgtgcaagcggatgtgcttccgcgcgaccatggaggtctccaaccgcgccctgttcatccggagcatcatcaacaccaccttcgtgctgtgcatcctcatcctggccgtgtgcgtcgtgtccacgagcgccgtggagatggagaacctgcccgccggcacctgggagcgcgaggaggacctcaccaacttctgccaccaggagtgccaggtcaccgagacggagtgcctgtgcccgtacgaggcgctggtgctgcggcgccccctcttcctggacagcatcgtgaaggggatgaagaacctgctcaactccaccagcctggagacctccctgagcatcgaggccccctggggcgccatcaacgtccagtccacctacaagcccacggtgagcaccgccaacatcgccctctcctggagctccgtggagcaccgggggaacaagatcctggtcagcggccgctccgagagcatcatgaagctggaggagcggaccgggatctcctgggacctcggcgtggaggacgcgagcgagtccaagctgctgaccgtgagcgtcatggacctctcccagatgtacagcccggtgttcgagtacctgagcggcgaccgccaggtggaggagtggcccaaggcgacctgcacgggggactgccccgagcggtgcggctgcacctccagcacgtgcctgcacaaggagtggccccactcccgcaactggcggtgcaacccgacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcgccagtgctccctcatcgaggccggcacccggttcaacctggggcccgtcaccatcaccctgagcgagccccgcaacatccagcagaagctgcccccggagatcatcacgctgcacccccggatcgaggagggcttcttcgacctgatgcacgtgcagaaggtgctctccgccagcaccgtctgcaagctgcagtcctgcacccacggggtgcccggcgacctccaggtgtaccacatcggcaacctcctgaagggggacaaggtcaacggccacctgatccacaagatcgagccgcacttcaacaccagctggatgtcctgggacgggtgcgacctcgactactactgcaacatgggcgactggcccagctgcacgtacaccggggtgacccagcacaaccacgcctccttcgtgaacctgctgaacatcgagaccgactacacgaagaacttccacttccacagcaagcgcgtcaccgcccacggcgacacgccccagctcgacctgaaggcccggcccacctacggcgccggggagatcaccgtgctggtggaggtcgcggacatggagctccacaccaagaagatcgagatctccggcctgaagttcgccagcctgacctgcaccgggtgctacgcctgctccagcggcatctcctgcaaggtgcgcatccacgtggacgagccggacgagctcacggtccacgtcaagagcgacgaccccgacgtggtggccgccagctccagcctgatggcgcggaagctggagttcgggaccgactccatcttcaaggccttcagcgccatgcccaagacctccctctgcttctacatcgtggagcgcgagcactgcaagagctgctccgaggaggacaccaagaagtgcgtgaacacgaagctggagcagccccagagcatcctgatcgagcacaagggcaccatcatcggcaagcagaactccacgtgcaccgccaagaccagctgctggctcgagtccgtcaagagcttcttctacgggctgaagaacatgctgtccggcatcttcgggaacgtgttcatcggcatcttcctcttcctggccccgttcatcctgctcatcctgttcttcatgttcgggtggcgcatcctgttctgcttcaagtgctgccggcgcacccggggcctcttcaagtaccgccacctgaaggacgacgaggagaccggctaccggcgcatcatcgagcggctgaacaacaagaaggggaagaacaagctcctggacggcgagcgcctggcggaccggcgcatcgccgagctgttcagcaccaagacccacatcggg

SEQ ID NO: 12139 - RNA, 3495 nt, synthetic construct
  misc_feature 1..3495: note = derived and/or modified CDS sequence (opt1) from CCHVF(CCHVF Haskovo-V46/13)__KR092379.1__Gn-NSm-Gc
  source 1..3495: mol_type = other RNA
agcgaggagctgggcgacgactgcatctcccgcacccagctcctgcggaccgagacggccgagatccacgacgacaactacgggggccccggggacaagatcaccatctgcaacggcagcaccatcgtggaccagcgcctggggtccgagctcggctgctacaccatcaaccggggcaagagcttcaagctgtgcgagaactccgccacggggaagacctgcgagatcgacagcaccccggtcaagtgccgccagggcttctgcctgaagatcacccaggaggggcggggccacgtgaagctctcccgcgggagcgaggtggtcctggacgcgtgcgactccagctgcgaggtgatgatccccaagggcacgggcgacatcctggtggactgctccgggggccagcagcacttcctcaaggacaacctgatcgacctggggtgcccccacatccccctcctgggcaagatggccatctacatctgccggatgagcaaccacccgcgcaccaccatggccttcctgttctggttctccttcggctacgtcatcacgtgcatcttctgcaaggccctcttctacagcctgatcatcatcgggaccctgggcaagaagatcaagcagtaccgggagctcaagccccagacctgcaccatctgcgagaccacgcccgtgaacgccatcgacgcggagatgcacgacctgaactgctcctacaacatctgcccctactgcgccagccgcctgacctccgacgggctcgcccggcacgtgacccagtgcccgaagcgcaaggagaaggtcgaggagaccgagctgtacctgaacctcgagcggatcccctggatcgtgcgcaagctgctccaggtgagcgagtccacgggcgtcgccctcaagcggagcagctggctgatcgtgctgctcgtgctgctgcccgtctccctcagccccgtgcagtccgcgccggtggggcacggcaagaccatcgagacctaccagacccgcgagggcttcacgagcatctgcctgttcatgctggggtccatcctcttcatcgtcagctgcctggtgaagggcctggtggactccgtcggggacagcttcttccccggcctctccgtgtgcaagacctgcagcatcgggtccatcaacggcttcgagatcgagagccacaagtgctactgctccctgttctgctgcccctactgccggcactgcagcgccgaccgcgagatccaccagctgcacctctccatctgcaagaagcggaagaccggcagcaacgtgatgctggccgtctgcaagcgcatgtgcttccgggccaccatcgaggcctcccgccgcgcgctgctcatccggagcatcatcaacacgaccttcgccatgtgcatcctgaccctgaccatctgcgtggtctccacgagcgccgtggagatggagaacctccccgccgggacctgggagcgcgaggaggacctgaccaacttctgccaccaggagtgccaggtgaccgagacggagtgcctgtgcccgtacgaggccctggtcctccggaagcccctgttcctggacagcatcgtgaagggcatgaagaacctcctgaactccaccagcctggagacctccctcagcatcgaggcgccctggggcgccatcaacgtgcagtccaccttcaagcccaccgtcagcacggccaacatcgccctgtcctggagctccgtggagcaccgcgggaacaagatcctggtgaccgggcggagcgagtccatcatgaagctcgaggagcgcaccggcgtcagctgggacctgggcgtggaggacgcctccgagagcaagctgctcaccgtgtccatcatggacctgagccagatgtactccccggtcttcgagtacctgagcggggaccgccaggtggaggagtggcccaaggcgacgtgcaccggcgactgccccgagcggtgcgggtgcaccagctccacgtgcctccacaaggagtggccccacagccggaactggcgctgcaacccgacctggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctgacctcccaggagcggcagtgcagcctcatcgaggccgggacccgcttcaacctgggccccgtcaccatcacgctgtccgagccccggaacatccagcagaagctgcccccggagatcatcaccctgcaccccaagatcgaggaggggttcttcgacctgatgcacgtgcagaaggtgctcagcgcctccaccgtctgcaagctgcagagctgcacccacggcatccccggcgacctccaggtgtaccacatcgggaacctgctgaagggcgaccgcgtgaacgggcacctgatccacaagatcgagccgcacttcaacacgtcctggatgagctgggacggctgcgacctcgactactactgcaacatgggggactggccctcctgcacctacaccggcgtcacccagcacaaccacgccgcgttcgtgaacctgctgaacatcgagacggactacaccaagaccttccacttccacagcaagcgggtgaccgcccacggcgacacgccccagctcgacctgaaggcccgccccacctacggggccggcgagatcaccgtcctggtggaggtggcggacatggagctccacaccaagaaggtcgagatctccgggctgaagttcgccagcctgacgtgcaccggctgctacgcctgctccagcgggatctcctgcaaggtgcggatccacgtggacgagccggacgagctcaccgtccacgtcaagagctccgaccccgacgtggtggccgccggcaccagcctgatggcgcgcaagctggagttcggcacggacagcaccttcaaggccttctccgccatgcccaagaccagcctctgcttctacatcgtggagcgggagtactgcaagtcctgcagcgaggacgacacccagaagtgcgtggacaccaagctggagcagccccagtccatcctgatcgagcacaaggggacgatcatcggcaagcagaacgacacgtgcaccgcccgcgccagctgctggctcgagtccgtcaagagcttcttctacgggctgaagaacatgctgggctccgtgttcgggaacttcctcatcggcatcctgctgttcctcgcgccgttcgtgctgctggtcctcttcttcatgttcggctggaagatcctgttctgcttcaagtgctgccgccggacccgcgggctgttcaagtaccggcacctcaaggacgacgaggagaccggctaccgccggatcatcgagcgcctgaacagcaagaaggggaagaaccggctgctcgacggcgagcgcctggccgaccggaagatcgccgagctgttctccaccaagacccacatcggc

SEQ ID NO: 12140 - RNA, 3495 nt, synthetic construct
  misc_feature 1..3495: note = derived and/or modified CDS sequence (opt1) from CCHVF(CCHVF 24-R-2012)__KR814856.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtgaacgcgatcgacgccgagatgcacgacctcaactgcagctacaacatctgcccgtactgcgcctcccgcctgaccagcgacggcctggcccggcacgtcccccagtgccccaagcgcaaggagaaggtggaggagaccgagctctacctgaacctggagcggatcccctggatcgtgcgcaagctcctgcaggtctccgagagcaccggggtggcgctgaagcggtccagctggctcatcgtgctgctggtcctcctgacggtgagcctgtccccggtgcagagcgcccccgtcggccacgggaagaccatcgagacctaccagacccgcgagggcttcacgtccgtgtgcctcttcatgctgggcagcatcctgttcctcgtgtcctgcctggtcaaggggctggtggacagcgtgtccgacagcttcttccccggcctctccgtctgcaagacctgcagcatcgggtccatcaacggcttcgagatcgagagccacaagtgctactgctccctgttctgctgcccctactgccggcactgcagcgccgaccgcgagatccaccagctgcacctctccatctgcaagaagcggaagatggggagcaacgtgatgctggccgtctgcaagcgcatgtgcttccgggccaccatcgaggcgtcccgccgcgccctgctcatccggagcatcatcaacaccacgttcgtgatctgcatcctgaccctgaccatctgcgtggtctccaccagcgccgtggagatggagaacctcccgagcggcacgtgggagcgcgaggaggacctgaccaacttctgccaccaggagtgccaggtgaccgagaccgagtgcctgtgcccctacgaggccctggtcctccggaagcccctgttcctggactccatcgtgaagggcatgaagaacctcctgaacagcacgtccctggagaccagcctctccatcgaggccccctggggcgcgatcaacgtgcagagcaccttcaagccgaccgtctccaccgccaacatcgccctgagctggtccagcgtggagcaccgcgggaacaagatcctggtgacggggcggtccgagagcatcatgaagctcgaggagcgcaccggcgtctcctgggacctgggggtggaggacgccagcgagtccaagctgctcaccgtgagcatcatggacctgtcccagatgtacagccccgtcttcgagtacctgagcggcgaccgccaggtggaggagtggcccaaggcgacctgcacgggcgactgccccgagcggtgcgggtgcacctccagcacgtgcctccacaaggagtggccgcactcccggaactggcgctgcaaccccacctggtgctggggcgtggggaccggctgcacgtgctgcggcgtcgacgtgaaggacctgttcaccgaccacatgttcgtgaagtggaaggtcgagtacatcaagaccgaggccatcgtgtgcgtggagctgaccagccaggagcggcagtgctccctcatcgaggccgggacccgcttcaacctgggccccgtcaccatcaccctgagcgagccccggaacatccagcagaagctcccgcccgagatcatcacgctgcaccccaaggtggaggaggggttcttcgacctgatgcacgtgcagaaggtcctctccgccagcaccgtgtgcaagctgcagtcctgcacccacggcatcccgggggacctccaggtgtaccacatcggcaacctcctgaagggcgaccgcgtcaacgggcacctgatccacaagatcgagccccacttcaacaccagctggatgtcctgggacggctgcgacctcgactactactgcaacatgggggactggcccagctgcacgtacaccggcgtgacccagcacaaccacgccgccttcgtgaacctgctgaacatcgagaccgactacacgaagaccttccacttccactccaagcgggtcaccgcgcacggggacacgccccagctcgacctgaaggcccgcccgacctacggcgccggcgagatcaccgtgctggtggaggtcgccgacatggagctccacaccaagaaggtggagatcagcgggctgaagttcgcgtccctggcctgcaccggctgctacgcctgcagctccgggatcagctgcaaggtgcggatccacgtcgacgagcccgacgagctcacggtgcacgtgaagtccaacgaccccgacgtcgtggccgccagcaccagcctgatggcgcgcaagctggagttcggcaccgactccaccttcaaggccttcagcgccatgcccaagacgtccctctgcttctacatcgtggagcgggagtactgcaagagctgctccgaggaggacacccagaagtgcgtcgacaccaagctggagcagccgcagagcatcctgatcgagcacaaggggaccatcatcggcaagcagaacgacacgtgcaccgccaaggcctcctgctggctcgagagcgtgaagtccttcttctacggcctgaagaacatgctggggagcgtgttcggcaacttcttcatcgggatcctcctgttcctggcgcccttcgtcctcctggtgctgttcttcatgttcggctggaagatcctcttctgcttcaagtgctgccgccgcacccgggggctgctgaagtaccgcctcctgaaggacgacgaggagaccggctaccggcgcatcatcgagcggctgaacaacaagaagggcaagaaccgcctcctggacggggagcggctggccgaccgcaagatcgccgagctgttctccaccaagacgcacatcggc

SEQ ID NO: 12141 - RNA, 3495 nt, synthetic construct
  misc_feature 1..3495: note = derived and/or modified CDS sequence (opt1) from CCHVF(CCHVF 36-ST-2014)__KR814857.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacctgcatcttctgcaaggccctgttctacagcctcatcatcatcggcacgctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctgcaggtgagcgagtccaccggggtcgcgctgaagcgcagcagctggctcatcgtgctgctggtgctcctgacggtctccctgagccccgtgcagtccgccccggtgggccacgggaagaccatcgagacctaccagacccgggagggcttcacgaacatctgcctcttcatgctgggcagcatcctgttcatcgtctcctgcctcgtgaaggggctggtggacagcgtctccgacagcttcttccccggcctgtccgtgtgcaagacctgcagcatcgggtccatcaacggcttcgagatcgagagccacaagtgctactgctccctcttctgctgcccctactgccgccactgcagcgccgaccgggagatccaccagctgcacctggggatctgcaagaagcgcaagaccggctccaacgtgatgctcgccgtctgcaagcggatgtgcttcaaggccaccatcgaggcgagccgccgggccctgctgatccgctccatcatcaacacgaccttcgtgatctgcatcctcaccctggccatctgcgtcgtgagcacctccgccgtggagatggagaacctgcccgccggcacgtgggagcgcgaggaggacctcaccaacttctgccaccaggagtgccaggtcagcgagaccgagtgcctgtgcccgtacgaggcgctggtgctgcggaagcccctcttcctggacagcatcgtgaaggggatgaagaacctgctcaactccaccagcctggagacgtccctgagcatcgaggccccctggggcgccatcaacgtccagtccaccttcaagcccaccgtgagcaccgccaacatcgccctctcctggagctccgtggagcaccgcgggaacaagatcctggtcaccggccggagcgagtccatcatgaagctggaggagcgcacgggggtgagctgggacctcggcgtggaggacgcgtccgagagcaagctgctgaccgtctccatcatggacctcagccagatgtactccccggtgttcgagtacctgagcggcgaccggcaggtggaggagtggcccaaggccacctgcaccggggactgccccgagcgctgcggctgcacgagctccacctgcctgcacaaggagtggccccacagccggaactggcgctgcaacccgacctggtgctggggggtcggcaccggctgcacgtgctgcggggtggacgtgaaggacctcttcaccgaccacatgttcatcaagtggaaggtcgagtacatcaagaccgaggccatcgtgtgcgtggagctgacctcccaggagcggcagtgcagcctgatcgaggccggcacgcgcttcaacctcgggcccgtcaccatcaccctgtccgagccccggaacatccagcagaagctgcccccggagatcatcaccctccaccccaagatcgaggagggcttcttcgacctgatgcacgtgcagaaggtgctgagcgcctccacggtctgcaagctccagagctgcacccacgggatccccggcgacctgcagatctaccacatcggcaacctgctcaagggggaccgcctgaacggccacctgatccacaagatcgagccgcacttcaacacctcctggatgagctgggacgggtgcgacctcgactactactgcaacatgggcgactggccctcctgcacctacacgggggtgacccagcacaaccacgcggccttcgtgaacctgctgaacatcgagaccgactacaccaagacgttccacttccacagcaagcgggtcaccgcccacggcgacaccccccagctcgacctgaaggcccgccccacctacggcgcgggggagatcacggtgctggtggaggtcgccgacatggagctccacaccaagaaggtggagatctccggcctgaagttcgccagcctggcctgcaccgggtgctacgcctgctccagcggcatctcctgcaaggtgcggatccacgtcgacgagccggacgagctcaccgtgcacgtgaagagctccgaccccgacgtcgtggcggccagcacgagcctgatggcccgcaagctggagttcgggaccgactccaccttcaaggccttcagcgccatgcccaagacctccctctgcttctacatcgtggagcgggagtactgcaagagctgctccgaggacgacacgaagaagtgcgtcgacaccaagctggaccagccccagagcatcctgatcgagcacaagggcaccatcatcggcaagcagaacgacacctgcaccgcgaaggcctcctgctggctcgagagcgtgaagtccttcttctacgggctgaagaacatgctgggcagcgtgttcgggaacttcttcgtcggcatcctcctgttcctggccccgttcgtgctcctggtgctgttcttcatgtgcgggtggaagttcctcttctgcttcaagtgctgccgccggacgcgcggcctgttcaagtaccgccacctgaaggacgacgaggagaccggctaccggcgcatcatcgagcggctcaactccaagaaggggaagaaccgcctgctggacggcgagcggctcgccgaccgcaagatcgccgagctgttcagcaccaagtcccacatcggg

SEQ ID NO: 12142 - RNA, 3495 nt, synthetic construct
  misc_feature 1..3495: note = derived and/or modified CDS sequence (opt1) from CCHVF(CCHVF 37-R-2013)__KR814858.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtgaacgcgatcgacgccgagatgcacgacctcaactgcagctacaacatctgcccgtactgcgcctcccgcctgaccagcgacggcctggcccggcacgtcccccagtgccccaagcgcaaggagaaggtggaggagaccgagctctacctgaacctggagcggatcccctggatcgtgcgcaagctcctgcaggtctccgagagcaccggggtggcgctgaagcggtccagctggctcatcgtgctgctggtcctcctgacggtgagcctgtccccggtgcagagcgcccccgtcggccacgggaagaccatcgagacctaccagacccgcgagggcttcacgtccgtgtgcctcttcatgctgggcagcatcctgttcctcgtgtcctgcctggtcaaggggctggtggacagcgtgtccgacagcttcttccccggcctctccgtctgcaagacctgcagcatcgggtccatcaacggcttcgagatcgagagccacaagtgctactgctccctgttctgctgcccctactgccggcactgcagcgccgaccgcgagatccaccagctgcacctctccatctgcaagaagcggaagatggggagcaacgtgatgctggccgtctgcaagcgcatgtgcttccgggccaccatcgaggcgtcccgccgcgccctgctcatccggagcatcatcaacaccacgttcgtgatctgcatcctgaccctgaccatctgcgtggtctccaccagcgccgtggagatggagaacctcccgagcggcacgtgggagcgcgaggaggacctgaccaacttctgccaccaggagtgccaggtgaccgagaccgagtgcctgtgcccctacgaggccctggtcctccggaagcccctgttcctggactccatcgtgaagggcatgaagaacctcctgaacagcacgtccctggagaccagcctctccatcgaggccccctggggcgcgatcaacgtgcagagcaccttcaagccgaccgtctccaccgccaacatcgccctgagctggtccagcgtggagcaccgcgggaacaagatcctggtgacggggcggtccgagagcatcatgaagctcgaggagcgcaccggcgtctcctgggacctgggggtggacgacgccagcgagtccaagctgctcaccgtgagcatcatggacctgtcccagatgtacagccccgtcttcgagtacctgagcggcgaccgccaggtggaggagtggcccaaggcgacctgcacgggcgactgccccgagcggtgcgggtgcacctccagcacgtgcctccacaaggagtggccgcactcccggaactggcgctgcaaccccacctggtgctggggcgtggggaccggctgcacgtgctgcggcgtcgacgtgaaggacctgttcaccgaccacatgttcgtgaagtggaaggtcgagtacatcaagaccgaggccatcgtgtgcgtggagctgaccagccaggagcggcagtgctccctcatcgaggccgggacccgcttcaacctgggccccgtcaccatcaccctgagcgagccccggaacatccagcagaagctcccgcccgagatcatcacgctgcaccccaaggtggaggaggggttcttcgacctgatgcacgtgcagaaggtcctctccgccagcaccgtgtgcaagctgcagtcctgcacccacggcatcccgggggacctccaggtgtaccacatcggcaacctcctgaagggcgaccgcgtcaacgggcacctgatccacaagatcgagccccacttcaacaccagctggatgtcctgggacggctgcgacctcgactactactgcaacatgggggactggcccagctgcacgtacaccggcgtgacccagcacaaccacgccgccttcgtgaacctgctgaacatcgagaccgactacacgaagaccttccacttccactccaagcgggtcaccgcgcacggggacacgccccagctcgacctgaaggcccgcccgacctacggcgccggcgagatcaccgtgctggtggaggtcgccgacatggagctccacaccaagaaggtggagatcagcgggctgaagttcgcgtccctggcctgcaccggctgctacgcctgcagctccgggatcagctgcaaggtgcggatccacgtcgacgagcccgacgagctcacggtgcacgtgaagtccaacgaccccgacgtcgtggccgccagcaccagcctgatggcgcgcaagctggagttcggcaccgactccaccttcaaggccttcagcgccatgcccaagacgtccctctgcttctacatcgtggagcgggagtactgcaagagctgctccgaggaggacacccagaagtgcgtcgacaccaagctggagcagccgcagagcatcctgatcgagcacaaggggaccatcatcggcaagcagaacgtgacctgcacggccaaggcctcctgctggctcgagagcgtgaagtccttcttctacggcctgaagaacatgctggggagcgtcttcggcaacttcttcatcgggatcctcctgttcctggcgcccttcgtgctcctggtgctgttcttcatgttcggctggaagatcctcttctgcttcaagtgctgccgccgcacccgggggctgctgaagtaccgcctcctgaaggacgacgaggagaccggctaccggcgcatcatcgagcggctgaacaacaagaagggcaagaaccgcctcctggacggggagcggctggccgaccgcaagatcgccgagctgttctccaccaagacgcacatcggc

SEQ ID NO: 12143 - RNA, 3495 nt, synthetic construct
  misc_feature 1..3495: note = derived and/or modified CDS sequence (opt1) from CCHVF(CCHVF 44-ST-2010)__KR814859.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgctgtggttctccttcggctacgtcatcacctgcatcttctgcaaggccctcttctacagcctgatcatcatcggcacgctggggaagaagatcaagcagtaccgcgagctcaagccccagacctgcaccatctgcgagaccgcccccgtgaacgcgatcgacgccgagatgcacgacctgaactgctcctacaacatctgcccgtactgcgccagccggctgacgtccgacggcctcgcccgccacgtgacccagtgccccaagcggaaggagaaggtcgaggagaccgagctgtacctgaacctcgagcgcatcccctggatcgtgcggaagctgctgcaggtgagcgagtccaccggggtcgcgctcaagcgcagcagctggctgatcgtgctgctcgtgctgctgacggtctccctcagccccgtgcagtccgccccggtgggccacgggaagaccatcgagacctaccagacccgggagggcttcacgaacatctgcctgttcatgctgggcagcatcctcttcatcgtctcctgcctggtgaaggggctggtggacagcgtctccgacagcttcttccccggcctctccgtgtgcaagacctgcagcttcgggtccatcaacggcttcgagatcgagagccacaagtgctactgctccctgttctgctgcccctactgccgccactgcagcgccgaccgggagatccaccagctgcacctcgggatctgcaagaagcgcaagaccggctccaacgtgatgctggccgtctgcaagcggatgtgcttcaaggccaccatcgaggcgagccgccgggccctgctcatccgctccatcatcaacacgaccttcgtgatctgcatcctgaccctggccatctgcgtcgtgagcacctccgccgtggagatggagaacctccccgccggcacgtgggagcgcgaggaggacctgaccaacttctgccaccaggagtgccaggtcagcgagaccgagtgcctgtgcccgtacgaggcgctggtgctccggaagcccctgttcctggacagcatcgtgaaggggatgaagaacctcctgaactccaccagcctggagacgtccctcagcatcgaggccccctggggcgccatcaacgtccagtccaccttcaagcccaccgtgagcaccgccaacatcgccctgtcctggagctccgtggagcaccgcgggaacaagatcctggtcaccggccggagcgagtccatcatgaagctcgaggagcgcacgggggtgagctgggacctgggcgtggaggacgcgtccgagagcaagctgctcaccgtctccatcatggacctgagccagatgtactccccggtgttcgagtacctgagcggcgaccggcaggtggaggagtggcccaaggccacctgcaccggggactgccccgagcgctgcggctgcacgagctccacctgcctccacaaggagtggccccacagccggaactggcgctgcaacccgacctggtgctggggggtcggcaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggccggcacgcgcttcaacctggggcccgtcaccatcaccctgtccgagccccggaacatccagcagaagctccccccggagatcatcaccctgcaccccaagatcgaggagggcttcttcgacctgatgcacgtgcagaaggtgctcagcgcctccacggtctgcaagctgcagagctgcacccacgggatccccggcgacctgcagatctaccacatcggcaacctcctgaagggggaccgcctgaacggccacctcatccacaagatcgagccgcacttcaacacctcctggatgagctgggacgggtgcgacctggactactactgcaacatgggcgactggccctcctgcacctacacgggggtgacccagcacaaccacgcggccttcgtgaacctgctcaacatcgagaccgactacaccaagacgttccacttccacagcaagcgggtcaccgcccacggcgacaccccccagctggacctgaaggcccgccccacctacggcgcgggggagatcacggtgctcgtggaggtcgccgacatggagctgcacaccaagaaggtggagatctccggcctgaagttcgccagcctcgcctgcaccgggtgctacgcctgctccagcggcatctcctgcaaggtgcggatccacgtcgacgagccggacgagctgaccgtgcacgtgaagagctccgaccccgacgtcgtggcggccagcacgagcctgatggcccgcaagctcgagttcgggaccgactccaccttcaaggccttcagcgccatgcccaagacctccctgtgcttctacatcgtggagcgggagtactgcaagagctgctccgaggacgacacgaagaagtgcgtcgacaccaagctggaccagccccagagcatcctcatcgagcacaagggcaccatcatcggcaagcagaacgacacctgcaccgcgaaggcctcctgctggctggagagcgtgaagtccttcttctacgggctgaagaacatgctcggcagcgtgttcgggaacttcttcgtcggcatcctgctgttcctcgccccgttcgtgctgctggtgctcttcttcatgtgcgggtggaagatcctgttctgcttcaagtgctgccgccggacgcgcggcctgttcaagtaccgccacctcaaggacgacgaggagaccggctaccggcgcatcatcgagcggctgaactccaagaaggggaagaaccgcctgctcgacggcgagcggctggccgaccgcaagatcgccgagctgttcagcaccaagtcccacatcggg

SEQ ID NO: 12144 - RNA, 3495 nt, synthetic construct
  misc_feature 1..3495: note = derived and/or modified CDS sequence (opt1) from CCHVF(CCHVF 46-ST-2012)__KR814860.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacctgcatcttctgcaaggccctgttctacagcctcatcatcatcggcacgctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagaccgggtccaacgtcatgctggccgtgtgcaagcgcatgtgcttccgggccaccatcgaggcgagccgccgcgccctgctcatccggtccatcatcaacgccaccttcgtcatctgcatcctgacgctgaccatctgcgtggtgagcaccagcgccgtcgagatggagtccctcccggccggcacctgggagcgcgaggaggacctgacgaacttctgccaccaggagtgccaggtgaccgagaccgagtgcctgtgcccctacgaggcgctggtgctccggaagcccctgttcctggacagcatcgtcaagggcatgaagaacctcctgaactccaccagcctggagacgtccctcagcatcgaggccccctggggggccatcaacgtgcagtccaccttcaagccgaccgtgagcaccgccaacatcgccctgtcctggagctccgtcgagcaccgcggcaacaagatcctggtgaccgggcggagcgagtccatcatgaagctcgaggagcgcacgggcgtgagctgggacctgggggtcgaggacgcgtccgagagcaagctgctcaccgtgtccatcatggacctgagccagatgtacagccccgtgttcgagtacctgtccggcgaccggcaggtcgaggagtggcccaaggccacctgcaccggcgactgccccgagcgctgcgggtgcacgagctccacctgcctccacaaggagtggccgcacagccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgacctcccaggagcggcagtgcagcctcatcgaggccgggacgcgcttcaacctgggccccgtgaccatcaccctgtccgagccccggaacatccagcagaagctcccgcccgagatcatcaccctgcaccccaaggtcgaggaggggttcttcgacctgatgcacgtgcagaaggtgctcagcgcctccacggtctgcaagctgcagagctgcacccacggcatcccgggggacctgcaggtgtaccacatcggcaacctcctgaagggcgaccgcatcaacgggcacctgatccacaagatcgagccccacttcaacacctcctggatgagctgggacggctgcgacctcgactactactgcaacatgggggactggccctcctgcacctacacgggcgtgacccagcacaaccacgcggccttcgtcaacctgctgaacatcgagaccgactacaccaagacgttccacttccacagcaagcgggtgaccgcccacggggacaccccccagctcgacctgaaggcccgcccgacctacggcgcgggcgagatcacggtgctggtcgaggtggccgacatggagctccacaccaagaaggtggagatctccgggctgaagttcgccagcctggcctgcaccggctgctacgcctgctccagcgggatctcctgcaaggtccggatccacgtggacgagcccgacgagctcaccgtgcacgtcaagagcagcgaccccgacgtggtggcggcctccacgagcctgatggcccgcaagctggagttcggcaccgactccaccttcaaggccttcagcgccatgcccaagacctccctctgcttctacatcgtcgagcgggagtactgcaagagctgctccgaggaggacacgcagaagtgcgtggacacccgcctggagcagccgcagagcatcctgatcgagcacaaggggaccatcatcggcaagcagaacgacacctgcaccgcgaaggcctcctgctggctcgagagcgtgaagtccttcttctacggcctgaagaacatgctggggagcgtcttcggcaacttcttcatcgggatcctcctgttcctggcccccttcgtgctcctggtgctgttcttcatgttcggctggaagatcctcttctgcttcaagtgctgccgccggacgcgcgggctgctgaagtaccggcacctcaaggacgacgaggagaccggctaccgccggatcatcgagcgcctgaacaacaagaagggcaagaaccggctgctcgacggggagcgcctggccgaccggaagatcgccgagctgttctccaccaagacccacatcggc

SEQ ID NO: 12145 - RNA, 3495 nt, synthetic construct
  misc_feature 1..3495: note = derived and/or modified CDS sequence (opt1) from CCHVF(CCHVF 47-ST-2013)__KR814861.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccacgggaagaccatcgagacctaccagacccgggagggcttcacgagcatctgcctcttcatgctgggctccatcctgttcatcgtcagctgcctcgtgaaggggctggtggactccgtcagcgactccttcttccccggcctgagcgtgtgccggacctgctccatcgggagcatcaacggcttcgagatcgagtcccacaagtgctactgcagcctcttctgctgcccctactgccgccactgctccgccgaccgcgagatccaccagctgcacctgagcatctgcaagaagcggaagaccgggtccaacgtgatgctcgccgtctgcaagcgcatgtgcttcaaggccaccatcgaggcgagccggcgcgccctgttcatccgctccatcatcaacacgaccttcgtgacctgcatcctgaccctcgccatctgcgtcgtgagcacgagcgccgtggagatggaggacctgcccgccggcacctgggagcgggaggaggacctgaccaacttctgccaccaggagtgccaggtcaccgagacggagtgcctctgcccgtacgaggcgctggtgctgcgcaagcccctgttcctcgactccatcgtgaagggcatgaagaacctgctgaacagcacctccctcgagaccagcctgtccatcgaggccccctggggcgccatcaacgtccagagcaccttcaagcccaccgtgtccacggccaacatcgccctgagctggtccagcgtggagcaccgggggaacaagatcctcgtcaccgggcgctccgagagcatcatgaagctggaggagcggaccggcgtgtcctgggacctgggggtggaggacgcgagcgagtccaagctcctgaccgtcagcatcatggacctgtcccagatgtacagcccggtgttcgagtacctcagcggcgaccgccaggtggaggagtggcccaaggccacgtgcaccggcgagtgccccgagcggtgcgggtgcacctccagcacgtgcctgcacaaggagtggccccactcccgcaactggcggtgcaacccgacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctcaccagccaggagcgccagtgctccctgatcgaggccgggacccggttcaacctgggccccgtcaccatcacgctcagcgagccccgcaacatccagcagaagctgcccccggagatcatcaccctgcaccccaagatcgaggaggggttcttcgacctcatgcacgtgcagaaggtgctgtccgccagcaccgtctgcaagctgcagtcctgcacccacggcatccccggggacctccagatctaccacatcggcaacctgctgaagggcgaccgggtgaacgggcacctcatccacaagatcgagccgcacttcaacacgagctggatgtcctgggacggctgcgacctggactactactgcaacatgggggactggcccagctgcacctacaccggcgtgacccagcacaaccacgcggccttcgtcaacctgctcaacatcgagacggactacaccaagaccttccacttccactccaagcgcgtgaccgcccacggggacacgccccagctggacctgaaggcccggcccacctacggcgcgggcgagatcaccgtgctcgtcgaggtggccgacatggagctgcacaccaagaaggtggaggtcagcgggctgaagttcgcctccctcgcctgcacgggctgctacgcctgcagctccgggatcagctgcaaggtgcgcatccacgtggacgagccggacgagctgaccgtccacgtgaagtccagcgaccccgacgtggtcgcggccagcacctccctgatggcccggaagctcgagttcggcaccgacagcacgttcaaggccttctccgccatgcccaagaccagcctgtgcttctacatcgtggagcgcgagtactgcaagtcctgcagcgaggacgacaccaagaagtgcgtggacaccaagctggagcagccccagtccatcctcatcgagcacaaggggaccatcatcggcaagcagaacgacacgtgcaccgcgaaggccagctgctggctggagtccgtcaagagcttcttctacggcctgaagaacatgctcgggtccgtgttcggcaacttcttcgtggggatcctgctgttcctcgccccgttcgtcctgctggtgctgttcttcatgttcggctggaagatcctgttctgcttcaagtgctgccggcgcacccgcgggctgttcaagtaccggcacctcaaggacgacgaggagaccggctaccgccggatcatcgagcgcctgaacagcaagaagggcaagaaccggctgctcgacggggagcgcctggccgaccggaagatcgccgagctgttctccacgaagacccacatcggc

SEQ ID NO: 12146 - RNA, 3495 nt, synthetic construct
  misc_feature 1..3495: note = derived and/or modified CDS sequence (opt1) from CCHVF(CCHVF 52-R-2014)__KR814862.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacgtgccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtcaacgcgatcgacgccgagatgcacgacctcaactgcagctacaacatctgcccgtactgcgcctcccgcctgaccagcgacggcctggcccggcacgtgccccagtgccccaagcgcaaggagaaggtggaggagaccgagctctacctgaacctggagcggatcccctggatcgtccgcaagctcctccaggtgtccgagagcaccggggtggcgctgaagcggtccagctggctcatcgtcctgctggtgctcctgacggtgagcctgtccccggtccagagcgcccccgtgggccacgggaagaccatcgagacctaccagacccgcgagggcttcacgtccgtgtgcctcttcatgctgggcagcatcctgttcctcgtctcctgcctggtgaaggggctggtggacagcgtctccgacagcttcttccccggcctctccgtgtgcaagacctgcagcatcgggtccatcaacggcttcgagatcgagagccacaagtgctactgctccctgttctgctgcccctactgccggcactgcagcgccgaccgcgagatccaccagctgcacctctccatctgcaagaagcggaagatggggagcaacgtcatgctggccgtgtgcaagcgcatgtgcttccgggccaccatcgaggcgtcccgccgcgccctgctcatccggagcatcatcaacaccacgttcgtgatctgcatcctgaccctgaccatctgcgtcgtgtccaccagcgccgtggagatggagaacctcccgagcggcacgtgggagcgcgaggaggacctgaccaacttctgccaccaggagtgccaggtcaccgagaccgagtgcctgtgcccctacgaggccctggtgctccggaagcccctgttcctggactccatcgtgaagggcatgaagaacctcctgaacagcacgtccctggagaccagcctctccatcgaggccccctggggcgcgatcaacgtccagagcaccttcaagccgaccgtgtccaccgccaacatcgccctgagctggtccagcgtggagcaccgcgggaacaagatcctggtcacggggcggtccgagagcatcatgaagctcgaggagcgcaccggcgtgtcctgggacctgggggtggacgacgccagcgagtccaagctgctcaccgtcagcatcatggacctgtcccagatgtacagccccgtgttcgagtacctgagcggcgaccgccaggtggaggagtggcccaaggcgacctgcacgggcgactgccccgagcggtgcgggtgcacctccagcacgtgcctccacaaggagtggccgcactcccggaactggcgctgcaaccccacctggtgctggggcgtcgggaccggctgcacgtgctgcggcgtggacgtgaaggacctgttcaccgaccacatgttcgtcaagtggaaggtggagtacatcaagaccgaggccatcgtgtgcgtcgagctgaccagccaggagcggcagtgctccctcatcgaggccgggacccgcttcaacctgggccccgtgaccatcaccctgagcgagccccggaacatccagcagaagctcccgcccgagatcatcacgctgcaccccaaggtggaggaggggttcttcgacctgatgcacgtccagaaggtgctctccgccagcaccgtgtgcaagctgcagtcctgcacccacggcatcccgggggacctgcaggtctaccacatcggcaacctcctgaagggcgaccgcgtgaacgggcacctgatccacaagatcgagccccacttcaacaccagctggatgtcctgggacggctgcgacctcgactactactgcaacatgggggactggcccagctgcacgtacaccggcgtgacccagcacaaccacgccgccttcgtcaacctgctgaacatcgagaccgactacacgaagaccttccacttccactccaagcgggtgaccgcgcacggggacacgccccagctcgacctgaaggcccgcccgacctacggcgccggcgagatcaccgtgctggtcgaggtggccgacatggagctccacaccaagaaggtggagatcagcgggctgaagttcgcgtccctggcctgcaccggctgctacgcctgcagctccgggatcagctgcaaggtccggatccacgtggacgagcccgacgagctcacggtgcacgtcaagtccaacgaccccgacgtggtggccgccagcaccagcctgatggcgcgcaagctggagttcggcaccgactccaccttcaaggccttcagcgccatgcccaagacgtccctctgcttctacatcgtcgagcgggagtactgcaagagctgctccgaggaggacacccagaagtgcgtggacaccaagctggagcagccgcagagcatcctgatcgagcacaaggggaccatcatcggcaagcagaacgacacgtgcaccgccaaggccggctgctggctcgagtccgtcaagagcttcttctacgggctgaagaacatgctgggctccgtgttcgggaacttcttcatcggcatcctcctgttcctggcgcccttcgtgctcctggtgctgttcttcatgttcgggtggaagatcctcttctgcttcaagtgctgccgccgcacccggggcctgctgaagtaccgcctcctgaaggacgacgaggagaccggctaccggcgcatcatcgagcggctgaacaacaagaaggggaagaaccgcctcctggacggcgagcggctggccgaccgcaagatcgccgagctgttcagcaccaagacgcacatcggg

SEQ ID NO: 12147 - RNA, 3495 nt, synthetic construct
  misc_feature 1..3495: note = derived and/or modified CDS sequence (opt1) from CCHVF(CCHVF 75-R-2012)__KR814863.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcgcgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccccacatcccgctgctcgggaagatggccatctacatctgccggatgagcaaccacccccgcacgaccatggccttcctgttctggttctccttcggctacgtgatcacctgcatcttctgcaaggccctgttctacagcctcatcatcatcggcaccctggggaagaagatcaagcagtaccgggagctgaagccccagacgtgcaccatctgcgagaccgcgcccgtgaacgccatcgacgccgagatgcacgacctcaactgctcctacaacatctgcccgtactgcgccagccgcctgacctccgacggcctggcgcggcacgtcccccagtgccccaagcgcaaggagaaggtggaggagacggagctctacctgaacctggagcggatcccctggatcgtgcgcaagctcctgcaggtcagcgagtccaccggggtggccctgaagcggagcagctggctcatcgtgctgctggtcctcctgaccgtgtccctgagcccggtgcagtccgcccccgtcggccacgggaagaccatcgagacgtaccagacccgcgagggcttcaccagcatctgcctcttcatgctgggctccatcctgttcctcgtgagctgcctggtgaaggggctggtcaactccgtgagcgactccttcttccccggcctcagcgtgtgcaagacctgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagacggggtccaacgtcatgctggccgtgtgcaagcgcatgtgcttccgggcgaccatcgaggccagccgccgcgccctgctcatccggtccatcatcaacaccaccttcgtcatctgcatcctgacgctgaccatctgcgtggtgagcaccagcgccgtcgagatggagaacctcccgtccggcacctgggagcgcgaggaggacctgacgaacttctgccaccaggagtgccaggtgaccgagaccgagtgcctgtgcccctacgaggccctggtgctccggaagcccctgttcctggacagcatcgtcaagggcatgaagaacctcctgaactccaccagcctggagacgtccctcagcatcgaggcgccctggggggccatcaacgtgcagtccaccttcaagccgaccgtgagcaccgccaacatcgccctgtcctggagctccgtcgagcaccgcggcaacaagatcctggtgaccgggcggagcgagtccatcatgaagctcgaggagcgcacgggcgtgagctgggacctgggggtcgaggacgcctccgagagcaagctgctcaccgtgtccatcatggacctgagccagatgtacagccccgtgttcgagtacctgtccggcgaccggcaggtcgaggagtggcccaaggcgacctgcaccggcgactgccccgagcgctgcgggtgcacgagctccacctgcctccacaaggagtggccgcacagccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgacctcccaggagcggcagtgcagcctcatcgaggccgggacgcgcttcaacctgggccccgtgaccatcaccctgtccgagccccggaacatccagcagaagctcccgcccgagatcatcaccctgcaccccaaggtcgaggaggggttcttcgacctgatgcacgtgcagaaggtgctcagcgcctccacggtctgcaagctgcagagctgcacccacggcatcccgggggacctgcaggtgtaccacatcggcaacctcctgaagggcgaccgcgtgaacgggcacctgatccacaagatcgagccccacttcaacacctcctggatgagctgggacggctgcgacctcgactactactgcaacatgggggactggccctcctgcacctacacgggcgtcacccagcacaaccacgccgcgttcgtgaacctgctgaacatcgagaccgactacaccaagacgttccacttccacagcaagcgggtgaccgcccacggggacaccccccagctcgacctgaaggcccgcccgacctacggcgccggcgagatcacggtcctggtggaggtggcggacatggagctccacaccaagaaggtcgagatctccgggctgaagttcgccagcctggcctgcaccggctgctacgcctgctccagcgggatctcctgcaaggtgcggatccacgtggacgagcccgacgagctcaccgtccacgtgaagagcagcgaccccgacgtggtcgccgcgtccacgagcctgatggcccgcaagctggagttcggcaccgactccaccttcaaggccttcagcgccatgcccaagacctccctctgcttctacatcgtggagcgggagtactgcaagagctgctccgaggaggacacgcagaagtgcgtggacaccaagctggagcagccgcagagcatcctgatcgagcacaaggggaccatcatcggcaagcagaacgacacctgcaccgccaaggcgtcctgctggctcgagagcgtcaagtccttcctgtacggcctgaagaacatgctcgggagcgtgttcggcaacttcttcatcgggatcctgctgttcctcgcccccttcgtgctgctggtcctcttcttcatgttcggctggaagatcctgttctgcttcaagtgctgccgccgcacgcgggggctgctcaagtaccgcctgctgaaggacgacgaggagaccggctaccggcgcatcatcgagcggctcaacaacaagaagggcaagaaccgcctgctggacggggagcggctcgccgaccgcaagatcgccgagctgttctccaccaagacccacatcggc

SEQ ID NO: 12148 - RNA, 3495 nt, synthetic construct
  misc_feature 1..3495: note = derived and/or modified CDS sequence (opt1) from CCHVF(CCHVF 75-ST-2010)__KR814864.1__Gn-NSm-Gc
  source 1..3495: mol_type = other RNA
agcgaggagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacctgcgagatcgactccaccccggtgaagtgccgccaggggttctgcctgaagatcacccaggagggccgggggcacgtgaagctgagccgcggctccgaggtcgtgctcgacgcgtgcgacagctcctgcgaggtgatgatccccaaggggacgggcgacatcctggtcgactgcagcggcgggcagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcctgttctgcaaggccctcttctactccctgatcatcatcggcaccctggggaagaagatcaagcagtaccgggagctccgcccccagacctgcaccatctgcgagaccgcccccgtgaacgcgatcgacgccgagatgcacgacctgaactgcagctacaacatctgcccctactgcgcctcccggctgacgagcgacggcctcgcccgccacgtcccgcagtgccccaagcggaaggagaaggtggaggagaccgagctgtacctgaacctcgagcgcatcccctggatcgtgcggaagctgctgcaggtctccgagagcaccggggtggcgctcaagcgcagctcctggctgatcgtgctgctcgtcctgctgaccgtgagcctctcccccgtgcagagcgccccggtcggccacgggaagacgatcgagacctaccagacccgggagggcttcacctccatctgcctgttcatgctgggcagcatcctcttcctggtgtcctgcctggtgaaggggctcgtcgacagcgtgtccgacagcttcttccccggcctgtccgtgtgcaagacgtgcagcatcgggtccatcaacggcttcgagatcgagagccacaagtgctactgctccctgctctgctgcccctactgccgccactgcagcgccgaccgggagatccaccagctgcacctgtccatctgcaagaagcgcaagaccgggagcaacgtcatgctcgccgtgtgcaagcggatgtgcttccgcgccaccatcgaggcgtcccgccgggccctgctgatccgcagcatcatcaacaccacgttcgtcatctgcatcctcaccctgaccatctgcgtggtgagcacctccgccgtcgagatggagaacctgcccagcggcacgtgggagaaggaggaggacctgaccaacttctgccaccaggagtgccaggtgaccgagaccgagtgcctctgcccgtacgaggccctggtgctgcggaagcccctcttcctggactccatcgtcaagggcatgaagaacctgctcaacagcacgtccctggagaccagcctgtccatcgaggccccctggggcgcgatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgccagcgagtccaagctgctgaccgtgagcatcatggacctcagccagatgtactccccggtgttcgagtacctgagcggcgaccggcaggtcgaggagtggcccaaggcgacctgcacgggcgactgccccgagcgctgcgggtgcacctccagcacgtgcctgcacaaggagtggccccactcccggaactggcgctgcaacccgacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcggcagtgctccctgatcgaggccgggacccgcttcaacctcggccccgtgaccatcaccctgagcgagccccggaacatccagcagaagctgcccccggagatcatcacgctccaccccaaggtcgaggaggggttcttcgacctgatgcacgtgcagaaggtgctgtccgccagcaccgtctgcaagctccagtcctgcacccacggcatccccggggacctccaggtgtaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacgtacaccggcgtcacccagcacaaccacgccgccttcgtgaacctcctgaacatcgagaccgactacacgaagaccttccacttccactccaagcgggtgaccgcgcacggggacacgccccagctggacctcaaggcccgccccacctacggcgccggcgagatcaccgtcctggtggaggtggccgacatggagctgcacaccaagaaggtcgagatcagcgggctcaagttcgcgtccctggcctgcaccggctgctacgcctgcagctccgggatcagctgcaaggtgcggatccacgtggacgagccggacgagctgacggtccacgtcaagagctccgaccccgacgtggtggccgccagcacctccctcatggcgcgcaagctggagttcggcaccgacagcaccttcaaggccttctccgccatgcccaagacgagcctgtgcttctacatcgtggagcgggagtactgcaagtcctgcagcgaggaggacacccagaagtgcgtggacaccaagctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacttcttcatcgggatcctgctgttcctggcgccgttcgtgctgctcgtcctgttcttcatgttcggctggaagatcctgttctgcttcaagtgctgccgccgcgcccgggggctcctgaagtaccgccacctgaaggacgacgaggagaccggctaccggaagatcatcgagcgcctcaacaacaagaagggcaagaaccggctgctggacggggagcgcctcgccgaccggaagatcgccgagctgttcagcaccaagacccacatcggc

SEQ ID NO: 12149 - RNA, 3495 nt, synthetic construct
  misc_feature 1..3495: note = derived and/or modified CDS sequence (opt1) from CCHVF(CCHVF 81-R-2014)__KR814865.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagaccgggtccaacgtcatgctggccgtgtgcaagcgcatgtgcttccgggccaccatcgaggcgagccgccgcgccctgctcatccggtccatcatcaacaccacgttcgtcatctgcatcctgaccctgaccatctgcgtggtgagcaccagcgccgtcgagatggagaacctcccggccggcacgtgggagcgcgaggaggacctgaccaacttctgccaccaggagtgccaggtgaccgagaccgagtgcctgtgcccctacgaggccctggtgctccggaagcccctgttcctggactccatcgtcaagggcatgaagaacctcctgaacagcacgtccctggagaccagcctctccatcgaggcgccctggggcgccatcaacgtgcagagcaccttcaagccgaccgtgtccaccgccaacatcgccctgagctggtccagcgtcgagcaccgcgggaacaagatcctggtgacggggcggtccgagagcatcatgaagctcgaggagcgcaccggcgtgtcctgggacctgggggtcgaggacgccagcgagtccaagctgctcaccgtgagcatcatggacctgtcccagatgtacagccccgtgttcgagtacctgagcggcgaccggcaggtcgaggagtggcccaaggcgacctgcacgggcgactgccccgagcgctgcgggtgcacctccagcacgtgcctccacaaggagtggccgcactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgaccagccaggagcggcagtgctccctcatcgaggccgggacccgcttcaacctgggccccgtgaccatcaccctgagcgagccccggaacatccagcagaagctcccgcccgagatcatcacgctgcaccccaaggtcgaggaggggttcttcgacctgatgcacgtgcagaaggtgctctccgccagcaccgtctgcaagctgcagtcctgcacccacggcatcccgggggacctccaggtgtaccacatcggcaacctgctgaagggcgaccgcatcaacgggcacctgatccacaagatcgagccccacttcaacaccagctggatgtcctgggacggctgcgacctcgactactactgcaacatgggggactggcccagctgcacgtacaccggcgtgacccagcacaaccacgccgcgttcgtcaacctgctgaacatcgagaccgactacacgaagaccttccacttccactccaagcgggtgaccgcccacggggacacgccccagctcgacctgaaggcccgcccgacctacggcgccggcgagatcaccgtgctggtcgaggtggcggacatggagctccacaccaagaaggtggagatcagcgggctgaagttcgcctccctggcctgcaccggctgctacgcctgcagctccgggatcagctgcaaggtccggatccacgtggacgagcccgacgagctcacggtgcacgtcaagtccagcgaccccgacgtggtggccgcgagcacctccctgatggcccgcaagctggagttcggcaccgacagcaccttcaaggccttctccgccatgcccaagacgagcctctgcttctacatcgtcgagcgggagtactgcaagtcctgcagcgaggaggacacccagaagtgcgtggacacccgcctggagcagccgcagtccatcctgatcgagcacaaggggaccatcatcggcaagcagaacgacacgtgcaccgccaaggcgagctgctggctcgagtccgtcaagagcttcttctacggcctgaagaacatgctggggtccgtgttcggcaacttcttcatcgggatcctcctgttcctggcccccttcgtgctcctggtgctgttcttcatgttcggctggaagatcctcttctgcttcaagtgctgccgccggacccgcgggctgctgaagtaccggcacctcaaggacgacgaggagaccggctaccgccggatcatcgagcgcctgaacaacaagaagggcaagaaccggctgctcgacggggagcgcctggccgaccggaagatcgccgagctgttcagcaccaagacgcacatcggc

SEQ ID NO: 12150 - RNA, 3495 nt, synthetic construct
  misc_feature 1..3495: note = derived and/or modified CDS sequence (opt1) from CCHVF(CCHVF 3756-ST-2007)__KR814866.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccacgggaagaccatcgagacctaccagacccgggagggcttcacgagcatctgcctcttcatgctgggctccatcctgttcatcgtcagctgcctcgtgaaggggctggtggactccgtcagcgactccttcttccccggcctgagcgtgtgcaagacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtgatgctcgccgtctgcaagcggatgtgcttcaaggccaccatcgaggcgagccgccgggccctgctgatccgctccatcatcaacacgaccttcgtgatctgcatcctcaccctggccatctgcgtcgtgagcaccagcgccgtggagatggaggacctgcccgccggcacgtgggagcgcgaggaggacctcaccaacttctgccaccaggagtgccaggtcaccgagaccgagtgcctgtgcccgtacgaggcgctggtgctgcggaagcccctcttcctggactccatcgtgaagggcatgaagaacctgctcaacagcacgtccctggagaccagcctgtccatcgaggccccctggggcgccatcaacgtccagagcaccttcaagcccaccgtgtccaccgccaacatcgccctcagctggtccagcgtggagcaccgcgggaacaagatcctggtcacggggcggtccgagagcatcatgaagctggaggagcgcaccggcgtgtcctgggacctcggggtggaggacgcgagcgagtccaagctgctgaccgtcagcatcatggacctctcccagatgtacagcccggtgttcgagtacctgagcggcgaccgccaggtggaggagtggcccaaggcgacctgcacgggcgactgccccgagcggtgcgggtgcacctccagcacgtgcctgcacaaggagtggccccactcccggaactggcgctgcaacccgacctggtgctggggcgtcgggaccggctgcacgtgctgcggcgtggacgtgaaggacctcttcaccgaccacatgttcatcaagtggaaggtcgagtacatcaagaccgaggccatcgtgtgcgtggagctgaccagccaggagcggcagtgctccctgatcgaggccgggacccgcttcaacctcggccccgtcaccatcaccctgagcgagccccggaacatccagcagaagctgcccccggagatcatcacgctccaccccaagatcgaggaggggttcttcgacctgatgcacgtgcagaaggtgctgtccgccagcaccgtctgcaagctccagtcctgcacccacggcatccccggggacctgcagatctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacgtacaccggcgtgacccagcacaaccacgccgccttcgtcaacctcctgaacatcgagaccgactacacgaagaccttccacttccactccaagcgggtgaccgcccacggggacacgccccagctggacctcaaggcccgccccacctacggcgcgggcgagatcaccgtgctggtcgaggtggccgacatggagctgcacaccaagaaggtggagatcagcgggctcaagttcgcctccctgacctgcacgggctgctacgcctgcagctccgggatcagctgcaaggtccggatccacgtggacgagccggacgagctgaccgtgcacgtcaagtccagcgaccccgacgtggtggccgcgagcacctccctcatggcccgcaagctggagttcggcaccgacagcacgttcaaggccttctccgccatgcccaagaccagcctgtgcttctacatcgtcgagcgggagtactgcaagtcctgcagcgaggacgacaccaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcagcttcttcgtggggatcctcctcttcctgaccccgttcgtgctgctcgtcctgttcttcatgttcggctggaagatcctgttctgcttcaagtgctgccgccggacccgcgggctgttcaagtaccgccacctgaaggacgacgaggagacgggctaccggcgcatcatcgagcggctgaactccaagaagggcaagaaccgcctcctggacggggagcggctggccgaccgcaagatcgccgagctgttcagcaccaagacccacatcggc

SEQ ID NO: 12151 - RNA, 3495 nt, synthetic construct
  misc_feature 1..3495: note = derived and/or modified CDS sequence (opt1) from CCHVF(CCHVF 3809-ST-2007)__KR814867.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcgtcaacggcttcgagatcgagtcccacaagtgctactgcagcctgttctgctgcccctactgccggcactgctccgccgaccgcgagatccaccagctgcacctcagcgtgtgcaagaagcggaagaccgggtccaacgtcatgctggccgtgtgcaagcgcatgtgcttccgggccaccatcgaggcgagccgccgcgccctgctcatccggtccatcatcaacaccacgttcgtgatctgcatcctgaccctgaccatctgcgtcgtgagcaccagcgccgtggagatggagaacctcccggccggcacgtgggagcgcgaggaggacctgaccaacttctgccaccaggagtgccaggtcaccgagaccgagtgcctgtgcccctacgaggccctggtgctccggaagcccctgttcctggactccatcgtgaagggcatgaagaacctcctgaacagcacgtccctggagaccagcctctccatcgaggcgccctggggcgccatcaacgtccagagcaccttcaagccgaccgtgtccaccgccaacatcgccctgagctggtccagcgtggagcaccgcgggaacaagatcctggtcacggggcggtccgagagcatcatgaagctcgaggagcgcaccggcgtgtcctgggacctgggggtggaggacgccagcgagtccaagctgctcaccgtcagcatcatggacctgtcccagatgtacagccccgtgttcgagtacctgagcggcgaccgccaggtggaggagtggcccaaggcgacctgcacgggcgactgccccgagcggtgcgggtgcacctccagcacgtgcctccacaaggagtggccgcactcccggaactggcgctgcaaccccacctggtgctggggcgtcgggaccggctgcacgtgctgcggcgtggacgtgaaggacctgttcaccgaccacatgttcgtcaagtggaaggtggagtacatcaagaccgaggccatcgtgtgcgtcgagctgaccagccaggagcggcagtgctccctcatcgaggccgggacccgcttcaacctgggccccgtgaccatcaccctgagcgagccccggaacatccagcagaagctcccgcccgagatcatcacgctgcaccccaaggtggaggaggggttcttcgacctgatgcacgtccagaaggtgctctccgccagcaccgtgtgcaagctgcagtcctgcacccacggcatcccgggggacctgcaggtctaccacatcggcaacctcctgaagggcgaccgcgtgaacgggcacctgatccacaagatcgagccccacttcaacaccagctggatgtcctgggacggctgcgacctcgactactactgcaacatgggggactggcccagctgcacgtacaccggcgtgacccagcacaaccacgccgcgttcgtcaacctgctgaacatcgagaccgactacacgaagaccttccacttccactccaagcgggtgaccgcccacggggacacgccccagctcgacctgaaggcccgcccgacctacggcgccggcgagatcaccgtgctggtcgaggtggcggacatggagctccacaccaagaaggtggagatcagcgggctgaagttcgcctccctggcctgcaccggctgctacgcctgcagctccgggatcagctgcaaggtccggatccacgtggacgagcccgacgagctcacggtgcacgtcaagtccagcgaccccgacgtggtggccgcgagcacctccctgatggcccgcaagctggagttcggcaccgacagcaccttcaaggccttctccgccatgcccaagacgagcctctgcttctacatcgtcgagaaggagtactgccggtcctgcagcgaggaggacacccagaagtgcgtggacaccaagctggagcagccgcagtccatcctgatcgagcacaaggggaccatcatcggcaagcagaacgacacgtgcaccgccaaggcgagctgctggctcgagtccgtcaagagcttcttctacggcctgaagaacatgctggggtccgtgttcggcaacttcttcatcgggatcctcctgttcctgacccccttcgtgctcctggtgctgttcttcatgttcggctggaagatcctcttctgcttcaagtgctgccgccgcacccgggggctgctgaagtaccgccacctcaaggacgacgaggagaccggctaccggcgcatcatcgagcggctgaacaacaagaagggcaagaaccgcctgctcgacggggagcggctggccgaccgcaagatcgccgagctgttcagcacgaagacccacatcggc

SEQ ID NO: 12152 - RNA, 3495 nt, synthetic construct
  misc_feature 1..3495: note = derived and/or modified CDS sequence (opt1) from CCHVF(CCHVF 3820-ST-2007)__KR814868.1__Gn-NSm-Gc
  source 1..3495: mol_type = other RNA
agcgaggagcccggcgacgactgcatctcccgcacccagctgctcaagaccgagacggccgagatccacgacgacaactacgggagcccgggcgacaagatcaccatctgcaacgggtccaccatcgtggaccagcggctgggcagcgagctggggtgctacaccatcaaccgcgtcaagtccttcaagctctgcgagaacagcgccacgggcaagacctgcgagatcgactccacccccgtgaagtgccggcagggcttctgcctgaagatcacccaggaggggcgcggccacgtgaagctgagccgggggtccgaggtcgtgctcgacgcgtgcgacagctcctgcgagatcatgatccccaagggcacgggggacatcctggtggactgcagcggcggccagcagcacttcctgaaggacaacctcatcgacctggggtgcccccacatcccgctgctcggcaagatggccatctacatctgccgcatgtccaaccacccccggaccaccatggccttcctgttctggttcagcttcgggtacgtcatcacctgcatcttctgcaaggccctgttctactccctcatcatcatcggcacgctgggcaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacgggctggcccgccacgtgacccagtgccccaagcggaaggagaaggtcgaggagaccgagctctacctgaacctggagcgcatcccctggatcgtgcggaagctcctgcaggtgtccgagagcaccggcgtcgcgctgaagcgcagctcctggctcatcgtgctgctggtgctcctggccgtcagcctgtcccccgtgcagagcgccccggtggggcacggcaagacgatcgagacctaccagacccgggaggggttcacctccatctgcctcttcatgctgggcagcatcctgttcatcgtctcctgcctcgtgaagggcctggtggacagcgtctccgacagcttcttccccgggctgtccgtgtgcaagacgtgcagcatcggctccatcaacgggttcgagatcgagagccacaagtgctactgctccctcttctgctgcccctactgccgccactgcagcgccgaccgggagatccaccagctgcacctgtccatctgcaagaagcgcaagaccggcagcaacgtgatgctcgccgtctgcaagcggatgtgcttcaaggcgaccatcgaggcctcccgccgggccctgctgatccgcagcatcatcaacaccacgttcgtgatgtgcatcctcaccctggccatctgcgtcgtgagcacctccgccgtggagatggaggacctgcccgcggggacctgggagcgcgaggaggacctcacgaacttctgccaccaggagtgccaggtcaccgagaccgagtgcctgtgcccgtacgaggccctggtgctgcggaagcccctcttcctggacagcatcgtgaagggcatgaagaacctgctcaactccaccagcctggagacgtccctgagcatcgaggccccctggggcgccatcaacgtccagtccaccttcaagcccaccgtgagcaccgccaacatcgcgctctcctggagctccgtggagcaccgcgggaacaagatcctggtcaccggccggagcgagtccatcatgaagctggaggagcgcacgggggtgagctgggacctcggcgtggaggacgcctccgagagcaagctgctgaccgtctccatcatggacctcagccagatgtacagcccggtgttcgagtacctgtccggggaccggcaggtggaggagtggcccaaggccacctgcaccggcgactgccccgagcgctgcggctgcacgagctccacctgcctgcacaaggagtggccccacagccggaactggcgctgcaacccgacctggtgctggggggtcggcaccgggtgcacgtgctgcggcgtggacgtgaaggacctcttcaccgaccacatgttcatcaagtggaaggtcgagtacatcaagaccgaggccatcgtgtgcgtggagctgacctcccaggagcggcagtgcagcctgatcgaggccggcacgcgcttcaacctcgggcccgtcaccatcaccctgtccgagccccggaacatccagcagaagctgcccccggagatcatcaccctccaccccaagatcgaggagggcttcttcgacctgatgcacgtgcagaaggtgctgagcgcgtccacggtctgcaagctccagagctgcacccacgggatccccggcgacctgcagatctaccacatcgggaacctgctcaagggcgaccgcgtgaacggccacctgatccacaagatcgagccgcacttcaacacctcctggatgagctgggacgggtgcgacctggactactactgcaacatgggcgactggccctcctgcacctacacgggggtgacccagcacaaccacgccgccttcgtcaacctcctgaacatcgagaccgactacaccaagacgttccacttccacagcaagcgggtgaccgcccacggcgacaccccccagctggacctcaaggcgcgccccacctacggggccggcgagatcacggtgctggtcgaggtggccgacatggagctgcacaccaagaaggtggagatctccggcctcaagttcgccagcctgacctgcaccgggtgctacgcctgctccagcggcatctcctgcaaggtccggatccacgtggacgagccggacgagctgacggtgcacgtcaagagcagcgaccccgacgtggtggcggcctccaccagcctcatggcccgcaagctggagttcgggaccgactccaccttcaaggccttcagcgccatgcccaagacgtccctgtgcttctacatcgtcgagcgggagtactgcaagagctgctccgaggacgacaccaagaagtgcgtggacaccaagctcgagcagccccagagcatcctgatcgagcacaagggcaccatcatcgggaagcagaacgacacctgcacggcgaaggcctcctgctggctggagagcgtgaagtccttcttctacggcctcaagaacatgctgggcagcgtcttcgggtccttcttcgtgggcatcctgctcttcctggccccgttcgtgctgctcgtcctgttcttcatgttcgggtggaagatcctgttctgcttcaagtgctgccgccggacccgcggcctcttcaagtaccgccacctgaaggacgacgaggagaccgggtaccggcgcatcatcgagcggctgaacagcaagaagggcaagaaccgcctcctggacggcgagcggctggccgaccgcaagatcgccgagctcttctccaccaagacgcacatcggg

SEQ ID NO: 12153 - RNA, 3495 nt, synthetic construct
  misc_feature 1..3495: note = derived and/or modified CDS sequence (opt1) from CCHVF(CCHVF 4495-ST-2008)__KR814869.1__Gn-NSm-Gc
  source 1..3495: mol_type = other RNA
agcgaggagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacctgcgagatcgactccaccccggtgaagtgccgccaggggttctgcctgaagatcacccaggagggccgggggcacgtgaagctgagccgcggctccgaggtcgtgctcgacgcgtgcgacagctcctgcgaggtgatgatccccaaggggacgggcgacatcctggtcgactgcagcggcgggcagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcctgttctgcaaggccctcttctactccctgatcatcatcggcaccctggggaagaagatcaagcagtaccgggagctccgcccccagacctgcaccatctgcgagaccgcccccgtgaacgcgatcgacgccgagatgcacgacctgaactgcagctacaacatctgcccctactgcgcctcccggctgacgagcgacggcctcgcccgccacgtcccgcagtgccccaagcggaaggagaaggtggaggagaccgagctgtacctgaacctcgagcgcatcccctggatcgtgcggaagctgctgcaggtctccgagagcaccggggtggcgctcaagcgcagctcctggctgatcgtgctgctcgtcctgctgaccgtgagcctctcccccgtgcagagcgccccggtcggccacgggaagacgatcgagacctaccagacccgggagggcttcacctccatctgcctgttcatgctgggcagcatcctcttcctggtgtcctgcctggtgaaggggctcgtcgacagcgtgtccgacagcttcttccccggcctgtccgtgtgcaagacgtgcagcatcgggtccatcaacggcttcgagatcgagagccacaagtgctactgctccctgctctgctgcccctactgccgccactgcagcgccgaccgggagatccaccagctgcacctgtccatctgcaagaagcgcaagaccgggagcaacgtcatgctcgccgtgtgcaagcggatgtgcttccgcgccaccatcgaggcgtcccgccgggccctgctgatccgcagcatcatcaacaccacgttcgtcatctgcatcctcaccctgaccatctgcgtggtgagcacctccgccgtcgagatggagaacctgcccagcggcacgtgggagaaggaggaggacctgaccaacttctgccaccaggagtgccaggtgaccgagaccgagtgcctctgcccgtacgaggccctggtgctgcggaagcccctcttcctggactccatcgtcaagggcatgaagaacctgctcaacagcacgtccctggagaccagcctgtccatcgaggccccctggggcgcgatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcatctcctgggacctcggggtggaggacgccagcgagtccaagctgctgaccgtcagcatcatggacctcagccagatgtactccccggtgttcgagtacctgagcggcgaccgccaggtggaggagtggcccaaggcgacctgcacgggcgactgccccgagcggtgcgggtgcacctccagcacgtgcctgcacaaggagtggccccactcccggaactggcgctgcaacccgacctggtgctggggcgtcgggaccggctgcacgtgctgcggcgtggacgtgaaggacctcttcaccgaccacatgttcgtcaagtggaaggtggagtacatcaagaccgaggccatcgtgtgcgtcgagctgaccagccaggagcggcagtgctccctgatcgaggccgggacccgcttcaacctcggccccgtgaccatcaccctgagcgagccccggaacatccagcagaagctgcccccggagatcatcacgctccaccccaaggtggaggaggggttcttcgacctgatgcacgtccagaaggtgctgtccgccagcaccgtgtgcaagctccagtcctgcacccacggcatccccggggacctgcaggtctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacgtacaccggcgtgacccagcacaaccacgccgccttcgtcaacctcctgaacatcgagaccgactacacgaagaccttccacttccactccaagcgggtgaccgcgcacggggacacgccccagctggacctcaaggcccgccccacctacggcgccggcgagatcaccgtgctggtcgaggtggccgacatggagctgcacaccaagaaggtggagatcagcgggctcaagttcgcgtccctggcctgcaccggctgctacgcctgcagctccgggatcagctgcaaggtccggatccacgtggacgagccggacgagctgacggtgcacgtcaagagctccgaccccgacgtggtggccgccagcacctccctcatggcgcgcaagctggagttcggcaccgacagcaccttcaaggccttctccgccatgcccaagacgagcctgtgcttctacatcgtcgagcgggagtactgcaagtcctgcagcgaggaggacacccagcgctgcgtggacaccaagctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacttcttcatcgggatcctcctgttcctggcgccgttcgtgctgctcgtgctgttcttcatgttcggctggaagatcctgttctgcttcaagtgctgccgccgggcccgcgggctcctgaagtaccggcacctgaaggacgacgaggagaccggctaccgcaagatcatcgagcggctcaacaacaagaagggcaagaaccgcctgctggacggggagcggctcgccgaccgcaagatcgccgagctgttcagcaccaagacccacatcggc

SEQ ID NO: 12154 - RNA, 3495 nt, synthetic construct
  misc_feature 1..3495: note = derived and/or modified CDS sequence (opt1) from CCHVF(CCHVF 4691-ST-2009)__KR814871.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccacgggaagaccatcgagacctaccaggcccgggagggcttcaccagcatctgcctcttcatgctgggctccatcctgttcatcgtcagctgcctcgtgaaggggctggtggactccgtcagcgactccttcttccccggcctgagcgtgtgcaagacgtgctccatcgggagcatcaacggcttcgagatcgagtcccacaagtgctactgcagcctcttctgctgcccctactgccgccactgctccgccgaccgggagatccaccagctgcacctgagcatctgcaagaagcgccggaccgggtccaacgtgatgctcgccgtctgcaagcgcatgtgcttcaaggcgaccatcgaggccagccggcgcgccctgctgatccgctccatcatcaacaccacgttcgtgatctgcatcctcaccctggccatctgcgtcgtgagcaccagcgccgtggagatggagaacctgcccgcgggcacctgggagcgggaggaggacctcacgaacttctgccaccaggagtgccaggtcaccgagaccgagtgcctgtgcccgtacgaggccctggtgctgcgcaagcccctcttcctggactccatcgtgaagggcatgaagaacctgctcaacagcacctccctggagacgagcctgtccatcgaggccccctggggcgccatcaacgtccagagcaccttcaagcccgccgtgtccaccgcgaacatcgccctcagctggtccagcgtggagcaccgggggaacaagatcctggtcaccgggcgctccgagagcatcatgaagctggaggagcggaccggcgtgtcctgggacctcggggtggaggacgccagcgagtccaagctgctgacggtcagcatcatggacctctcccagatgtacagcccggtgttcgagtacctgagcggcgaccgccaggtggaggagtggcccaaggcgacctgcaccggcgactgccccgagcggtgcgggtgcacctccagcacgtgcctgcacaaggagtggccccactcccgcaactggcggtgcaacccgacctggtgctggggcgtcgggaccggctgcacgtgctgcggcgtggacgtgaaggacctcttcaccgaccacatgttcatcaagtggaaggtcgagtacatcaagaccgaggccatcgtgtgcgtggagctgaccagccaggagcgccagtgctccctgatcgaggccgggacccggttcaacctcggccccgtcacgatcaccctgagcgagccccgcaacatccagcagaagctgcccccggagatcatcaccctccaccccaagatcgaggaggggttcttcgacctgatgcacgtgcagaaggtgctgtccgccagcaccgtctgcaagctccagtcctgcacgcacggcatccccggggacctgcagatctaccacatcggcaacctgctcaagggcgaccgggtgaacgggcacctgatccacaagatcgagccgcacttcaacaccagctggatgtcctgggacggctgcgacctggactactactgcaacatgggggactggcccagctgcacctacaccggcgtgacgcagcacaaccacgccgccttcgtcaacctcctgaacatcgagaccgactacaccaagaccttccacttccactccaagcgcgtgacggcgcacggggacacgccccagctggacctcaaggcccggcccacctacggcgccggcgagatcaccgtgctggtcgaggtggccgacatggagctgcacaccaagaaggtggagatcagcgggctcaagttcgcctccctggcgtgcaccggctgctacgcctgcagctccgggatcagctgcaaggtccgcatccacgtggacgagccggacgagctgaccgtgcacgtcaagtccagcgaccccgacgtggtggccgccagcacctccctcatggcccggaagctggagttcggcacggacagcaccttcaaggcgttctccgccatgcccaagaccagcctgtgcttctacatcgtcgagcgcgagtactgcaagtcctgcagcgaggacgacaccaagaagtgcgtggacacgaagctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacttcttcgtggggatcctcctcttcctggccccgttcgtgctgctcgtcctgttcttcatgttcggctggaagatcctgttctgcttcaagtgctgccggcgcacccgcgggctgttcaagtaccggcacctgaaggacgacgaggagaccggctaccgccggatcatcgagcgcctgaacagcaagaagggcaagaaccggctcctggacggggagcgcctggcggaccggaagatcgccgagctgttctccaccaagacccacatcggc

SEQ ID NO: 12155 - RNA, 3495 nt, synthetic construct
  misc_feature 1..3495: note = derived and/or modified CDS sequence (opt1) from CCHVF(CCHVF 4701-ST-2009)__KR814872.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgcgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccacgggaagaccatcgagacctaccagacccgggagggcttcacgagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtcatgctcgccgtgtgcaagcggatgtgcttcaaggccaccatcgaggcgagccgccgggccctgctgatccgctccatcatcaacacgaccttcgtcatgtgcatcctcaccctggccatctgcgtggtgagcaccagcgccgtcgagatggaggacctgcccgccggcacgtgggagcgcgaggaggacctcaccaacttctgccaccaggagtgccaggtgaccgagaccgagtgcctgtgcccgtacgaggcgctggtgctgcggaagcccctcttcctggactccatcgtcaagggcatgaagaacctgctcaacagcacgtccctggagaccagcctgtccatcgaggccccctggggcgccatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgcgagcgagtccaagctgctgaccgtgagcatcatggacctctcccagatgtacagcccggtgttcgagtacctgagcggcgaccggcaggtcgaggagtggcccaaggcgacctgcacgggcgactgccccgagcgctgcgggtgcacctccagcacgtgcctgcacaaggagtggccccactcccggaactggcgctgcaacccgacctggtgctggggcgtggggaccggctgcacgtgctgcggcgtggacgtcaaggacctcttcaccgaccacatgttcatcaagtggaaggtggagtacatcaagaccgaggccatcgtgtgcgtcgagctgaccagccaggagcggcagtgctccctgatcgaggccgggacccgcttcaacctcggccccgtgaccatcaccctgagcgagccccggaacatccagcagaagctgcccccggagatcatcacgctccaccccaagatcgaggaggggttcttcgacctgatgcacgtgcagaaggtcctgtccgccagcaccgtgtgcaagctccagtcctgcacccacggcatccccggggacctgcagatctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacgtacaccggcgtcacccagcacaaccacgccgccttcgtgaacctcctgaacatcgagaccgactacacgaagaccttccacttccactccaagcgggtgaccgcccacggggacacgccccagctggacctcaaggcccgccccacctacggcgcgggcgagatcaccgtcctggtggaggtggccgacatggagctgcacaccaagaaggtcgagatcagcgggctcaagttcgcctccctgacctgcacgggctgctacgcctgcagctccgggatcagctgcaaggtgcggatccacgtggacgagccggacgagctgaccgtccacgtgaagtccagcgaccccgacgtggtcgccgcgagcacctccctcatggcccgcaagctggagttcggcaccgacagcacgttcaaggccttctccgccatgcccaagaccagcctgtgcttctacatcgtggagcgggagtactgcaagtcctgcagcgaggacgacaccaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcgggttcttcgtgggcatcctcctcttcctggccccgttcgtcctgctcgtgctgttcttcatgttcgggtggaagatcctgttctgcttcaagtgctgccgccggacccgcggcctcttcaagtaccgccacctgaaggacgacgaggagaccggctaccggcgcatcatcgagcggctgaacagcaagaaggggaagaaccgcctcctggacggcgagcggctggccgaccgcaagatcgccgagctgttctccacgaagacccacatcggg

SEQ ID NO: 12156 - RNA, 3495 nt, synthetic construct
  misc_feature 1..3495: note = derived and/or modified CDS sequence (opt1) from CCHVF(CCHVF 5170-R-2011)__KR814873.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgtgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgagggcctggcccgccacgtcacccagtgccccaagcggaaggagaaggtggaggagaccgagctctacctgaacctggagcgcatcccctggatcgtgcggaagctcctgcaggtcagcgagtccaccggggtggccctgaagcgcagcagctggctcatcgtgctgctggtcctcctgacggtgtccctgagccccgtgcagtccgcgccggtcggccacgggaagaccatcgagacctaccagacccgggagggcttcacgagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtcatgctcgccgtgtgcaagcggatgtgcttcaaggccaccatcgaggccagccgccgggcgctgctgatccgctccatcatcaacacgaccttcgtcatctgcatcctcaccctggccatctgcgtggtgagcaccagcgccgtcgagatggaggacctgcccgccggcacgtgggagcgcgaggaggacctcaccaacttctgccaccaggagtgccaggtgaccgagaccgagtgcctgtgcccgtacgaggccctggtgctgcggaagcccctcttcctggactccatcgtcaagggcatgaagaacctgctcaacagcacgtccctggagaccagcctgtccatcgaggcgccctggggcgccatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgccagcgagtccaagctgctgaccgtgagcatcatggacctctcccagatgtacagcccggtgttcgagtacctgagcggcgaccggcaggtcgaggagtggcccaaggcgacctgcacgggcgactgccccgagcgctgcgggtgcacctccagcacgtgcctgcacaaggagtggccccactcccggaactggcgctgcaacccgacctggtgctggggcgtggggaccggctgcacgtgctgcggcgtggacgtcaaggacctcttcaccgaccacatgttcatcaagtggaaggtggagtacatcaagaccgaggccatcgtgtgcgtcgagctgaccagccaggagcggcagtgctccctgatcgaggccgggacccgcttcaacctcggccccgtgaccatcaccctgagcgagccccggaacatccagcagaagctgcccccggagatcatcacgctccaccccaagatcgaggaggggttcttcgacctgatgcacgtgcagaaggtcctgtccgccagcaccgtgtgcaagctccagtcctgcacccacggcatccccggggacctgcagatctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacgtacaccggcgtcacccagcacaaccacgccgcgttcgtgaacctcctgaacatcgagaccgactacacgaagaccttccacttccactccaagcgggtgaccgcccacggggacacgccccagctggacctcaaggcccgccccacctacggcgccggcgagatcaccgtcctggtggaggtggcggacatggagctgcacaccaagaaggtcgagatcagcgggctcaagttcgcctccctgacctgcacgggctgctacgcctgcagctccgggatcagctgcaaggtgcggatccacgtggacgagccggacgagctgaccgtccacgtgaagtccagcgaccccgacgtggtcgccgccagcacctccctcatggcgcgcaagctggagttcggcaccgacagcacgttcaaggccttctccgccatgcccaagaccagcctgtgcttctacatcgtggagcgggagtactgcaagtcctgcagcgaggacgacaccaagaagtgcgtggacaccaagctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcagcttcttcgtggggatcctcctcttcctggcgccgttcgtcctgctcgtgctgttcttcatgttcggctggaagatcctgttctgcttcaagtgctgccgccggacccgcggcctcttcaagtaccgccacctgaaggacgacgaggagaccgggtaccggcgcatcatcgagcggctgaactccaagaagggcaagaaccgcctcctggacggggagcggctggccgaccgcaagatcgccgagctgttcagcacgaagacccacatcggc

SEQ ID NO: 12157 - RNA, 3495 nt, synthetic construct
  misc_feature 1..3495: note = derived and/or modified CDS sequence (opt1) from CCHVF(CCHVF Oman-199809166)__KR864901.1__Gn-NSm-Gc
  source 1..3495: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctcaagcggagcagctggctgatcgtgctgctcgtgctgctgaccgtctccctcagccccgtgcagtccgcccccatcggccacgggaagacgatcgagacctaccagacccgcgagggctacaccagcatctgcctgttcgtgctgggctccatcctcttcatcgtcagccacctgatgaaggggctggtggactccgtgggcaacagcttcttcccggggctctccatctgcaagacgtgcagcatcggctccatcaacgggttcgagatcgagagccacaagtgctactgctccctgttctgctgcccctactgccggcactgcagcgcggacaaggagatccacaagctgcacctctccatctgcaagaagcgcaaggccggcagcaacgtcatgctggccgtgtgcaagcggatgtgcttccgcgccaccatggaggtctccaacaaggccctgctcatccggagcgtgatcaacaccaccttcgtggtctgcatcctgatcctggcggtgtgcgtggtctccacgagcgccgtggagatggagagcctccccgccggcacctgggagcgcgaggaggacctgaccaacttctgccaccaggagtgccaggtgaccgagacggagtgcctgtgcccctacgaggccctggtcctccggaagccgctgttcctggactccatcgccaaggggatgaagaacctcctgaacagcacctccctggagaccagcctctccatcgaggcgccctggggcgccatcaacgtgcagagcaccttcaagcccacggtgtccaccgccaacatcgccctgagctggtccagcgtcgagcaccgcgggaacaagatcctggtgtccggccgcagcgagtccatcatgaagctcgaggagcggaccgggatcagctgggacctgggcgtggaggacgcctccgagagcaagctgctcaccgtctccgtgatggacctgagccagatgtacagccccgtgttcgagtacctgtccggcgaccgccaggtcgaggagtggccgaaggcgacctgcacgggggactgccccgagcggtgcggctgcaccagctccacgtgcctccacaaggagtggccccacagccgcaactggcggtgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccaggagcgccagtgcagcctgatcgaggccggcacccggttcaacctggggccggtgaccatcaccctctccgagccccgcaacatccagcagaagctgccgcccgagatcgtgacgctgcacccccggatcgaggagggcttcttcgacctcatgcacgtccagaaggtgctgagcgcctccaccgtgtgcaagctgcagagctgcacccacggggtccccggcgacctccaggtgtaccacatcggcaacctgctgaagggggacaaggtgaacggccacctcatccacaaggtcgagccccacttcaacacctcctggatgagctgggacgggtgcgacctggactactactgcaacatgggcgactggccgtcctgcacgtacaccggggtgacccagcacaaccacgccgcgttcgtgaacctgctcaacatcgagaccgactacacgaagaacttccacttccacagcaagcgcgtcaccgcccacggcgacacgccccagctggacctgaaggcccggcccaactacggcgccggggagatcaccgtgctcgtggaggtcgcggacatggagctgcacaccaagaagatcgagatctccggcctgaagttcgccagcctgacctgcaccgggtgctacgcctgctccagcggcatctcctgcaaggtgcgcatccacgtggacgagcccgacgagctgaccgtccacgtcaagagcgaggacccggacatcgtggccgccagctccagcctgatggcgcggaagctcgagttcgggacggactccaccttcaaggccttcagcgccatgcccaagacctccctgtgcttctacatcgtggagcgcgagtactgcaagagctgctccaaggaggacacccagaagtgcgtgaacgccaagctggagcggccccagagcatcctcatcgagcacaagggcacgatcatcggcaagcagaacgacacgtgcaccgccaaggcgtcctgctggctggagagcgtgaagtccttcttctacgggctgaagaacatgctcagcggcatcttcgggaacgtcttcatcggcatcttcctgttcctggcccccttcatcctcctgatcctgttcttcatgttcgggtggcgcatcctcttctgcttcaagtgctgccggcgcacccggggcctgttcaagtaccgccacctgaaggacgacgaggagaccggctaccgcaagatcatcgagcggctcaacaacaagaaggggaagaacaagctgctggacggcgagcgcctcgccgaccggaagatcgccgagctgttctccaccaagacccacatcggg

SEQ ID NO: 12158 - RNA, 3495 nt, synthetic construct
  misc_feature 1..3495: note = derived and/or modified CDS sequence (opt1) from CCHVF(CCHVF 200406546-Turkey)__KR864902.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgtgtgcgactccagctgcgaggtcatgatccccaaggggacgggcgacatcctggtggactgctccggcgggcagcagcacttcctgaaggacaacctcatcgacctgggctgcccccacgtgccgctgctcgggcggatggcgatctacatctgccgcatgagcaaccacccccggaccaccatggccttcctgttctggttctccttcggctacgtcatcacgtgcatcttctgcaaggccctgttctacagcctcatcatcatcggcaccctggggaagaagttcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgacggcctggcccgccacgtgccccagtgccccaagcggaaggagaaggtcgaggagaccgagctctacctgaacctggagcgcatcccctggatcgtgcggaagctcctccaggtgagcgagtccaccggggtcgccctgaagcgcagcagctggctcatcgtgctgctggtgctcctgaccgtctccctgagcccggtgcagtccgcgcccgtgggccacgggaagacgatcgagacctaccagacccgggagggcttcaccagcatctgcctcttcatgctgggctccatcctgttcatcgtcagctgcctcgtgaaggggctggtggactccgtcagcgactccttcttccccggcctgagcgtgtgcaagacgtgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtcatgctcgccgtgtgcaagcggatgtgcttccgcgccaccatcgaggccagccgccgggcgctgctgatccgctccatcatcaacaccacgttcgtgatctgcatcctcaccctgaccatctgcgtcgtgagcaccagcgccgtggagatggagaacctgccggccggcacgtgggagcgggaggaggacctcaccaacttctgccaccaggagtgccaggtcaccgagaccgagtgcctgtgcccctacgaggccctggtgctgcgcaagcccctcttcctggactccatcgtgaagggcatgaagaacctgctcaacagcacgtccctggagaccagcctgtccatcgaggccccctggggcgcgatcaacgtccagagcaccttcaagccgaccgtgtccaccgccaacatcgccctcagctggtccagcatcgagcaccgggggaacaagatcctggtgacggggcgctccgagagcatcatgaagctggaggagcggaccggcgtctcctgggacctcggggtggaggacgccagcgagtccaagctgctgaccgtgagcatcatggacctctcccagatgtacagccccgtcttcgagtacctgagcggcgaccgccaggtggaggagtggcccaaggcgacctgcacgggcgactgccccgagcggtgcgggtgcacctccagcacgtgcctgcacaaggagtggccgcactcccgcaactggcggtgcaaccccacctggtgctggggcgtggggaccggctgcacgtgctgcggcgtcgacgtgaaggacctcttcaccgaccacatgttcgtgaagtggaaggtcgagtacatcaagaccgaggccatcgtgtgcgtggagctgaccagccaggagcgccagtgctccctgatcgaggccgggacccggttcaacctcggccccgtcaccatcaccctgagcgagccccgcaacatccagcagaagctgccgcccgagatcatcacgctccaccccaaggtggaggaggggttcttcgacctgatgcacgtgcagaaggtcctgtccgccagcaccgtgtgcaagctccagtcctgcacccacggcatcccgggggacctccaggtgtaccacatcggcaacctgctcaagggcgaccgggtcaacgggcacctgatccacaagatcgagccccacttcaacaccagctggatgtcctgggacggctgcgacctggactactactgcaacatgggggactggcccagctgcacgtacaccggcgtgacccagcacaaccacgccgccttcgtgaacctcctgaacatcgagaccgactacacgaagaccttccacttccactccaagcgcgtcaccgcgcacggggacacgccccagctggacctcaaggcccggccgacctacggcgccggcgagatcaccgtgctggtggaggtcgccgacatggagctgcacaccaagaaggtggagatcagcgggctcaagttcgcgtccctggcctgcaccggctgctacgcctgcagctccgggatcagctgcaaggtgcgcatccacgtcgacgagcccgacgagctgacggtgcacgtgaagtccagcgaccccgacgtcgtggccgccagcacctccctcaccgcgcggaagctggagttcggcaccgacagcacgttcaaggccttctccgccatgcccaagaccagcctgtgcttctacatcgtggagaaggagtactgcaagtcctgcaacgaggacgacacccagaagtgcgtcgacaccaagctcgagcagccgcagagcatcctgatcgagcacaaggggaccatcatcggcaagcagaacgacacgtgcaccgccaaggcctcctgctggctggagagcgtgaagtccttcttctacggcctcaagaacatgctggggagcgtgttcggcaacttcttcatcgggatcctgctgttcctggcgcccttcgtcctgctcgtgctgttcttcatgttcggctggaagatcctgttctgcttcaagtgctgccgccgcacccggggcctcttcaagtaccgccacctgaaggacgacgaggagaccgggtacaagcggatcatcgagcgcctgaacaacaagaagggcaagaaccggctcctggacggggagcgcctggccgaccggaagatcgccgagctgttctccacgaagacccacatcggc

SEQ ID NO: 12159 - RNA, 3495 nt, synthetic construct
  misc_feature 1..3495: note = derived and/or modified CDS sequence (opt1) from CCHVF(CCHVF 1-CR/HU-2015)__KU161584.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcacccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgacggtgtccctgagccccgtgcagtccgccccggtcggccacgggaagaccatcgagacctaccagacccgcgagggcttcacgagcatctgcctcttcatgctgggctccatcctgttcatcgtgagctgcctcgtgaaggggctggtcgactccgtgagcgactccttcttccccggcctgagcgtgtgccggacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtcatgctcgccgtgtgcaagcggatgtgcttccgcgccaccatggaggcgagccgccgggccctgctgatccgctccatcatcaacacgaccttcgtcatctgcatcctcaccctgaccatctgcgtggtgagcacgagcgccgtcgagatggagaacctgcccgccggcacctgggagcgggaggaggacctcaccaacttctgccaccaggagtgccaggtgaccgagacggagtgcctgtgcccgtacgaggccctggtgctgcgcaagcccctcttcctggactccatcgtcaagggcatgaagaacctgctcaacagcacctccctggagaccagcctgtccatcgaggcgccctggggcgccatcaacgtgcagagcaccttcaagcccaccgtgtccacggccaacatcgccctcagctggtccagcgtcgagcaccgggggaacaagatcctggtgaccgggcgctccgagagcatcatgaagctggaggagcggaccggcgtgtcctgggacctcggggtcgaggacgccagcgagtccaagctgctgaccgtgagcatcatggacctctcccagatgtacagcccggtgttcgagtacctgagcggcgaccgccaggtcgaggagtggcccaaggcgacgtgcaccggcgactgccccgagcggtgcgggtgcacctccagcacgtgcctgcacaaggagtggccccactcccgcaactggcggtgcaacccgacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcgccagtgctccctgatcgaggccgggacccggttcaacctcggccccgtgaccatcacgctgagcgagccccgcaacatccagcagaagctgcccccggagatcatcaccctccaccccaagatcgaggaggggttcttcgacctgatgcacgtccagaaggtgctgtccgccagcaccgtgtgcaagctccagtcctgcacccacggcatccccggggacctgcaggtctaccacatcggcaacctgctcaagggcgaccgggtgaacgggcacctgatccacaagatcgagccgcacttcaacacgagctggatgtcctgggacggctgcgacctggactactactgcaacatgggggactggcccagctgcacctacaccggcgtgacccagcacaaccacgccgcgttcgtcaacctcctgaacatcgagacggactacaccaagaccttccacttccactccaagcgcgtgaccgcccacggggacacgccccagctggacctcaaggcccggcccacctacggcgccggcgagatcaccgtgctggtcgaggtggcggacatggagctgcacaccaagaaggtggagatcagcgggctcaagttcgcctccctggcctgcacgggctgctacgcctgcagctccgggatcagctgcaaggtccgcatccacgtggacgagccggacgagctgaccgtgcacgtcaagtccagcgaccccgacgtggtggccgcgagcacctccctcatggcccggaagctggagttcggcaccgacagcacgttcaaggccttctccgccatgcccaagaccagcctgtgcttctacatcgtcgagcgcgagtactgcaagtcctgcagcgaggacgacaccaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcaacttcttcatcgggatcctcctcttcctggccccgttcgtgctgctcgtgctgttcttcatgttcggctggaagatcctgttctgcttcaagtgctgccgccggacccgcggcctcttcaagtaccggcacctgaaggacgacgaggagaccgggtaccgccggatcatcgagcgcctgaacaacaagaagggcaagaaccggctcctggacggggagcgcctggccgaccggaagatcgccgagctgttcagcacgaagacccacatcggc

SEQ ID NO: 12160 - RNA, 3495 nt, synthetic construct
  misc_feature 1..3495: note = derived and/or modified CDS sequence (opt1) from CCHVF(CCHVF 1231-CR/TI-2015)__KU161585.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcacccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgacggtgtccctgagccccgtgcagtccgccccggtcggccacgggaagaccatcgagacctaccagacccgcgagggcttcacgagcatctgcctcttcatgctgggctccatcctgttcatcgtgagctgcctcgtgaaggggctggtcgagtccgtgagcgactccttcttccccggcctgagcgtgtgccggacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtcatgctcgccgtgtgcaagcggatgtgcttccgcgccaccatggaggcgagccgccgggccctgctgatccgctccatcatcaacacgaccttcgtcatctgcatcctcaccctgaccatctgcgtggtgagcacgagcgccgtcgagatggagaacctgcccgccggcacctgggagcgggaggaggacctcaccaacttctgccaccaggagtgccaggtgaccgagacggagtgcctgtgcccgtacgaggccctggtgctgcgcaagcccctcttcctggactccatcgtcaagggcatgaagaacctgctcaacagcacctccctggagaccagcctgtccatcgaggcgccctggggcgccatcaacgtgcagagcaccttcaagcccaccgtgtccacggccaacatcgccctcagctggtccagcgtcgagcaccgggggaacaagatcctggtgaccgggcgctccgagagcatcatgaagctggaggagcggaccggcgtgtcctgggacctcggggtcgaggacgccagcgagtccaagctgctgaccgtgagcatcatggacctctcccagatgtacagcccggtgttcgagtacctgagcggcgaccgccaggtcgaggagtggcccaaggcgacgtgcaccggcgactgccccgagcggtgcgggtgcacctccagcacgtgcctgcacaaggagtggccccactcccgcaactggcggtgcaacccgacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcgccagtgctccctgatcgaggccgggacccggttcaacctcggccccgtgaccatcacgctgagcgagccccgcaacatccagcagaagctgcccccggagatcatcaccctccaccccaagatcgaggaggggttcttcgacctgatgcacgtccagaaggtgctgtccgccagcaccgtgtgcaagctccagtcctgcacccacggcatccccggggacctgcaggtctaccacatcggcaacctgctcaagggcgaccgggtgaacgggcacctgatccacaagatcgagccgcacttcaacacgagctggatgtcctgggacggctgcgacctggactactactgcaacatgggggactggcccagctgcacctacaccggcgtgacccagcacaaccacgccgcgttcgtcaacctcctgaacatcgagacggactacaccaagaccttccacttccactccaagcgcgtgaccgcccacggggacacgccccagctggacctcaaggcccggcccacctacggcgccggcgagatcaccgtgctggtcgaggtggcggacatggagctgcacaccaagaaggtggagatcagcgggctcaagttcgcctccctggcctgcacgggctgctacgcctgcagctccgggatcagctgcaaggtccgcatccacgtggacgagccggacgagctgaccgtgcacgtcaagtccagcgaccccgacgtggtggccgcgagcacctccctcatggcccggaagctggagttcggcaccgacagcacgttcaaggccttctccgccatgcccaagaccagcctgtgcttctacatcgtcgagcgcgagtactgcaagtcctgcagcgaggacgacaccaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcaacttcttcatcgggatcctcctcttcctggccccgttcgtgctgctcgtgctgttcttcatgttcggctggaagatcctgttctgcttcaagtgctgccgccggacccgcggcctcttcaagtaccggcacctgaaggacgacgaggagaccgggtaccgccggatcatcgagcgcctgaacaacaagaagggcaagaaccggctcctggacggggagcgcctggccgaccggaagatcgccgagctgttcagcacgaagacccacatcggc

SEQ ID NO: 12161 - RNA, 3495 nt, synthetic construct
  misc_feature 1..3495: note = derived and/or modified CDS sequence (opt1) from CCHVF(CCHVF Gaib)__KX013445.1__Gn-NSm-Gc
  source 1..3495: mol_type = other RNA
agcgaggagtccagcgacgactgcatctcccgcacccagctgctccggaccgagacggccgagatccacaacgacaactacggcgggcccggcgacaagatcaccatctgcaacgggagcaccatcgtggaccagcgcctgggctccgagctggggtgctacaccatcaaccgggtcaagagcttcaagctctgcgagaactccgccacgggcaagagctgcgagatcgactccatcccggtgaagtgccgccagggcttctgcctgaagatcacccaggaggggcggggccacgtgaagctgagccgcgggtccgaggtcgtgctcgacgcgtgcgacagctcctgcgagatcatgatccccaagggcaccggggacatcctggtggactgcagcggcggccagcagcacttcctgaaggacaacctcatcgacctggggtgccccaacatccccctgctcggcaagatggccatctacatctgccggatgtccaaccacccgaagaccacgatggccttcctgttctggttcagcttcgggtacgtcatcacgtgcatcttctgcaaggccatcttctacctgctcatcatcgtgggcaccctgggcaagaagttcaagcagtaccgcgagctgaagccccagacctgcaccatctgcgagaccacccccgtgaacgccatcgacgcggagatgcacgacctcaactgctcctacaacatctgcccctactgcgccagccggctgacctccgacgggctggcccgccacgtcgtgcactgcccgaagcggaaggagaagatcgaggagacggagctctacctgaacctggagcgcgtgccctgggtcgtgcggaagctcctccaggtgagcgagagcaccggcgtcgccctgaagcgctccagctggctgatcgtgctgctggtgctcctgaccgtctccctgagccccgtgcagtccgcgcccatcgggcacggcaagaccatcgagacgtaccagacccgggaggggtacaccagcatctgcctcttcgtgctgggcggcatcctgttcatcgtctcctgcctcatgaaggggctggtggacagcgtgggcaacaacttcttcccggggctgaccatctgcaagacgtgctccatcagctccatcaacggcttcgagatcgagagccacaagtgctactgctccctcctgtgctgcccctactgccgccactgcagcgccgaccgggagatccaccagctgcacctctccatctgcaagaagcgcaagaccgggagcaacgtcatgctggccgtgtgcaagcggatgtgcctgcgcgtcaccaccgaggtgtccaaccgggccctcttcatccgcagcatcatcaacacgaccttcgtgatctgcatcctgatcctggccgtctgcgtgatctccaccagcgcggtggagatggagaacctccccgccggcacctgggagcgcgaggaggacctgacgaacttctgccaccaggagtgccaggtcaccgagaccgagtgcctgtgcccctacgaggccctggtgctccggaagccgctgttcagcgactccatcgtgaagggcatgaagaacctgctcaacagcacctccctggagacgagcctgtccatcgaggccccctggggcgccatcaacgtccagagcaccttcaagcccaccgtgtccaccgcgaacatcgccctcagctggtccagcatcgagcaccgcgggaacaagatcctggtgtccgggcggagcgagtccatcatgaagctggaggagcgcaccggcatcagctgggacctcggggtcgaggacgcctccgagagccggctgctgacggtgtccgtgatggacctcagccagatgtacagccccgtcttcgagtacctgtccggcgaccgccaggtggaggagtggccgaaggcgacctgcaccggcgactgccccgagcggtgcgggtgcaccagctccacgtgcctgcacaaggagtggccccacagccgcaactggcggtgcaaccccacctggtgctggggcgtggggaccggctgcacgtgctgcggcctcgacgtcaaggacctgttcaccgactacatgttcgtgaagtggaaggtggagtacatcaagaccgaggccatcgtctgcgtggagctgacctcccaggagcgccagtgcagcctcatcgaggccgggacccggttcaacctgggcccggtgacgatcaccctgtccgagccccgcaacatccagcagaagctcccgcccgagatcatcaccctgcacccccggatcgaggaggggttcttcgacctgatgcacgtccagaaggtgctcagcgcctccaccgtgtgcaagctgcagagctgcacgcacggcgtccccggggacctccaggtgtaccacatcggcaacctgctgaagggcgacaaggtgaacgggcacctgatccacaagatcgagccccacttcaacacctcctggatgagctgggacggctgcgacctcgactactactgcaacatgggggactggccgtcctgcacctacaccggcgtcacgcagcacaaccacgccgccttcgtgaacctgctgaacatcgagaccgactacaccaagaacttccacttccacagcaagcgcgtgaccgcccacggggacacgccccagctcgacctgaaggcgcggcccacctacggcgccggcgagatcaccgtcctggtggaggtggccgacatggagctccacaccaagaagatcgagatctccgggctgaagttcgccagcctgacgtgcaccggctgctacgcgtgctccagcgggatctcctgcaaggtccgcatccacgtggacgagcccgacgagctcaccgtgcacgtcaagagcgaggacccggacatcgtggccgccagctccagcctgatggcccggaagctggagttcggcaccgactccacgttcaaggccttcagcgcgatgcccaagacctccctctgcttctacatcgtggagcgcgagtactgcaagagctgctcccgggaggacacccagaagtgcgtcagcaccaagctggagcagccccagtccatcctgatcgagcacaaggggacgatcatcggcaagcagaacaacacgtgcaccaccaagacgacctgctggctcgagagcgtgaagtccttcttctacggcctgaagaacatgctgagctccatcttcgggaacgtgttcgtcggcatcttcagcttcctcgcccccttcatcctgctgatcctcttcttcatgttcgggtggcgcatcctgttctgcttcaagtgctgccgccggacccgcggcctgttcaagtaccggcacctcaaggacgacgaggagaccgggtaccgccggatcatcgagcgcctgaacaacaagaagggcaagtccaagctgctcgacggcgagcggctggccgaccgcaagatcgccgagctgttcagcaccaagacccacatcggg

SEQ ID NO: 12162 - RNA, 3495 nt, synthetic construct
  misc_feature 1..3495: note = derived and/or modified CDS sequence (opt1) from CCHVF(CCHVF Hodzha)__KX013448.1__Gn-NSm-Gc
  source 1..3495: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccggagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcgggcacggcaagacgatcgagacctaccaggcccgggaggagtacacctccatctgcctcttcgtcctgggcagcatcctgttcatcgtgtcctgcctcatgaaggggctggtggacagcatcggcaacatcttcttcccggggctgaccatctgcaagacgtgctccatcggcagcatcaacgggttcgagatcgagtcccacaagtgctactgcagcctcctgtgctgcccctactgccgccactgccccgccgaccgggagatccaccagctgcacctctccatctgcaagaagcgcaagaccggcagcaacgtcatgctggcggtgtgcaagcggatgtgcttccgcgccaccatggaggtgtccaacaaggccctgctcatccgcagcatcatcaacaccacgttcgtcgtgtgcatcctgatcctggccgtctgcgtggtgtccaccagcgccgtcgagatggagtccctccccgcgggcacctgggagcgggaggaggacctgaccaacttctgccaccaggagtgccaggtgacggagaccgagtgcctgtgcccgtacgaggccctggtgctccgccggcccctgttcctggacagcatcgtcaaggggaagaagaacctcctgaacagcacctccctggagaccagcctctccatcgaggccccctggggcgccatcaacgtgcagagcacgtacaagcccaccgtgtccaccgccaacatcgcgctgagctggtccagcgtcgagcaccgcgggaacaagatcctggtgtccggccggagcgagtccatcatgaagctcgaggagcgcaccgggatcagctgggacctgggcgtggaggacgcctccgagagcaagctgctcaccgtctccgtgatggacctgagccagatgtactccccggtgttcgagtacctgagcggcgaccggcaggtcgaggagtggcccaaggccacgtgcaccggggactgcagcgagcgctgcggctgcacctccagcacgtgcctccacaaggagtggccccactcccggaactggcgctgcaaccccacctggtgctggggcgtggggaccggctgcacgtgctgcgggctggacgtgaaggacctgttcaccgactacatgttcgtcaagtggaaggtggactacatcaagaccgaggccatcgtgtgcgtcgagctcaccagccaggagcggcagtgctccctggtggaggccggcacccgcttcaacctggggccggtgaccatcacgctcagcgagccccggaacatccagcagaagctgccgcccgagatcatcaccctgcacccccgcatcgaggagggcttcttcgacctcatgcacgtccagaaggtgctgtccgcgagcaccgtgtgcaagctgcagtcctgcacccacggggtccccggcgacctccaggtgtaccacatcggcaacctgctgaagggggacaaggtgaacggccacctcatccacaagatcgagccccacttcaacacgagctggatgtcctgggacgggtgcgacctggactactactgcaacatgggcgactggccgagctgcacctacaccggggtcacccagcacaaccacgcctccttcgtgaacctgctcaacatcgagacggactacaccaagagcttccacttccactccaagcgggtgaccgcccacggcgacacgccccagctggacctgaaggcccgccccacctacggcgcgggggagatcaccgtcctcgtggaggtggccgacatggagctgcacaccaagaagatcgagatcaccggcctgaagttcgccagcctcacgtgcaccgggtgctacgcctgctccagcggcatctcctgcaaggtccggatccacgtggacgagcccgacgagctgaccgtgcacgtcaagagcgacgacccggacgtggtggccgcgagctccagcctgatggcccgcaagctcgagttcgggaccgactccacgttcaaggccttcagcgccatgcccaagacctccctgtgcttctacatcgtcgagcgggagtactgcaagagctgctccaaggaggacacccagaagtgcgtgaacaccaagctggagcagccccagagcatcctcatcgagcagaagggcacgatcatcggcaagcagaacaacacgtgcaccgccaaggcgtcctgctggctggagagcgtgaagtccttcttctacgggctgaagaacatgctcagcggcatcttcgggaacgtcttcgtgggcatcttcctgttcctggcccccttcatcctcctgatcctgttcttcatgttcgggtggcgcatcctcttctgcttcaagtgctgccgccggacccgcggcctgttcaagtacaagcacctgaaggacgacgaggagaccggctaccggcgcatcatcgagcggctcaacaacaagaaggggaagaacaagctgctggacggcgagcgcctcgccgaccggcgcatcgccgagctgttctccaccaagacccacatcggg

SEQ ID NO: 12163 - RNA, 3495 nt, synthetic construct
  misc_feature 1..3495: note = derived and/or modified CDS sequence (opt1) from CCHVF(CCHVF IbAn7620)__KX013451.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgagatcgtgctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacgtcatcacgtgcatcctgtgcaaggccatcttctacctcctgatcatcatcggcaccctggggaagcggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggccaggggaagacgaccgaggcctaccgggcccgcgagggctacacctccatctgcctgttcgtcctgggcagcatcctcttcatcgtgtcctgcctgatgaaggggctggtggacagcgtcggcaactccttcttccccgggctcagcatctgcaagacctgctccatcagctccatcaacggcttcgagatcgagagccacaagtgctactgctccctgttctgctgcccctactgccggcactgcagcacggacaaggagatccacaagctgcacctctccatctgcaagaagcgcaagaccgggagcaacgtgatgctggccgtgtgcaagcggatgtgcttccgcgccaccatggaggtctccaaccgcgcgctgttcatccggagcatcatcaacaccacgttcgtgctctgcatcctgatcctggccgtctgcgtggtgtccaccagcgccgtcgagatggagaacctccccgccggcacctgggagcgcgaggaggacctgaccaacttctgccaccaggagtgccaggtgacggagaccgagtgcctgtgcccgtacgaggccctggtgctccggaagcccctgttcctggacagcatcgcgaagggcatgaagaaccccctcaactccaccagcctggagacctccctgagcatcgaggccccctggggcgccatcgacgtccagtccacgtacaagccgaccgtgagcaccgccaacatcgccctctcctggagctccgtggagcaccgcgggaacaagatcctggtcagcgggcggtccgagagcatcatgaagctggaggagcgcaccggcatctcctgggacctcggggtggaggacgcgagcgagtccaagctgctgaccgtgagcgtcatggacctctcccagatgtacagccccgtgttcgagtacctgagcggcgaccgccaggtggaggagtggcccaaggccacgtgcaccggcgactgccccgagcggtgcgggtgcacctccagcacgtgcctgcacaaggagtggccgcactcccggaactggcgctgcaaccccacctggtgctggggcgtcgggaccggctgcacgtgctgcggcctcgacgtgaaggacctgttcaccgactacatgttcgtgaagtggaaggtcgagtacatcaagaccgaggccatcgtgtgcgtggagctgaccagccaggagcggcagtgctccctcatcgaggccgggacccgcttcaacctgggccccgtcaccatcacgctgagcgagccccggaacatccagcagaagctcccgcccgagatcatcaccctgcacccccgcatcgaggaggggttcttcgacctgatgcacgtgcagaaggtgctctccgccagcaccgtctgcaagctgcagtcctgcacccacggcgtgccgggggacctccaggtgtaccacatcggcaacctcctgaagggcgacaaggtcaacgggcacctgatccacaagatcgagccccacttcaacacgagctggatgtcctgggacggctgcgacctcgactactactgcaacatgggggactggcccagctgcacctacaccggcgtgacccagcacaaccacgcgtccttcgtgaacctgctgaacatcgagacggactacaccaagaacttccacttccacagcaagcgggtcaccgcccacggggacacgccccagctcgacctgaaggcccgcccgacctacggcgccggcgagatcaccgtgctggtggaggtcgcgaacatggagctccacaccaagaagatcgagatctccgggctgaagttcgccagcctgacctgcacgggctgctacgcctgctccagcgggatctcctgcaaggtgcggatccacgtggacgagcccgacgagctcaccgtccacgtcaagagcgacgaccccgacgtggtggccgccagctccagcctgatggcgcgcaagctggagttcggcaccgactccaccttcaaggccttcagcgccatgcccaagacgtccctctgcttctacatcgtggagcgggagcactgcaagagctgctccgaggaggacaccaagaagtgcgtgaacaccaagctggagcagccgcagagcatcctgatcgagcacaaggggaccatcatcggcaagcagaactccacgtgcaccgccaaggccagctgctggctcgagtccgtcaagagcttcttctacggcctgaagaacatgctgtccgggatcttcggcaacgtgttcatggggatcttcctcttcctggcgcccttcatcctgctcatcctgttcttcatgttcggctggcgcatcctgttctgcttcaagtgctgccgccggacccgcggcctcttcaagtaccggcacctgaaggacgacgaggagaccgggtaccgccggatcatcgagcgcctgaacaacaagaagggcaagaacaagctcctggacggggagcggctggccgaccgccggatcgccgagctgttcagcaccaagacgcacatcggc

SEQ ID NO: 12164 - RNA, 3495 nt, synthetic construct
  misc_feature 1..3495: note = derived and/or modified CDS sequence (opt1) from CCHVF(CCHVF K128_76)__KX013454.1__Gn-NSm-Gc
  source 1..3495: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcatcccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacgtgcatcgtgtgcaaggccatcttctacctgctcatcatcgtcgggaccctgggcaagcgcttcaagcagtaccgggagctgaagccccagacctgcaccatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtggaggagaccgagctctacctgaacctggagcggatcccctgggtcgtgcgcaagctcctccaggtgtccgagagcaccggcgtcgccctgaagcggagctcctggctcatcgtgctgctggtcctcttcgcggtgagcctgtcccccgtgcagagcgcccccatctcccacgggaagacgatcgagacctaccaggtgcgcgaggagtacaccagcatctgcctgttcgtcctcggctccatcctgttcatcgtgagctgcctgatgaagggcctcgtgaactccgtcgggaacatcttcttcccgggcctgagcatctgcaagacctgctccatcgggagcatcaacggcttcgagatcgagtcccacaagtgctactgcagcctgctctgctgcccctactgccggcactgctccgccgaccgcgagatccaccagctgcacctgagcatctgcaagaagcggaagacggggtccaacgtgatgctcgccgtctgcaagcgcatgtgcttccgggccaccatggaggtgagcaacaaggcgctgttcatccgctccatcatcaacaccaccttcgtggtctgcatcctgatcctcgccgtgtgcgtggtcagcacgagcgccgtggagatggagtccctgcccgccggcacctgggagcgcgaggaggacctgaccaacttctgccaccaggagtgccaggtgaccgagacggagtgcctctgcccctacgaggccctggtcctgcggcgcccgctgttccaggacagcatcgtgaagggcatgaagaacctcctgaactccaccagcctggagacctccctcagcatcgaggcgccctggggcgccatcaacgtgcagtccacctacaagcccgccgtcagcgccgccaacatcgcgctgtcctggagctccgtggagcaccgggggagcaagatcctggtgtccgggcgcagcgagtccatcatgaagctcgaggagcggacgggcatcagctgggacctgggggtcgaggacgcctccgagagcaagctgctcaccgtgagcgtgatggacctgtcccagatgtacagccccgtcttcgagtacctgtccggcgaccgccaggtggaggagtggccgaaggcgacctgcaccggcgactgccccgagcggtgcgggtgcaccagctccacgtgcctccacaaggagtggccccacagccgcaactggcggtgcaaccccacctggtgctggggcgtggggaccggctgcacgtgctgcggcctggacgtcaaggacctgttcaccgactacatgttcgtgaagtggaaggtggagtacatcaagaccgaggccatcgtctgcgtggagctcacctcccaggagcgccagtgcagcctgatcgaggccgggacccggttcaacctgggcccggtgacgatcaccctctccgagccccgcaacatccagcagaagctgccgcccgagatcatcaccctgcacccccggatcgaggaggggttcttcgacctcatgcacgtccagaaggtgctgagcgcctccaccgtgtgcaagctgcagagctgcacgcacggcgtccccggggacctccaggtgtaccacatcggcaacctgctgaagggcgaccgcgtgaacgggcacctcatccacaagatcgagccccacttcaacacctcctggatgagctgggacggctgcgacctggactactactgcaacatgggggactggccgtcctgcacctacaccggcgtcacgcagcacaaccacgccagcttcgtgaacctgctcaacatcgagaccgactacaccaagtccttccacttccacagcaagcgggtgaccgcccacggggacacgccccagctggacctgaaggcccgccccaactacggcgcgggcgagatcaccgtcctcgtggaggtggccgacatggagctgcacaccaagaagatcgagatctccgggctgaagttcgccagcctgacctgcacgggctgctacgcctgcagctccgggatcagctgcaaggtccggatccacgtggacgagcccgacgagctgaccgtgcacgtcaagtccgacgacccggacgtggtggccgcgagctccagcctgatggcccgcaagctcgagttcggcaccgactccaccttcaaggccttcagcgccatgcccaagacgtccctgtgcttctacatcgtcgagcgggagtactgcaagagctgctccaaggaggacacccagaagtgcgtgaacaccaagctggagcagccccagagcatcctcatcgagcacaaggggaccatcatcggcaagcagaacaacacgtgcaccgccaagacctcctgctggctggagagcgtgaagtccttcttctacggcctgaagaacatgctcagcgggatcttcggcaacgtcttcgtggggatcttcctgttcctggcgcccttcatcctcctgatcctgttcttcatgttcggctggcgcatcctcttctgcttcaagtgctgccgccggacccgcgggctgttccggtacaagcacctggagaacgacgaggagacgggctaccgccggatcatcgagcgcctcaacaacaagaagggcaagaacaagctgctggacggggagcggctcgccgaccgccggatcgccgagctgttctccaccaagacccacatcggc

SEQ ID NO: 12165 - RNA, 3495 nt, synthetic construct
  misc_feature 1..3495: note = derived and/or modified CDS sequence (opt1) from CCHVF(CCHVF K168_40)__KX013457.1__Gn-NSm-Gc
  source 1..3495: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacctgcatcgtctgcaaggccatcttctacctgctcatcatcgtggggaccctgggcaagcgcttcaagcagtaccgggagctgaagccccagacctgcacgatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtcgaggagaccgagctctacctgaacctggagcggatcccctgggtggtgcgcaagctcctgcaggtctccgagagcaccggcgtggccctgaagcggagctcctggctcatcgtgctgctggtcctcttcgcggtgagcctgtcccccgtgcagagcgcccccatcgggcacggcaagacgatcgagacctaccaggtccgcgaggagtacacctccatctgcctgttcgtgctcggcagcatcctgttcatcgtgtcctgcctgatgaaggggctcgtcaacagcgtgggcaacatcttcttcccggggctgtccatctgcaagacctgcagcatcggctccatcaacgggttcgagatcgagagccacaagtgctactgctccctgctctgctgcccctactgccggcactgcagcgccgaccgcgagatccaccagctgcacctgtccatctgcaagaagcggaagacgggcagcaacgtcatgctcgccgtgtgcaagcgcatgtgcttccgggccaccgtggaggtctccaacaaggcgctgagcatccgctccatcatcaacaccaccttcgtggtgtgcatcctgatcctcgccgtctgcgtggtgagcacgagcgccgtcgagatggagtccctgcccgccggcacctgggagcgcgaggaggacctgaccaacttctgccaccaggagtgccaggtgaccgagacggagtgcctctgcccctacgaggccctggtgctgcggcgcccgctgttcctcgacgggatcgtcaagggcatgaagaacctgctgaacagcacctccctcgagaccagcctgtccatcgaggcgccctggggggccatcaacgtgcagagcacctacaagcccacggtgtccgccgccaacatcgccctgagctggtccagcgtcgagcaccggggcaacaagatcctcgtgtccgggcgcagcgagtccatcatgaagctggaggagcggaccggcatcagctgggacctgggcgtggaggacgcgtccgagagcaagctcctgaccgtctccgtgatggacctgagccagatgtacagccccgtgttcgagtacctctccggggaccgccaggtcgaggagtggccgaaggccacctgcaccggcgactgccccgagcggtgcgggtgcacgagctccacctgcctgcacaaggagtggccccacagccgcaactggcggtgcaaccccacctggtgctggggcgtgggcaccgggtgcacgtgctgcggcctggacgtgaaggacctcttcaccgactacatgttcgtcaagtggaaggtggagtacatcaagaccgaggccatcgtgtgcgtcgagctgacctcccaggagcgccagtgcagcctgatcgaggccgggacgcggttcaacctcggcccggtgaccatcaccctgtccgagccccgcaacatccagcagaagctgccccccgagatcatcaccctccacccgcggatcgaggaggggttcttcgacctgatgcacgtgcagaaggtcctgagcgcctccacggtgtgcaagctccagagctgcacccacggcgtgcccggcgacctgcaggtctaccacatcgggaacctgctcaagggcgacaaggtgaacgggcacctgatccacaagatcgagccccacttcaacacctcctggatgagctgggacggctgcgacctggactactactgcaacatgggggactggccgtcctgcacctacacgggcgtgacccagcacaaccacgcgagcttcatcaacctcctgaacatcgagaccgactacaccaagtccttccacttccacagcaagcgcgtcacggcccacggcgacaccccccagctggacctcaaggcccggcccaactacggggccggcgagatcaccgtgctggtggaggtcgcggacatggagctgcacaccaagaagatcgagatctccgggctcaagttcgccagcctgacgtgcaccggctgctacgcctgctccagcgggatcagctgcaaggtgcgcatccacgtggacgagcccgacgagctgaccgtccacgtgaagtccgacgacccggacgtggtcgccgccagctccagcctcatggcgcggaagctggagttcggcaccgactccacgttcaaggccttcagcgccatgcccaagacctccctgtgcttctacatcgtggagcgcgagtactgcaagagctgctccaaggaggacacccagaagtgcgtgaacaccaagctcgagcacccccagagcatcctgatcgagcacaagggcacgatcatcgggaagcagaacaacacctgcaccgccaagacctcctgctggctggagagcgtcaagtccttcttctacggcctcaagaacatgctgagcgggatcttcggcaacgtgttcgtggggatcttcctgttcctcgcccccttcatcctgctgatcctcttcttcatgttcggctggcggatcctgttctgcttcaagtgctgccgccgcacgcggggcctgttccgctacaagcacctcgaggacgacgaggagaccgggtaccggcgcatcatcgagcggctgaacaacaagaagggcaagaacaagctgctcgacggggagcgcctggcggaccggcgcatcgccgagctgttctccaccaagacccacatcggc

SEQ ID NO: 12166 - RNA, 3495 nt, synthetic construct
  misc_feature 1..3495: note = derived and/or modified CDS sequence (opt1) from CCHVF(CCHVF K168_125)__KX013460.1__Gn-NSm-Gc
  source 1..3495: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaaggtgcccctgctcggcaagatggccatctacatctgccggatgagcaaccacccgaagaccacgatggccttcctgttctggttctccttcggctacgtcatcacctgcatcgtgtgcaaggccatcttctacctgctcatcatcgtggggaccctgggcaagcgcttcaagcagtaccgggagctgaagccccagacctgcacgatctgcgagaccacccccaccaacgccatcgacgcggagatgcacgacctcaactgcagctacaacatctgcccctactgcgcctcccgcctgacgagcgacgggctggcccggcacgtcacccactgcccgaagcgcaaggagaaggtggaggagaccgagctctacctgaacctggagcggatcccctgggtggtccgcaagctcctgcaggtgtccgagagcaccggcgtggccctgaagcggagctcctggctcatcgtcctgctggtgctcttcgcggtgagcctgtcccccgtccagagcgcccccatcgggcacggcaagacgatcgagacctaccaggtgcgcgaggagtacacctccatctgcctgttcgtgctcggcagcatcctgttcatcgtctcctgcctgatgaaggggctcgtgaacagcgtcggcaacatcttcttcccggggctgtccatctgcaagacctgcagcatcggctccatcaacgggttcgagatcgagagccacaagtgctactgctccctgctctgctgcccctactgccggcactgcagcgccgaccgcgagatccaccagctgcacctgtccatctgcaagaagcggaagacgggcagcaacgtgatgctcgccgtgtgcaagcgcatgtgcttccgggccaccgtcgaggtgtccaacaaggcgctgagcatccgctccatcatcaacaccaccttcgtggtctgcatcctgatcctcgccgtgtgcgtggtcagcacgagcgccgtggagatggagtccctgcccgccggcacctgggagcgcgaggaggacctgaccaacttctgccaccaggagtgccaggtgaccgagacggagtgcctctgcccctacgaggccctggtcctgcggcgcccgctgttcctcgacagcatcgtgaaggggaagaagaacctgctgaactccaccagcctcgagacctccctgagcatcgaggcgccctggggcgccatcaacgtgcagtccacctacaagcccacggtcagcgccgccaacatcgccctgtcctggagctccgtggagcaccgggggaacaagatcctcgtgagcggccgctccgagagcatcatgaagctggaggagcggaccgggatctcctgggacctgggcgtcgaggacgcgagcgagtccaagctcctgaccgtgagcgtgatggacctgagccagatgtactcccccgtcttcgagtacctcagcggcgaccgccaggtggaggagtggccgaaggccacctgcaccggggactgccccgagcggtgcggctgcacgtccagcacctgcctgcacaaggagtggccccactcccgcaactggcggtgcaaccccacctggtgctggggggtgggcaccggctgcacgtgctgcgggctggacgtcaaggacctcttcaccgactacatgttcgtgaagtggaaggtggagtacatcaagaccgaggccatcgtctgcgtggagctgaccagccaggagcgccagtgctccctgatcgaggccggcacgcggttcaacctcgggccggtgaccatcaccctgagcgagccccgcaacatccagcagaagctgccccccgagatcatcaccctccacccgcggatcgaggagggcttcttcgacctgatgcacgtccagaaggtgctgtccgccagcacggtgtgcaagctccagtcctgcacccacggggtccccggcgacctgcaggtgtaccacatcggcaacctgctcaagggggacaaggtgaacggccacctgatccacaagatcgagccccacttcaacaccagctggatgtcctgggacgggtgcgacctggactactactgcaacatgggcgactggccgagctgcacctacacgggggtcacccagcacaaccacgcgtccttcatcaacctcctgaacatcgagaccgactacaccaagagcttccacttccactccaagcgcgtgacggcccacggcgacaccccccagctggacctcaaggcccggcccaactacggcgccggggagatcaccgtgctggtcgaggtggcggacatggagctgcacaccaagaagatcgagatcagcggcctcaagttcgcctccctgacgtgcaccgggtgctacgcctgcagcagcggcatctcctgcaaggtgcgcatccacgtcgacgagcccgacgagctgaccgtgcacgtgaagagcgacgacccggacgtcgtggccgcctccagctccctcatggcgcggaagctggagttcgggaccgacagcacgttcaaggccttctccgccatgcccaagaccagcctgtgcttctacatcgtggagcgcgagtactgcaagtcctgcagcaaggaggacacccagaagtgcgtcaacaccaagctcgagcacccccagtccatcctgatcgagcacaagggcacgatcatcggcaagcagaacaacacctgcaccgccaagaccagctgctggctggagtccgtgaagagcttcttctacgggctcaagaacatgctgtccggcatcttcgggaacgtgttcgtcggcatcttcctgttcctcgcccccttcatcctgctgatcctcttcttcatgttcgggtggcggatcctgttctgcttcaagtgctgccgccgcacgcggggcctgttccgctacaagcacctcgaggacgacgaggagaccggctaccggcgcatcatcgagcggctgaacaacaagaaggggaagaacaagctgctcgacggcgagcgcctggcggaccggcgcatcgccgagctgttcagcaccaagacccacatcggg

SEQ ID NO: 12167 - RNA, 3495 nt, synthetic construct
  misc_feature 1..3495: note = derived and/or modified CDS sequence (opt1) from CCHVF(CCHVF K229_194)__KX013463.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaagggcaacctcatcgacctggggtgcccccacatcccgctgctcggcaagatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacgggctggcccgccacgtgacccagtgccccaagcggaaggagaaggtcgaggagaccgagctctacctgaacctggagcgcatcccctggatcgtgcggaagctcctccaggtgagcgagtccaccggcgtcgcgctgaagcgcagcagctggctgatcgtgctgctggtgctcctgacggtctccctgagccccgtgcagtccgccccggtggggcacggcaagaccatcgagacctaccagacccgggagggcttcacgaacatctgcctcttcatgctggggagcatcctgttcatcgtctcctgcctcgtgaagggcctggtggacagcgtctccgacagcttcttccccgggctgtccgtgtgcaagacctgcagcatcggctccatcaacgggttcgagatcgagagccacaagtgctactgctccctcttctgctgcccctactgccgccactgcagcgccgaccgggagatccaccagctgcacctgggcatctgcaagaagcgcaagaccggctccaacgtgatgctcgccgtctgcaagcggatgtgcttcaaggccaccatcgaggcgagccgccgggccctgctgatccgctccatcatcaacacgaccttcgtgatctgcatcctcaccctggccatctgcgtcgtgagcacctccgccgtggagatggagaacctgcccgccgggacgtgggagcgcgaggaggacctcaccagcttctgccaccaggagtgccaggtcaccgagaccgagtgcctgtgcccgtacgaggcgctggtgctgcggaagcccctcttcctggacagcatcgtgaagggcaagaagaacctgctcaactccacgagcctggagacctccctgagcatcgaggccccctggggcgccatcaacgtccagtccaccttcaagcccaccgtgagcaccgccaacatcgccctctcctggagctccgtggagcaccgcgggaacaagatcctggtcacggggcggagcgagtccatcatgaagctggaggagcgcaccggcgtgagctgggacctcggcgtggaggacgcgtccgagagcaagctgctgaccgtctccatcatggacctcagccagatgtactccccggtgttcgagtacctgagcggggaccgccaggtggaggagtggcccaaggcgacctgcacgggcgactgccccgagcggtgcgggtgcaccagctccacgtgcctgcacaaggagtggccccacagccggaactggcgctgcaacccgacctggtgctggggcgtcggcaccgggtgcacgtgctgcggcgtggacgtgaaggacctcttcaccgaccacatgttcatcaagtggaaggtcgagtacatcaagaccgaggccatcgtgtgcgtggagctgacctcccaggagcggcagtgcagcctgatcgaggccgggacccgcttcaacctcggccccgtcaccatcaccctgtccgagccccggaacatccagcagaagctgcccccggagatcatcacgctccaccccaagatcgaggaggggttcttcgacctgatgcacgtgcagaaggtgctgagcgcctccaccgtctgcaagctccagagctgcacccacggcatccccggcgacctgcagatctaccacatcgggaacctgctcaagggcgaccgcctgaacgggcacctgatccacaagatcgagccgcacttcaacacctcctggatgagctgggacggctgcgacctcgactactactgcaacatgggggactggccctcctgcacgtacaccggcgtgacccagcacaaccacgccgccttcgtgaacctgctgaacatcgagaccgactacacgaagaccttccacttccacagcaagcgggtcaccgcccacggcgacacgccccagctcgacctgaaggcccgccccacctacggggcgggcgagatcaccgtgctggtggaggtcgccgacatggagctccacaccaagaaggtggagatctccgggctgaagttcgccagcctggcctgcaccggctgctactcctgcagctccgggatcagctgcaaggtgcggatccacgtcgacgagccggacgagctcacggtgcacgtgaagtccagcgaccccgacgtcgtggccgcgagcacctccctgatggcccgcaagctggagttcggcaccgacagcaccttcaaggccttctccgccatgcccaagacgagcctctgcttctacatcgtggagcgggagtactgcaagtcctgcagcgaggacgacaccaagaagtgcgtcgacaccaagctggagcagccccagtccatcctgatcgagcacaagggcaccatcatcgggaagcagaacgacacgtgcaccgccaaggcgagctgctggctcgagtccgtcaagagcttcttctacggcctgaagaacatgctggggtccgtgttcggcaacttcttcgtggggatcctcctgttcctggccccgttcgtgctcctggtgctgttcttcatgttcggctggaagatcctcttctgcttcaagtgctgccgccggacccgcggcctgttcaagtaccgccacctgaaggacgacgaggagaccgggtaccggaagatcatcgagcgcctcaacagcaagaagggcaagaaccggctgctggacggggagcgcctcgccgaccggaagatcgccgagctgttctccaccaagacgcacatcggc

SEQ ID NO: 12168 - RNA, 3495 nt, synthetic construct
  misc_feature 1..3495: note = derived and/or modified CDS sequence (opt1) from CCHVF(CCHVF K229_243)__KX013466.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagaccgggtccaacgtcatgctggccgtgtgcaagcgcatgtgcttccgggccaccatcgaggcgagccgccgcgccctgctcatccggtccatcatcaacaccacgttcgtcatctgcatcctgaccctgaccatctgcgtggtgagcaccagcgccgtcgagatggagaacctcccggccggcacgtgggagcgcgaggaggacctgaccaacttctgccaccaggagtgccaggtgaccgagaccgagtgcctgtgcccctacgaggccctggtgctccggaagcccctgttcctggactccatcgtcaagggcatgaagaacctcctgaacagcacgtccctggagaccagcctctccatcgaggcgccctggggcgccatcaacgtgcagagcaccttcaagccgaccgtgtccaccgccaacatcgccctgagctggtccagcgtcgagcaccgcgggaacaagatcctggtgacggggcggtccgagagcatcatgaagctcgaggagcgcaccggcgtgtcctgggacctgggggtcgaggacgccagcgagtccaagctgctcaccgtgagcatcatggacctgtcccagatgtacagccccgtgttcgagtacctgagcggcgaccggcaggtcgaggagtggcccaaggcgacctgcacgggcgactgccccgagcgctgcgggtgcacctccagcacgtgcctccacaaggagtggccgcactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgaccagccaggagcggcagtgctccctcatcgaggccgggacccgcttcaacctgggccccgtgaccatcaccctgagcgagccccggaacatccagcagaagctcccgcccgagatcatcacgctgcaccccaaggtcgaggaggggttcttcgacctgatgcacgtgcagaaggtgctctccgccagcaccgtctgcaagctgcagtcctgcacccacggcatcccgggggacctccaggtgtaccacatcggcaacctgctgaagggcgaccgcgtgaacgggcacctgatccacaagatcgagccccacttcaacaccagctggatgtcctgggacggctgcgacctcgactactactgcaacatgggggactggcccagctgcacgtacaccggcgtcacccagcacaaccacgccgcgttcgtgaacctgctgaacatcgagaccgactacacgaagaccttccacttccactccaagcgggtgaccgcccacggggacacgccccagctcgacctgaaggcccgcccgacctacggcgccggcgagatcaccgtcctggtggaggtggcggacatggagctccacaccaagaaggtcgagatcagcgggctgaagttcgcctccctggcctgcaccggctgctacgcctgcagctccgggatcagctgcaaggtgcggatccacgtggacgagcccgacgagctcacggtccacgtgaagtccagcgaccccgacgtggtcgccgcgagcacctccctgatggcccgcaagctggagttcggcaccgacagcaccttcaaggccttctccgccatgcccaagacgagcctctgcttctacatcgtggagaaggagtactgcaagtcctgcagcgaggaggacacccagaagtgcgtggacaccaagctggagcagccgcagtccatcctgatcgagcacaaggggaccatcatcggcaagcagaacgacacgtgcaccgccaaggcgagctgctggctcgagtccgtcaagagcttcttctacggcctgaagaacatgctggggtccgtgttcggcaacttcttcatcgggatcctcctgttcctgacccccttcgtgctcctggtcctgttcttcatgttcggctggaagatcctcttctgcttcaagtgctgccggcgcacccgcgggctgctgaagtaccggcacctcaaggacgacgaggagaccggctaccgccggatcatcgagcgcctgaacaacaagaagggcaagaaccggctgctcgacggggagcgcctggccgaccggaagatcgccgagctgttcagcacgaagacccacatcggc

SEQ ID NO: 12169 - RNA, 3495 nt, synthetic construct
  misc_feature 1..3495: note = derived and/or modified CDS sequence (opt1) from CCHVF(CCHVF K315_14)__KX013469.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgtctgcgactccagctgcgagatcatgatccccaaggggacgggcgacatcctggtggactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtcaacgccatcgacgcggagatgcacgacctcaactgctcctacaacatctgcccgtactgcgccagccggctgacgtccgagggcctggcccgccacgtgacccagtgccccaagcggaaggagaaggtggaggagaccgagctctacctgaacctggagcgcatcccctggatcgtccggaagctcctccaggtgagcgagtccaccggggtggccctgaagcgcagcagctggctcatcgtcctgctggtgctcctgacggtgtccctgagccccgtccagtccgcgccggtgggccacgggaagaccatcgagacctaccagacccgggagggcttcacgagcatctgcctcttcatgctgggctccatcctgttcatcgtgagctgcctcgtcaaggggctggtgtactccgtgagcgactccttcttccccggcctgagcgtctgcaagacctgctccatcgggagcatcaacggcttcgagatcgagtcccacaagtgctactgcagcctcttctgctgcccctactgccgccactgctccgccgaccgggagatccaccagctgcacctgagcatctgcaagaagcgcaagaccgggtccaacgtgatgctcgccgtctgcaagcggatgtgcttcaaggccaccatcgaggccagccgccgggcgctgctgatccgctccatcatcaacacgaccttcgtgatctgcatcctcaccctggccatctgcgtggtcagcaccagcgccgtggagatggaggacctgcccgccggcacgtgggagcgcgaggaggacctcaccaacttctgccaccaggagtgccaggtgaccgagaccgagtgcctgtgcccgtacgaggccctggtcctgcggaagcccctcttcctggactccatcgtgaagggcatgaagaagctgctcaacagcacgtccctggagaccagcctgtccatcgaggcgccctggggcgccatcaacgtgcagagcaccttcaagcccaccgtctccaccgccaacatcgccctcagctggtccagcgtggagcaccgcgggaacaagatcctggtgacggggcggtccgagagcatcatgaagctggaggagcgcaccggcgtctcctgggacctcggggtggaggacgccagcgagtccaagctgctgaccgtgagcatcatggacctctcccagatgtacagcccggtcttcgagtacctgagcggcgaccgccaggtggaggagtggcccaaggcgacctgcacgggcgactgccccgagcggtgcgggtgcacctccagcacgtgcctgcacaaggagtggccccactcccggaactggcgctgcaacccgacctggtgctggggcgtggggaccggctgcacgtgctgcggcgtcgacgtgaaggacctcttcaccgaccacatgttcatcaagtggaaggtggagtacatcaagaccgaggccatcgtctgcgtggagctgaccagccaggagcggcagtgctccctgatcgaggccgggacccgcttcaacctcggccccgtgaccatcaccctgagcgagccccggaacatccagcagaagctgcccccggagatcatcacgctccaccccaagatcgaggaggggttcttcgacctgatgcacgtccagaaggtgctgtccgccagcaccgtgtgcaagctccagtcctgcacccacggcatccccggggacctgcagatctaccacatcggcaacctgctcaagggcgaccgcgtcaacgggcacctgatccacaagatcgagccgcacttcaacaccagctggatgtcctgggacggctgcgacctggactactactgcaacatgggggactggcccagctgcacgtacaccggcgtgacccagcacaaccacgccgcgttcgtgaacctcctgaacatcgagaccgactacacgaagaccttccacttccactccaagcgggtcaccgcccacggggacacgccccagctggacctcaaggcccgccccacctacggcgccggcgagatcaccgtgctggtggaggtcgcggacatggagctgcacaccaagaaggtggagatcagcgggctcaagttcgcctccctgacctgcacgggctgctacgcctgcagctccgggatcagctgcaaggtgcggatccacgtcgacgagccggacgagctgaccgtgcacgtgaagtccagcgaccccgacgtcgtggccgccagcacctccctcatggcgcgcaagctggagttcggcaccgacagcacgttcaaggccttctccgccatgcccaagaccagcctgtgcttctacatcgtggagcgggagtactgcaagtcctgcagcgaggacgacaccaagaagtgcgtcgacaccaagctcgagcagccccagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcagcttcttcgtggggatcctcctcttcctggcgccgttcgtgctgctcgtgctgttcttcatgttcggctggaagatcctgttctgcttcaagtgctgccgccggacccgcgggctgttcaagtaccgccacctgaaggacgacgaggagaccggctaccggcgcatcatcgagcggctgaactccaagaagggcaagaaccgcctcctggacggggagcggctggccgaccgcaagatcgccgagctgttcagcacgaagacccacatcggc

SEQ ID NO: 12170 - RNA, 3495 nt, synthetic construct
  misc_feature 1..3495: note = derived and/or modified CDS sequence (opt1) from CCHVF(CCHVF K323_27)__KX013472.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacctcctgatcatcatcggcaccctggggaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacggcctcgcccgccacgtgacccagtgccccaagcggaaggagaaggtcgaggagaccgagctgtacctgaacctcgagcgcatcccctggatcgtgcggaagctgctccaggtgtccgagagcaccggggtcgcgctgaagcgctccagctggctgacggtgctgctcgtgctgctgaccgtcagcctctcccccgtgcagagcgccccggtgggccacgggaacaccatcgagacctaccagacgcgggagggcttcacctccatctgcctgttcatgctgggcagcatcctcttcatcgtctcctgcctggtgaaggggctggtggacagcgtctccgacagcttcttccccggcctctccgtgtgcaagacctgcagcatcgggtccatcaacggcttcgagatcgagagccacaagtgctactgctccctgttctgctgcccccactgccgccaccggagcgccgaccgcgagatccaccagctgcacctctccatctgcaagaagcggaagaccgggagcaacgtgatgctggccgtctgcaagcgcatgtgccccaaggccacgatcgaggcgtcccggcgcgccctgccgatccgcagcatcatcaacaccaccctcgtgatgtgcatcctgaccctggccatctgcgtcgtgtccacgagcgccgtggagatggaggacctccccgccggcacctgggagcgggaggaggacctgaccaacttctgccaccaggagtgccaggtcaccgagacggagtgcctgtgcccctacgaggcgctggtgctccgcaagcccctgttcctggacagcatcgccaagggcatgaagaacctcctgaactccaccagcctggagacctccctcagcatcgaggccccgtggggcgccatcaacgtgcagtccaccttcaagcccaccgtcagcacggccaacatcgcgctgtcctggagctccgtggagcaccgggggaacaagatcctggtgaccgggcgcagcgagtccatcatgaagctcgaggagcggaccggcgtcagctgggacctgggggtggaggacgcctccgagagcaagctgctcaccgtgtccatcatggacctgagccagatgtactcccccgtcttcgagtacctgagcggcgaccgccaggtggaggagtggcccaaggccacgtgcaccggcgactgcccggagcggtgcgggtgcaccagctccacgtgcctccacaaggagtggccccacagccgcaactggcggtgcaaccccacctggtgctggggcgtggggaccggctgcacgtgctgcggcgtcgacgtgaaggacctgttcaccgaccacatgttcatcaagtggaaggtggagtacatcaagaccgaggccatcgtctgcgtggagctgaccgggcaggagcgccagtgctccctcatcgaggccggcacccggttcaacctggggcccgtgaccatcacgctgagcgagccgcgcaacatccagcagaagctcccgcccgagatcatcaccctgcaccccaagatcgaggagggcttcttcgacctgatgcacgtccagaaggtgctctccgcgagcaccgtgtgcaagctgcagtcctgcacccacgggatccccggcgacctgcagatctaccacatcggcaacctcctgaagggggaccgggtcaacggccacctgatccacaagatcgagccccacttcaacacgagctggatgtcctgggacgggtgcgacctcgactactactgcaacatgggcgactggcccagctgcacctacaccggggtgacccagcacaaccacgccgccttcgtgaacctgctgaacatcgagacggactacaccaagaccttccacttccactccaagcgcgtcaccgcccacggcgacacgccgcagctcgacctgaaggcgcggcccacctacggcgccggggagatcaccgtgctggtggaggtcgccgacatggagctccacaccaagaaggtggagatcagcggcctgaagttcgcctccctgacgtgcaccgggtgctacgcctgcagctccggcatcagctgcaaggtgcgcatccacgtcgacgagcccgacgagctcaccgtgcacgtgaagtccagcgaccccgacgtcgtggcggcctccaccagcctgatggcccggaagctggagttcgggacggacagcaccttcaaggccttctccgccatgccgaagaccagcctctgcttctacatcgtggagcgcgagtactgcaagtcctgcagcgaggacgacaccaagaagtgcgtcgacaccaagctggagcagccccagtccatcctgatcgagcacaagggcacgatcatcggcaagcagaacgacacgtgcaccgcgaaggccagctgctggctcgagtccgtcaagagcttcttctacgggctgaagaacatgctgggctccgtgttcgggagcttcttcgtgggcatcctcctgttcctggcccccttcgtgctcctggtgctgttcttcatgttcgggtggaagatcctcttctgcttcaagtgctgccggcgcacccgcggcctgttcaagtaccggcacctgaacgacgacgaggagaccggctaccgccggatcatcgagcgcctcaactccaagaaggggaagaaccggctgctggacggcgagcgcctcgccgaccggaagatcgccgagctgttcagcaccaagacccacatcggg

SEQ ID NO: 12171 - RNA, 3495 nt, synthetic construct
  misc_feature 1..3495: note = derived and/or modified CDS sequence (opt1) from CCHVF(CCHVF K340_6)__KX013475.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccacgaccggcaagacctgcgagatcgacagcacccccgtgaagtgccggcaggggttctgcctgaagatcacgcaggagggccgcgggcacgtgaagctgtcccggggcagcgaggtcgtgctcgacgcctgcgactccagctgcgagatcatgatccccaaggggaccggcgacatcctggtggactgctccggcgggcagcagcacttcctgaaggacaacctcatcgacctgggctgcccccacatcccgcccctggggaagatggcgatctacatctgccgcatgagcaaccacccccggaccaccatggccttcctcttctggttctccttcggctacgtcatcacgtgcatcttctgcaaggccctgttctacagcctgatcatcatcggcaccctcgggaagaagatcaagcagtaccgcgagctgaagccccagacctgcaccatctgcgagacggccccggtgaacgccatcgacgcggagatgcacgacctgaactgctcctacaacatctgcccctactgcgccagccggctcacctccgacggcctggcccgccacgtgacccagtgccccaagcggaaggagaaggtcgaggagaccgagctgtacctcaacctggagcgcatcccctggatcgtgcggaagctgctccaggtgagcgagtccacgggggtcgccctgaagcgcagcagctggctgatcgtgctcctggtgctgctcaccgtctccctgagcccggtgcagtccgcgcccgtgggccacgggaagaccatcgagacctaccagacgcgggagggcttcaccagcatctgcctgttcatgctcggctccatcctgttcatcgtcagctgcctggtgaaggggctcgtggactccgtcagcgactccttcttccccggcctgagcgtgtgcaagacctgctccatcgggagcatcaacggcttcgagatcgagtcccacaagtgctactgcagcctgttctgctgcccctactgccgccactgctccgccgaccgggagatccaccagctccacctgagcatctgcaagaagcgcaagaccgggtccaacgtgatgctggccgtctgcaagcggatgtgcttcaaggccacgatcgaggccagccgccgggcgctcctgatccgctccatcatcaacaccaccttcgtgatgtgcatcctgaccctcgccatctgcgtcgtgagcacgagcgccgtggagatggaggacctgccggccggcacctgggagcgcgaggaggacctgaccaacttctgccaccaggagtgccaggtcaccgagacggagtgcctctgcccctacgaggccctggtgctgcggaagcccctgtccctcgacagcatcgtgaagggcatgaagaacctgctgaactccaccagcctcgagacctccctgagcatcgaggcgccctggggcgccatcaacgtccagtccaccttcaagccgaccgtgagcacggccaacatcgccctgtcctggagctccgtggagcaccgcgggaacaagatcctcgtcaccgggcggagcgagtccatcatgaagctggaggagcgcaccggcgtgagctgggacctgggggtggaggacgcctccgagagcaagctcctgaccgtctccatcatggacctgagccagatgtacagccccgtgttcgagtacctctccggcgaccgccaggtggaggagtggcccaaggcgacgtgcaccggcgactgccccgagcggtgcgggtgcaccagctccacgtgcctgcacaaggagtggccgcacagccggaactggcgctgcaaccccacctggtgctggggcgtcgggaccggctgcacgtgctgcggcgtggacgtgaaggacctgttcaccgaccacatgttcatcaagtggaaggtcgagtacatcaagaccgaggccatcgtgtgcgtggagctcacctcccaggagcggcagtgcagcctgatcgaggccgggacccgcttcaacctgggccccgtcaccatcacgctctccgagccccggaacatccagcagaagctgccgcccgagatcatcaccctgcaccccaagatcgaggaggggttcttcgacctcatgcacgtgcagaaggtgctgagcgcctccaccgtctgcaagctgcagagctgcacccacggcatcccgggggacctccagatctaccacatcggcaacctgctgaagggcgaccgcgtgaacgggcacctcatccacaagatcgagccccacttcaacacgtcctggatgagctgggacggctgcgacctggactactactgcaacatgggggactggccctcctgcacctacaccggcgtgacccagcacaaccacgccgcgttcgtcaacctgctcaacatcgagacggactacaccaagaccttccacttccacagcaagcgggtgaccgcccacggggacacgccccagctggacctgaaggcccgcccgacctacggcgccggcgagatcaccgtgctcgtcgaggtgaccgacatggagctgcacacgaagaaggtggagatctccgggctgaagttcgcgagcctgacctgcaccggctgctacgcctgctccagcgggatctcctgcaaggtccggatccacgtggacgagcccgacgagctcaccgtgcacgtcaagagcagcgaccccgacgtggtggccgcctccacgagcctgatggcccgcaagctcgagttcggcaccgactccaccttcaaggcgttcagcgccatgcccaagacctccctgtgcttctacatcgtcgagcgggagtactgcaagagctgctccgaggacgacaccaagaagtgcgtggacacgaagctggagcagccgcagagcatcctcatcgagcacaaggggaccatcatcggcaagcagaacgacacgtgcaccgccaaggcctcctgctggctggagagcgtgaagtccttcttctacggcctgaagaacatgctcgggagcgtcttcggctccttcttcgtggggatcctgctgttcctcgcccccttcgtgctgctggtcctcttcttcatgttcggctggaagatcctgttctgcttcaagtgctgccgccggacccgcgggctgttcaagtaccgccacttcaaggacgacgaggagaccggctaccggcgcatcatcgagcggctcaacagcaagaagggcaagaaccgcctgctggacggggagcggctcgcggaccgcaagatcgccgagctgttctccaccaagacccacatcggc

SEQ ID NO: 12172 - RNA, 3495 nt, synthetic construct
  misc_feature 1..3495: note = derived and/or modified CDS sequence (opt1) from CCHVF(CCHVF Mamon)__KX013478.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgtccgacgcgtgcgacagctcctgcgaggtgatgatccccaaggggacgggcgacatcctcgtcgactgcagcggcgggcagcagcacttcctgaaggacaacctgatcgacctcggctgcccccacatcccgctgctggggaagatggccatctacatctgccggatgtccaaccacccccgcaccaccgtggccttcctcttctggttcagcttcggctacgtgatcacgtgcatcttctgcaaggccctgttctactccctgatcatcatcggcaccctcgggaagaagatcaagcagtaccgggagctgaagccccagacctgcaccatctgcgagaccgcccccgtcaacgcgatcgacgccgagatgcacgacctgaactgcagctacaacatctgcccgtactgcgcctcccgcctcacgagcgacggcctggcccggcacgtgccccagtgccccaagcgcaaggagaaggtggaggagaccgagctgtacctcaacctggagcggatcccctggatcgtccgcaagctgctccaggtgtccgagagcaccggggtggcgctgaagcggagctcctggctgatcgtcctcctggtgctgctcaccgtgagcctgtccccggtccagagcgcccccgtgggccacgggaagacgatcgagacctaccagacccgcgagggcttcacctccatctgcctgttcatgctcggcagcatcctgttcctggtgtcctgcctcgtcaaggggctggtggacagcgtgtccgacagcttcttccccggcctgtccgtctgcaagacgtgcagcatcgggtccatcaacggcttcgagatcgagagccacaagtgctactgctccctcttctgctgcccctactgccggcactgcagcgccgaccgcgagatccaccagctgcacctgtccatctgcaagaagcggaagaccgggagcaacgtgatgctcgccgtctgcaagcgcatgtgcttccgggccaccatcgaggcgtcccgccgcgccctgctgatccggagcatcatcaacaccacgttcgtgatctgcatcctcaccctgaccatctgcgtggtcagcacctccgccgtggagatggagaacctgccgagcggcacgtgggagcgcgaggaggacctcaccaacttctgccaccaggagtgccaggtgaccgagaccgagtgcctgtgcccctacgaggccctggtcctgcggaagcccctcttcctggactccatcgtgaagggcatgaagaacctgctcaacagcacgtccctggagaccagcctgtccatcgaggccccctggggcgcgatcaacgtgcagagcaccttcaagccgaccgtctccaccgccaacatcgccctcagctggtccagcgtggagcaccgcgggaacaagatcctggtgacggggcggtccgagagcatcatgaagctggaggagcgcaccggcgtctcctgggacctcggggtggaggacgccagcgagtccaagctgctgaccgtgagcatcatggacctcagccagatgtactcccccgtcttcgagtacctgagcggcgaccgccaggtggaggagtggcccaaggcgacctgcacgggcgactgccccgagcggtgcgggtgcacctccagcacgtgcctgcacaaggagtggccgcactcccggaactggcgctgcaaccccacctggtgctggggcgtggggaccggctgcacgtgctgcggcgtcgacgtgaaggacctcttcaccgaccacatgttcgtgaagtggaaggtcgagtacatcaagaccgaggccatcgtgtgcgtggagctgaccagccaggagcggcagtgctccctgatcgaggccgggacccgcttcaacctcggccccgtcaccatcaccctgagcgagccccggaacatccagcagaagctgccgcccgagatcatcacgctccaccccaaggtggaggaggggttcttcgacctgatgcacgtgcagaaggtcctgtccgccagcaccgtgtgcaagctccagtcctgcacccacggcatcccgggggacctccaggtgtaccacatcggcaacctgctcaagggcgaccgcgtcaacgggcacctgatccacaagatcgagccccacttcaacaccagctggatgtcctgggacggctgcgacctggactactactgcaacatgggggactggcccagctgcacgtacaccggcgtgacccagcacaaccacgccgccttcgtgaacctcctgaacatcgagaccgactacacgaagaccttccacttccactccaagcgggtcaccgcgcacggggacacgccccagctggacctcaaggcccgcccgacctacggcgccggcgagatcaccgtgctggtggaggtcgccgacatggagctgcacaccaagaaggtggagatcagcgggctcaagttcgcgtccctggcctgcaccggctgctacgcctgcagctccgggatcagctgcaaggtgcggatccacgtcgacgagcccgacgagctgacggtgcacgtcaagagctccgaccccgacgtggtggccgccagcacctccctcatggcgcgcaagctggagttcggcaccgacagcaccttcaaggccttctccgccatgcccaagacgagcctgtgcttctacatcgtggagcgggagtactgcaagtcctgcagcgaggaggacacccagaagtgcgtcgacaccaagctcgagcagccgcagtccatcctgatcgagcacaaggggaccatcatcggcaagcagaacgacacgtgcaccgccaagaccagctgctggctggagtccgtcaagagcttcttctacggcctcaagaacatgctggggtccgtgttcggcaacttcttcatcgggatcctgctgttcctggcccccttcgtgctgctcgtgctgttcttcatgttcggctggaagatcctgttctgcttcaagtgctgccgccgcacccgggggctcctgaagtaccgccacctgaaggacgacgaggagaccggctaccggcgcatcatcgagcggctcaacaacaagaagggcaagaaccgcctgctggacggggagcggctcgcggaccgcaagatcgccgagctgttcagcacgaagacccacatcggc

SEQ ID NO: 12173 - RNA, 3495 nt, synthetic construct
  misc_feature 1..3495: note = derived and/or modified CDS sequence (opt1) from CCHVF(CCHVF Min)__KX013481.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgcaccatcgggtccatcaacggcttcgagatcgagagccacaagtgctactgctccctgttctgctgcccctactgccggcactgcagcgccgaccgcgagatccaccagctgcacctctccatctgcaagaagcggaagaccgggagcaacgtcatgctggccgtgtgcaagcgcatgtgcttccgggccaccatcgaggcgtcccgccgcgccctgctcatccggagcatcatcaacacgaccttcgtcatctgcatcctgaccctgaccatctgcgtggtgtccacgagcgccgtcgagatggagaacctcccgagcggcacctgggagcgcgaggaggacctgaccaacttctgccaccaggagtgccaggtgaccgagacggagtgcctgtgcccctacgaggccctggtgctccggaagcccctgttcctggactccatcgtcaagggcaccaagaacctcctgaacagcacctccctggagaccagcctctccatcgaggccccctggggcgcgatcaacgtgcagagcaccttcaagccgacggtgtccaccgccaacatcgccctgagctggtccagcgtcgagcaccgcgggaacaagatcctggtgaccgggcggtccgagagcatcatgaagctcgaggagcgcaccggcgtgtcctgggacctgggggtcgaggacgccagcgagtccaagctgctcacggtgagcatcatggacctgtcccagatgtacagccccgtgttcgagtacctgagcggcgaccggcaggtcgaggagtggcccaaggcgacctgcaccggcgactgccccgagcgctgcgggtgcacctccagcacgtgcctccacaaggagtggccgcactcccggaactggcgctgcaaccccacctggtgctggggcgtggggaccggctgcacgtgctgcggcgtggacgtcaaggacctgttcaccgaccacatgttcgtgaagtggaaggtggagtacatcaagaccgaggccatcgtctgcgtggagctgaccagccaggagcggcagtgctccctcatcgaggccgggacccgcttcaacctgggccccgtgacgatcaccctgagcgagccccggaacatccagcagaagctcccgcccgagatcatcaccctgcaccccaaggtcgaggaggggttcttcgacctgatgcacgtgcagaaggtgctctccgccagcaccgtctgcaagctgcagtcctgcacgcacggcatcccgggggacctccaggtgtaccacatcggcaacctgctgaagggcgaccgcatcaacgggcacctgatccacaagatcgagccccacttcaacaccagctggatgtcctgggacggctgcgacctcgactactactgcaacatgggggactggcccagctgcacctacaccggcgtgacgcagcacaaccacgccgccttcgtcaacctgctgaacatcgagaccgactacaccaagaccttccacttccactccaagcgggtgacggcgcacggggacacgccccagctcgacctgaaggcccgcccgacctacggcgccggcgagatcaccgtgctggtcgaggtggccgacatggagctccacaccaagaaggtggagatcagcgggctgaagttcgcgtccctggcctgcaccggctgctacgcctgcagctccgggatcagctgcaaggtccggatccacgtggacgagcccgacgagctcaccgtgcacgtcaagtccagcgaccccgacgtggtggccgccagcacctccctgatggcgcgcaagctggagttcggcacggacagcaccttcaaggccttctccgccatgcccaagaccagcctctgcttctacatcgtcgagcgggagtactgcaagtcctgcagcgaggaggacacccagaagtgcgtggacaccaagctggagcagccgcagtccatcctgatcgagcacaaggggacgatcatcggcaagcagaacgacacgtgcaccgccaaggccagctgctggctcgagtccgtcaagagcttcttctacggcctgaagaacatgctggggtccgtgttcggcaacttcttcatcgggatcctcctgttcctggcgcccttcgtgctcctggtgctgttcttcatgttcggctggaagatcctcttctgcttcaagtgctgccgccgcacccgggggctgctgaagtaccgccacctcaaggacgacgaggagaccggctaccggcgcatcatcgagcggctgaacaacaagaagggcaagaaccgcctgctcgacggggagcggctggccgaccgcaagatcgccgagctgttcagcaccaagacccacatcggc

SEQ ID NO: 12174 - RNA, 3495 nt, synthetic construct
  misc_feature 1..3495: note = derived and/or modified CDS sequence (opt1) from CCHVF(CCHVF Nakiwogo)__KX013484.1__Gn-NSm-Gc
  source 1..3495: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgtgatcgacgccgagatgcacgagctgaactgcaactacaacatctgcccctactgcgcctcccggctcaccagcgacggcctggtgcgccacgtcacccagtgcccgaagcggaaggagaaggtggaggagacggagctgtacctcaacctggagcgcatcccctggctggtgcggcgcctcctgcaggtctccgagagcaccgggatggcgctgaagcggtcctgctggatgaccaccctcctgatcctgctcgtggtcagcctgtcccccgtgcagagcgcccccgtgggccaggagaaggccatcgaggtctaccaggtgcgcgagagctacacgtccatgtgcctgttcgtgctcgggagcgtcctgttcgccgtgtcctggctggtgaagggcctcatcgacggcatcgggaacagcttcttcccgggcctgtccgtctgcaagacctgcagcatcgggtccatcaacggcttcgagatcgagagccacaagtgctactgctccctgttctgctgcccctactgccgggcgtgcagctccgacaagatcacccaccgcatgcacctcaacatctgcaagcggcgcaaggtggggagcaacgtgatgctggccgtctgcaagcggatgtgcttcaaggccaccgtggaggcctccaacagcgccctgctcatccgctccatcatcaacagcacgttcgtgatctgcgtcctgatcctggtgatctgcgtggtctccaccagcgcggtggacatggagaacctccccgccggcatctgggagcgggaggaggacctgaccaacttctgccaccaggagtgccaggtgaccgagacggagtgcctgtgcccctacgaggccctgatcctccgcaagccgctgtacctggactccatcgccaagggcatgaagtccctcctgaacagcaccaacctggagaccagcctcagcatcgaggccccctggggcgcgatcaacgtccagtccaccttcaagcccacggtgagcgccgccaacatcgccctgtcctggagctccgtggagcaccgcgggaacaagatcctggtcagcgggcggtccgagagcatcatgaagctcgaggagcgcaccggcatctcctggagcctgggggtggaggacgcctccgagagcaagaccctgaccgtgtccgtcatggacctcagccagatgtactcccccgtgttcgagtacctgagcggcgaccgccaggtggaggagtggccgaaggcgacgtgcaccggcgactgccccgagcggtgcgggtgcaccagctccacgtgcctgcacaaggagtggccccacagccggaactggcgctgcaaccccacctggtgctggggcgtcgggaccggctgcacgtgctgcggcctcgacgtgcgggacctgttcaccgactacatgatggtgaagtggaaggtcgagtacgtgaagaccgaggccatcatgtgcgtggagctgacctcccaggagcgccagtgcagcctcatcgaggccgggacccggttcaacctgggcccggtcaccatcaccctgtccgagccccgcaacgtgcagcagcggctccccagcgagatcgtgacgctgcaccccaagatcgaggaggggttcttcgacctgatgcacgtccagaaggtgctgttctgcaagcactccctccaggccaccagctgcacccacggcgtgccgggggacctgcaggtctaccacgtgggcaacctcctgaagggcgacaaggtgaacgggcactccatccacaagatcgagagccacttcaacacctcctggatgagctgggacggctgcgacctggactacttctgcaacatgggggactggccctcctgcacgtacaccggcgtcacccagcacaaccgcgccgcgttcgtgaacatgctcaacatcgagaccgactacacgaagaccttccacttccacagcaagcgggtgaccgcccacggggacacgccccagctggacctgaaggcccgcccgacctacggcgccggcgaggtcaccgtgctcgtggaggtcgcggacctggagctgcacaccaagaagatcgaggtgtccgggctcaagttcgccagcctgacctgctccggctgctacgcctgcagctccgggatcagctgcaaggtccggatccacgtgaacgagcccgacgagttcacggtgcacgtcaagagcaacgaccccgacgtggtggccgccggctccagcctgatggcgcgcaagatcgagctcggggccgactccaccttcaaggccttcagctccatgcccaagaacagcctgtgcttctacatcgtcgagcgggactactgctccagctgcaccgacgacgacacccagaagtgcgtgaacacgaagctggagcacccgcagtccatcctcatcgagcacaagggcaccatcatcggcaagcagaacgacacgtgccccaccaagaccagctgctggctggagtccgtcaagagcttcttctacgggctgaagaacatgctcggcgggatcttcggcaacgtgttcctggggatcttcctgttcctcgcccccttcgccctgctgatcctcttcttcttcttcggctggcgcctgctgttctgcctcaagtgctgccggcgcacccgcggcctgctgaagtacaagcagctcaaggacgaggaggaggcggggtacaagaagatcatcgagcggctgaacgacaagaagggcaagtcccgcctgttcgacggggagcggctcgccgaccgcaagatcgccgagctgttcagcaccaagacccacatcggc

SEQ ID NO: 12175 - RNA, 3495 nt, synthetic construct
  misc_feature 1..3495: note = derived and/or modified CDS sequence (opt1) from CCHVF(CCHVF Saf)__KX013487.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcactacctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccacgggaagacgatcgagacctaccagacccgcgagggcttcaccagcatctgcctcttcatgctgggctccatcctgttcctcgtgagctgcctggtgaaggggctggtcgactccgtgagcgactccttcttccccggcctcagcgtgtgcaagacgtgctccatcgggagcatcaacggcttcgagatcgagtcccacaagtgctactgcagcctgttctgctgcccctactgccggcactgctccgccgaccgcgagatccaccagctgcacctcagcatctgcaagaagcggaagaccgggtccaacgtcatgctggccgtgtgcaagcgcatgtgcttccgggccaccatcgaggcgagccgccgcgccctgctcatccggtccatcatcaacaccacgttcgtcatctgcatcctgaccctgaccatctgcgtggtgagcaccagcgccgtcgagatggagaacctcccgtccggcacgtgggagcgcgaggaggacctgaccaacttctgccaccaggagtgccaggtgaccgagaccgagtgcctgtgcccctacgaggccctggtgctccggaagcccctgttcagcgactccatcgtcaagggcatgaagaacctgctcaacagcacgtccctggagaccagcctgtccatcgaggccccctggggcgcgatcaacgtgcagagcaccttcaagccgaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgccagcgagtccaagctgctgaccgtgagcatcatggacctcagccagatgtactcccccgtgttcgagtacctgagcggcgaccggcaggtcgaggagtggcccaaggcgacctgcacgggcgactgccccgagcgctgcgggtgcacctccagcacgtgcctgcacaaggagtggccgcactcccggaactggcgctgcaaccccacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcggcagtgctccctgatcgaggccgggacccgcttcaacctcggccccgtgaccatcaccctgagcgagccccggaacatccagcagaagctgccgcccgagatcatcacgctccaccccaaggtcgaggaggggttcttcgacctgatgcacgtgcagaaggtgctgtccgccagcaccgtctgcaagctccagtcctgcacccacggcatcccgggggacctccaggtgtaccacatcggcaacctgctcaagggcgaccgcgtgaacgggcacctgatccacaagatcgagccccacttcaacaccagctggatgtcctgggacggctgcgacctggactactactgcaacatgggggactggcccagctgcacgtacaccggcgtcacccagcacaaccacgccgccttcgtgaacctcctgaacatcgagaccgactacatgaagacgttccacttccactccaagcgggtgaccgcgcacggggacacgccccagctggacctcaaggcccgcccgacctacggcgccggcgagatcaccgtcctggtggaggtggccgacatggagctgcacaccaagaaggtcgagatcagcgggctcaagttcgtgtccctggcgtgcaccggctgctacgcctgcagctccgggatcagctgcaaggtgcggatccacgtcgacgagcccgacgagctgaccgtgcacgtcaagagctccgaccccgacgtggtggccgccagcacgtccctcatggcccgcaagctggagttcggcaccgacagcaccttcaaggcgttctccgccatgcccaagaccagcctgtgcttctacatcgtggagcgggagtactgcaagtcctgcagcgaggaggacacgcagaagtgcgtcgacaccaagctcgagcagccgcagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacttcttcatcgggatcctgctgttcctggcccccttcgtgctgctcgtgctgttcttcatgttcggctggaagatcctgttctgcttcaagtgctgccgccgcacccgggggctcctgaagtaccgccacctgaaggacgacgaggagaccggctaccggcgcatcatcgagcggctcaacaacaagaagggcaagaaccgcctgctggacggggagcggctcgcggaccgcaagatcgccgagctgttcagcaccaagacccacatcggc

SEQ ID NO: 12176 - RNA, 3495 nt, synthetic construct
  misc_feature 1..3495: note = derived and/or modified CDS sequence (opt1) from CCHVF(CCHVF Ast199)__KX056051.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgctgcagctggctgatcgtgctgctggtgctcctgacggtcagcctgtcccccgtgcagagcgccccggtgggccacgggaagaccatcgagacctaccagacccgggagggcttcacgaacatctgcctcttcatgctgggctccatcctgttcatcgtcagctgcctcgtgaaggggctggtggactccgtcagcgactccttcttccccggcctgagcgtgtgcaagacctgctccatcgggagcatcaacggcttcgagatcgagtcccacaagtgctactgcagcctcttctgctgcccctactgccgccactgctccgccgaccgggagatccaccagctgcacctggggatctgcaagaagcgcaagaccggcagcaacgtgatgctcgccgtctgcaagcggatgtgcttcaaggccaccatcgaggcgtcccgccgggccctgctgatccgcagcatcatcaacacgaccttcgtgatctgcatcctcaccctggccatctgcgtcgtgtccaccagcgccgtggagatggagaacctgcccgccggcacgtgggagcgcgaggaggacctcaccaacttctgccaccaggagtgccaggtcaccgagaccgagtgcctgtgcccgtacgaggcgctggtgctgcggaagcccctcttcctggactccatcgtgaaggggatgaagaacctgctcaacagcacgagcctggagacctccctgagcatcgaggccccctggggcgccatcaacgtccagtccaccttcaagcccaccgtgagcaccgccaacatcgccctctcctggagctccgtggagcaccgcgggaacaagatcctggtcacgggccggagcgagtccatcatgaagctggaggagcgcaccggggtgagctgggacctcggcgtggaggacgcgtccgagagcaagctgctgaccgtctccatcatggacctcagccagatgtactccccggtgttcgagtacctgagcggcgaccgccaggtggaggagtggcccaaggcgacctgcacgggggactgccccgagcggtgcggctgcacctccagcacgtgcctgcacaaggagtggccccacagccggaactggcgctgcaacccgacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgacctcccaggagcggcagtgcagcctgatcgaggccggcacccgcttcaacctcgggcccgtcaccatcaccctgtccgagccccggaacatccagcagaagctgcccccggagatcatcacgctccaccccaagatcgaggagggcttcttcgacctgatgcacgtgcagaaggtgctgagcgcctccaccgtctgcaagctccagagctgcacccacgggatccccggcgacctgcagatctaccacatcggcaacctgctcaagggggaccgcctgaacggccacctgatccacaagatcgagccgcacttcaacacctcctggatgagctgggacgggtgcgacctcgactactactgcaacatgggcgactggccctcctgcacgtacaccggggtgacccagcacaaccacgccgccttcgtgaacctgctgaacatcgagaccgactacacgaagaccttccacttccacagcaagcgggtcaccgcccacggcgacacgccccagctcgacctgaaggcccgccccacctacggcgcgggggagatcaccgtgctggtggaggtcgccgacatggagctccacaccaagaaggtggaggtgtccggcctgaagttcgccagcctggcctgcaccgggtgctacgcctgctccagcggcatctcctgcaaggtccggatccacgtggacgagccggacgagctcacggtgcacgtcaagagctccgaccccgacgtggtggcggccagcacctccctgatggcccgcaagctggagttcgggaccgacagcaccttcaaggccttcagcgccatgcccaagacgtccctctgcttctacatcgtcgagcgggagtactgcaagagctgctccgaggacgacaccaagaagtgcgtggacaccaagctggagcagccccagagcatcctgatcgagcacaagggcaccatcatcggcaagcagaacgacacgtgcaccgcgaaggcctcctgctggctcgagagcgtgaagtccttcttctacgggctgaagaacatgctgggcagcgtcttcgggaacttcttcgtgggcatcctcctgttcctggccccgttcgtgctcctggtcctgttcttcatcttcgggtggaagatcctcttctgcttcaagtgctgccgccggacccgcggcctgttcaagtaccgccacctgaaggacgacgaggagaccggctaccggaagatcatcgagcgcctcaactccaagaaggggaagaaccggctgctggacggcgagcgcctcgccgaccggaagatcgccgagctgttcagcaccaagacgcacatcggg

SEQ ID NO: 12177 - RNA, 3495 nt, synthetic construct
  misc_feature 1..3495: note = derived and/or modified CDS sequence (opt1) from CCHVF(CCHVF Ast149)__KX056054.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccacgggaagaccatcgagacctaccagacccgggagggcttcacgaacatctgcctcttcatgctgggcagcatcctgttcatcgtctcctgcctcgtgaaggggctggtggacagcgtctccgacagcttcttccccggcctgtccgtgtgcaagacctgcagcatcgggtccatcaacggcttcgagatcgagagccacaagtgctactgctccctcttctgctgcccctactgccgccactgcagcgccgaccgggagatccaccagctgcacctggggatctgcaagaagcgcaagaccggctccaacgtgatgctcgccgtctgcaagcggatgtgcttcaaggccaccatcgaggcgagccgccgggccctgcccatccgctccatcatcaacacgaccttcgtgatctgcatcctgaccctcgccatctgcgtcgtgagcacctccgccgtggagatggagaacctgccggccggcacgtgggagcgcgaggaggacctgaccaacttctgccaccaggagtgccaggtcaccgagaccgagtgcctctgcccctacgaggcgctggtgctgcggaagcccctgttcctcgacagcatcgtgaaggggatgaagaacctgctgaacagcacgtccctcgagaccagcctgtccatcgaggccccctggggcgccatcaacgtccagagcaccttcaagccgaccgtgtccaccgccaacatcgccctgagctggtccagcgtggagcaccgcgggaacaagatcctcgtcacgggccggtccgagagcatcatgaagctggaggagcgcaccggggtgtcctgggacctgggcgtggaggacgcgagcgagtccaagctcctgaccgtcagcatcatggacctgtcccagatgtacagccccgtgttcgagtacctctccggcgaccgccaggtggaggagtggcccaaggcgacctgcacgggggactgccccgagcggtgcggctgcaccagcagcacgtgcctgcacaaggagtggccgcactcccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctcaccagccaggagcggcagtgctccctgatcgaggccggcacccgcttcaacctggggcccgtcaccatcaccctcagcgagccccggaacatccagcagaagctgccgcccgagatcatcacgctgcaccccaagatcgaggagggcttcttcgacctcatgcacgtgcagaaggtgctgtccgccagcaccgtctgcaagctgcagtcctgcacccacgggatcccgggcgacctccagatctaccacatcggcaacctgctgaagggggaccgcctcaacggccacctgatccacaagatcgagccccacttcaacaccagctggatgtcctgggacgggtgcgacctggactactactgcaacatgggcgactggcccagctgcacgtacaccggggtgacccagcacaaccacgccgccttcgtgaacctcctgaacatcgagaccgactacacgaagaccttccacttccactccaagcgggtcaccgcccacggcgacacgccccagctggacctcaaggcccgcccgacctacggcgcgggggagatcaccgtgctggtggaggtcgccgacatggagctgcacaccaagaaggtggaggtgagcggcctcaagttcgcctccctggcctgcaccgggtgctacgcctgcagctccggcatcagctgcaaggtccggatccacgtggacgagcccgacgagctgacggtgcacgtcaagtccagcgaccccgacgtggtggcggcctccaccagcctcatggcccgcaagctggagttcgggaccgacagcaccttcaaggccttctccgccatgcccaagacgagcctgtgcttctacatcgtcgagcgggagtactgcaagtcctgcagcgaggacgacaccaagaagtgcgtggacaccaagctcgagcagccgcagtccatcctgatcgagcacaagggcaccatcatcggcaagcagaacgacacgtgcaccgcgaaggccagctgctggctggagtccgtcaagagcttcttctacgggctcaagaacatgctgggctccgtgttcgggaacttcttcgtgggcatcctcctgttcctggcccccttcgtgctgctcgccctgttcttcatcttcgggtggaagatcctgttctgcttcaagtgctgccgccggacccgcggcctcttcaagtaccgccacctgaaggacgacgaggagaccggctaccggaagatcatcgagcgcctgaacagcaagaaggggaagaaccggctcctggacggcgagcgcctggccgaccggaagatcgcggagctgttctccaccaagacgcacatcggg

SEQ ID NO: 12178 - RNA, 3495 nt, synthetic construct
  misc_feature 1..3495: note = derived and/or modified CDS sequence (opt1) from CCHVF(CCHVF Ast137)__KX056057.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatccacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctgatcgtgctgctggtgctcctgacggtctccctgagccccgtgcagtccgccccggtgggccacgggaagaccatcgagacctaccagacccgggagggcttcacgaacatctgcctcttcatgctgggcagcatcctgttcatcgtctcctacctcgtgaaggggctggtggacagcgtctccgacagcttcttccccggcctgtccgtgtgcaagacctgcagcatcgggtccatcaacggcttcgagatcgagagccacaagtgctactgctccctcttctgctgcccctactgccgccactgcagcgccgaccgggagatccaccagctgcacctggggatctgcaagaagcgcaagaccggctccaacgtgatgctcgccgtctgcaagcggatgtgcttcaaggccaccatcgaggcgagccgccgggccctgctgatccgctccatcatcaacacgaccttcgtgatctgcatcctcaccctggccatctgcgtcgtgagcacctccgccgtggagatggagaacctgcccgccggcacgtgggagcgcgaggaggacctcaccaacttctgccaccaggagtgccaggtcaccgagaccgagtgcctgtgcccgtacgaggcgctggtgctgcggaagcccctcttcctggacagcatcgtgaaggggacgaagaacctgctcaacagcacctccctggagaccagcctgtccatcgaggccccctggggcgccatcaacgtccagagcaccttcaagcccaccgtgtccacggccaacatcgccctcagctggtccagcgtggagcaccgcgggaacaagatcctggtcaccggccggtccgagagcatcatgaagctggaggagcgcaccggggtgtcctgggacctcggcgtggaggacgcgagcgagtccaagctgctgaccgtcagcatcatggacctctcccagatgtacagcccggtgttcgagtacctgtccggcgaccgccaggtggaggagtggcccaaggccacgtgcaccggggactgccccgagcggtgcggctgcaccagcagcacgtgcctgcacaaggagtggccccactcccggaactggcgctgcaacccgacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgaccagccaggagcggcagtgctccctgatcgaggccggcacccgcttcaacctcgggcccgtcaccatcacgctgagcgagccccggaacatccagcagaagctgcccccggagatcatcaccctccaccccaagatcgaggagggcttcttcgacctgatgcacgtgcagaaggtgctgtccgccagcaccgtctgcaagctccagtcctgcacccacgggatccccggcgacctgcagatctaccacatcggcaacctgctcaagggggaccgcctgaacggccacctgatccacaagatcgagccgcacttcaacacgagctggatgtcctgggacgggtgcgacctcgactactactgcaacatgggcgactggcccagctgcacctacaccggggtgacccagcacaaccacgcggccttcgtgaacctgctgaacatcgagacggactacaccaagaccttccacttccactccaagcgggtcaccgcccacggcgacacgccccagctcgacctgaaggcccgccccacctacggcgcgggggagatcaccgtgctggtggaggtcgccgacatggagctccacaccaagaaggtggaggtgagcggcctgaagttcgcctccctggcctgcacggggtgctacgcctgcagctccggcatcagctgcaaggtccggatccacgtggacgagccggacgagctcaccgtgcacgtcaagtccagcgaccccgacgtggtggcggcctccaccagcctgatggcccgcaagctggagttcgggaccgacagcacgttcaaggccttctccgccatgcccaagaccagcctctgcttctacatcgtcgagcgggagtactgcaagtcctgcagcgaggacgacaccaagaagtgcgtggacaccaagctggagcagccccagtccatcctgatcgagcacaagggcaccatcatcggcaagcagaacgacacgtgcaccgcgaaggccagctgctggctcgagtccgtcaagagcttcttctacgggctgaagaacatgctgggctccgtgttcgggaacttcttcgtgggcatcctcctgttcctggccccgttcgtgctcctggtcctgttcttcatcttcgggtggaagatcctcttctgcttcaagtgctgccgccggacccgcggcctgttcaagtaccgccacctgaaggacgacgaggagaccggctaccggaagatcatcgagcgcctcaacagcaagaaggggaagaaccggctgctggacggcgagcgcctcgccgaccggaagatcgccgagctgttctccacgaagacccacatcggg

SEQ ID NO: 12179 - RNA, 3495 nt, synthetic construct
  misc_feature 1..3495: note = derived and/or modified CDS sequence (opt1) from CCHVF(CCHVF Ast133)__KX056060.1__Gn-NSm-Gc
  source 1..3495: mol_type = other RNA
agcgaggagcccgacgacgactgcatctcccgcacccagctgctcaagaccgagacggccgagatccacgacgacaactacggcgggccgggcgacaagatcaccatctgcaacgggagcaccatcgtggaccagcggctgggctccgagctggggtgctacaccatcaaccgcgtcaagagcttcaagctctgcgagaactccgccacgggcaagacctgcgagatcgacagcacccccgtgaagtgccggcagggcttctgcctgaagatcacccaggaggggcgcggccacgtgaagctgtcccgggggagcgaggtcgtgctcgacgcgtgcgactccagctgcgagatcatgatccccaagggcacgggggacatcctggtggactgctccggcggccagcagcacttcctgaaggacaacctcatcgacctggggtgcccccacatcccgctgctcggcaagatggccatctacatctgccgcatgagcaaccacccccggaccaccatggccttcctgttctggttctccttcgggtacgtcatcacgtgcatcttctgcaaggccctgttctacctcctgatcatcatcggcaccctgggcaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacgggctcgcccgccacgtgacccagtgccccaagcggaaggagaaggtcgaggagaccgagctgtacctgaacctcgagcgcatcccctggatcgtgcggaagctgctccaggtgtccgagagcaccggcgtcgcgctcaagcgctccagctggctgatcgtgctgctcgtgctgctgacggtcagcctctcccccgtgcagagcgccccggtggggcacggcaagaccatcgagacctaccagacccgggaggggttcacgtccatctgcctgttcatgctgggcagcatcctcttcatcgtctcctgcctggtgaagggcctggtggacagcgtctccgacagcttcttccccgggctctccgtgtgcaagacctgcagcatcggctccatcaacgggttcgagatcgagagccacaagtgctactgctccctgttctgctgcccctactgccgccactgcagcgccgaccgggagatccaccagctgcacctctccatctgcaagaagcgcaagaccggcagcaacgtgatgctggccgtctgcaagcggatgtgcttcaaggccaccatcgaggcgtcccgccgggccctgctcatccgcagcatcatcaacacgaccttcgtgatgtgcatcctgaccctggccatctgcgtcgtgtccaccagcgccgtggagatggaggacctccccgccgggacgtgggagcgcgaggaggacctgaccaacttctgccaccaggagtgccaggtcaccgagaccgagtgcctgtgcccgtacgaggcgctggtgctccggaagcccctgttcagcgactccatcgtgaagggcatgaagaacctgctcaacagcacgtccctggagaccagcctgtccatcgaggccccctggggcgccatcaacgtccagagcaccttcaagcccaccgtgtccaccgccaacatcgccctcagctggtccagcgtggagcaccgcgggaacaagatcctggtcacgggccggtccgagagcatcatgaagctggaggagcgcaccggggtgtcctgggacctcggcgtggaggacgcgagcgagtccaagctgctgaccgtcagcatcatggacctctcccagatgtacagcccggtgttcgagtacctgagcggggaccgccaggtggaggagtggcccaaggcgacctgcacgggcgactgccccgagcggtgcggctgcacctccagcacgtgcctgcacaaggagtggccccactcccggaactggcgctgcaacccgacctggtgctggggcgtcgggaccgggtgcacgtgctgcggcgtggacgtgaaggacctcttcaccgaccacatgttcatcaagtggaaggtcgagtacatcaagaccgaggccatcgtgtgcgtggagctgaccagccaggagcggcagtgctccctgatcgaggccggcacccgcttcaacctcgggcccgtcaccatcaccctgagcgagccccggaacatccagcagaagctgcccccggagatcatcacgctccaccccaagatcgaggagggcttcttcgacctgatgcacgtgcagaaggtgctgtccgccagcaccgtctgcaagctccagtcctgcacccacgggatccccggcgacctgcagatctaccacatcgggaacctgctcaagggcgaccgcgtgaacggccacctgatccacaagatcgagccgcacttcaacaccagctggatgtcctgggacgggtgcgacctggactactactgcaacatgggcgactggcccagctgcacgtacaccggggtgacccagcacaaccacgccgccttcgtcaacctcctgaacatcgagaccgactacacgaagaccttccacttccactccaagcgggtgaccgcccacggcgacacgccccagctggacctcaaggcccgccccacctacggggcgggcgagatcaccgtgctggtcgaggtggccgacatggagctgcacaccaagaaggtggagatcagcggcctcaagttcgcctccctgacctgcacggggtgctacgcctgcagctccggcatcagctgcaaggtccggatccacgtggacgagccggacgagctgaccgtgcacgtcaagtccagcgaccccgacgtggtggccgcgagcacctccctcatggcccgcaagctggagttcgggaccgacagcacgttcaaggccttctccgccatgcccaagaccagcctgtgcttctacatcgtcgagcgggagtactgcaagtcctgcagcgaggacgacaccaagaagtgcgtggacaccaagctcgagcagccccagtccatcctgatcgagcacaagggcaccatcatcgggaagcagaacgacacgtgcaccgccaaggcgagctgctggctggagtccgtcaagagcttcttctacggcctcaagaacatgctgggctccgtgttcgggagcttcttcgtgggcatcctcctgttcctggccccgttcgtgctgctcgtcctgttcttcatgttcgggtggaagatcctgttctgcttcaagtgctgccgccggacccgcggcctcttcaagtaccgccacctgaaggacgacgaggagaccgggtaccggcgcatcatcgagcggctgaactccaagaagggcaagaaccgcctcctggacggcgagcggctggccgaccgcaagatcgccgagctgttcagctccaagacgcacatcggg

SEQ ID NO: 12180 - RNA, 3495 nt, synthetic construct
  misc_feature 1..3495: note = derived and/or modified CDS sequence (opt1) from CCHVF(CCHVF SK/2015/human)__KX458183.1__Gn-NSm-Gc
  source 1..3495: mol_type = other RNA
agcgaggagtccggcgacgactgcatcagccgcacccggctgctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacgggcaagagctgcgagatcgactccatcccggtgcggtgccgccaggggtactgcctcaagatcacccaggaggggcggggccacgtgaagctgagccgcgggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaccatctgcccctactgcgccagccgcctgacgtccgacgggctggcccggcacgtcacccagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtgctgttcacggtgtccctgagccccgtccagtccgcccccatcgggcacggcaagaccatcgagacctaccaggcccgcgaggagtacaccggcatctgcctgttcgtgctcgggagcatcctgttcatcgtgtcctgcctggtcaagggcctcgtggacggggtgggcaacatcttcttcccggggctgagcatctgcaagacgtgctccatcggcagcatcaacggcttcgagatcgagtcccacaagtgctactgcagcctgctctgctgcccctactgccggcactgctccgccgaccgcgagatccaccagctgcacctgagcatctgcaagaagcggaagaccgggtccaacgtcatgctcgccgtgtgcaagcgcatgtgcttccgcgcgaccatggaggtcagcaacaaggccctgctgatccggtccatcatcaacaccacgttcgtggtgtgcatcctcatcctggccgtctgcgtggtgagcacctccgccgtcgagatggagagcctgcccgccggcacctgggagcgcgaggaggacctcaccaacttctgccaccaggagtgccaggtgacggagaccgagtgcctgtgcccctacgaggcgctggtgctgcggcgccccctcttcctggacagcatcgtccgggggatgaagaacctgctcaactccaccagcctggagacctccctgagcatcgaggccccctggggcgccatcaacgtgcagtccacgtacaagcccaccgtgagcaccgccaacatcgccctctcctggagctccgtcgagcaccgcgggaacaagatcctggtgagcggccggtccgagagcatcatgaagctggaggagcgcaccggcgtgtcctgggacctcggggtcgaggacgcgagcgagtccaagctgctgaccgtgagcgtgatggacctctcccagatgtacagccccgtcttcgagtacctgagcggcgaccgccaggtggaggagtggccgaaggccacgtgcaccggggactgccccgagcggtgcggctgcaccacctccacgtgcctgcacaaggagtggccccacagccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgacctcccagggccggcagtgcagcctcatcgaggccgggacccgcttcaacctgggctccgtgacgatcaccctgagcgagccgcggaacatccagcacaagctcccgcccgagatcatcaccctgcacccccgcatcgaggagggcttcttcgacctgatgcacgtccagaaggtgctctccgccagcaccgtgtgcaagctgcagtcctgcacgcacggggtcccgggcgacctccaggtgtaccacatcgggaacctgctgaagggcgacaaggtgaacgggcacctgatccacaagatcgagccccacttcaacaccagctggatgtcctgggacggctgcgacctcgactactactgcaacatgggcgactggcccagctgcacctacaccggggtcacgcagcacaaccacgcgtccttcgtgaacctgctgaacatcgagaccgactacaccaagaacttccacttccacagcaagcgggtgaccgcccacggcgacacgccgcagctcgacctgaaggcccgccccacctacggggccggcgagatcaccgtcctggtggaggtggcggacatggagctccacaccaagaagatcgagatctccgggctgaagttcgccagcctgacgtgcaccggctgctacgcctgctccagcggcatctcctgcaaggtccggatccacgtggacgagcccgacgagctcaccgtgcacgtcaagagcgacgaccccgacgtggtggccgccagctccagcctgatggcgcgcaagctggagttcgggaccgactccacgttcaaggccttcagcgccatgccgaagacctccctctgcttctacatcgtcgagcgcgagtactgcaagagctgctccaaggaggacacccagaagtgcgtgaacaccaagctggagcagccccagagcatcctgatcgagcaccggggcacgatcatcgggaagcagaacaacacgtgcatcgccaaggcctcctgctggctcgagagcgtgaagtccttcttctacggcctgaagaacatgctgagcgggatcttcggcaacctcttcctgggcatcttcctgttcctcgcgcccttcatcctgctgatcctcttcttcatgttcgggtggcgcatcctgttctgcttcaagtgctgccggcgcacccggggcctgttcaagtaccgccacctcaaggacgacgaggagaccgggtaccggcgcatcatcgagcggctgaacaacaagaagggcaagaacaagctgctcgacggcgagcgcctggccgaccggcgcatcgccgagctgttctccaccaagacccacatcggg

SEQ ID NO: 12181 - RNA, 3495 nt, synthetic construct
  misc_feature 1..3495: note = derived and/or modified CDS sequence (opt1) from CCHVF(CCHVF YL16070)__KY354081.1__Gn-NSm-Gc
  source 1..3495: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggctccgagctgggctgctacaccatcaaccgcgtgaagagctacaagctgtgcgagaactccgcgagcgggaagtcctgcgagatcgacagcatcccggtcaagtgcaagcagggcttctgcctcaagatcacccaggaggggcggggccacgtgaagctgtcccgcgggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccggatgtccaaccacccgaagaccaccatggccttcctgttctggttcagcttcggctacgtgatcacgtgcatcgtgtgccgcgtcctgttctacctcctgatcgccatcgggaccgtgggcaagaagctgaagcagtaccgggagctcaagccccagacctgcatcgtgtgcgagtccgtccccgtgaacgccatcgacgcggagatgcacgagctgaactgcagctacaacatctgcccctactgcgcctcccgcctgagcaccgacgggctcatccggcacgtgacgcagtgcccgaagcgccgggagaaggtcgaggagaccgagctgttcctgaacctcgagcgcatcccctggctggtgcggaagctgctccaggtgagcgagtccaccggcatggccctgaagcgcagctgctggatgatcaccctgctcatcctgctgctcgtctccatgagccccgtgcagtccgcccccgtggggaaggagcgggcgatcgagacgtaccaggcccgcgaggcctacaccggcatctgcctgttcgtcctgggcagcgtgctcttcgccgtctcctggctgaccaaggccctgatcgacgggatcggcaacagcttcttcccggggctctccgtgtgcaagacctgcagcatcggctccatcaacgggttcgagatcgagagccacaagtgctactgctccctgttctgctgcccctactgccgggcgtgcagctccgacaagaacacgcaccgcatgcacctgaacgtgtgcaagaagcggaagatgggcagcaacgtcatgctcgccgtgtgcaagcgcatgtgcttccgggccaccatcgaggcctccaacaaggccctgctgatccgcagcatcatcaactccaccttcgtgatctgcatcctcatcctgaccatctgcgtcgtgagcacgagcgcggtggacatggagaacctgcccgccggcatctgggagaaggaggaggacctcaccaacttctgccaccaggagtgccaggtcaccgagaccgagtgcctgtgcccctacgaggccatggtgctgcgcaagccgctgttcctcgactccatcgccaaggggatgaagagcctgctgaactccacgagcctcgagacctccctgagcatcgaggccccctggggcgcgatcaacgtgcagtccaccttcaagcccaccgtcagcgccgccaacatcgccctgtcctggagctccgtggagcaccgggggaacaagatcctcgtgagcggccgctccgagagcatcatgaagctggaggagcggacgggggtctcctggaacctgggcgtggaggacgccagcgagtccaagaccctcaccgtgagcgtcatggacctgagccagatgtactcccccgtgttcgagtacctgagcggcgaccgccaggtggaggagtggccgaaggcgacctgcacgggggactgccccgagcggtgcggctgcacctccagcacctgcctccacaaggagtggccccactcccgcaactggcggtgcaaccccacctggtgctggggggtcggcaccggctgcacgtgctgcgggctggacgtgaaggacttcttcaccgactacatgctggtgaagtggaaggtcgagtacatcaagaccgaggccatcgtgtgcgtggagctcaccagccaggagcgccagtgctccctgatcgaggccggcacgcggttcaacctggggccggtcaccatcaccctcagcgagccccgcaacgtgcagcagcggctgccccccgagatcgtgaccctgcacccgaagatcgaggagggcttcttcgacctcatgcacgtccagaagatcctgtccgccagcacggtgtgcaagctgcagtcctgcacccacggggtgcccggcgacttccaggtctaccacgtgggcaacctcctgcgcggggacaaggtgaacggccacagcatccacaagatcgagccccacttcaacacctcctggatgagctgggacgggtgcgacctggactacttctgcaacatgggcgactggccgtcctgcacctacacgggggtcacccagcacaaccgggcggccttcatcaacatgctcaacatcgagaccgactacaccaagacgttccacttccacagcaagcgcgtgaccgcccacggcgacaccccccagctggacctgaaggcccggcccgcctacggcgcgggggaggtgaccgtcctcgtggaggtggccgacctggagctgcacacgaagaagctcgaggtctccggcctgaagatcgccagcctgacctgctccgggtgctacgcctgcagcagcggcatctcctgcaaggtgcgcatccacgtgaacgagcccgacgagttcaccgtccacgtgcggagctccgacccggacgtggtcgccgcggggagctccctcatggcccgcaagatcgagttcggcgccgacagcaccttcaaggccttctccagcatgcccaaggactccctgtgcttctacatcgtggagaaggactactgcagctcctgcacggacgacgacacccagaagtgcgtgaacaccaagctggaccacccccagagcatcctcatcgagcacaagggcaccatcatcgggaagcagaacgacacgtgctccaccaagaccagctgctggctgaagtccttcaagggcttcttctacgggctgaagaacatgctcagcggcatcttcgggaacgtcttcctgggcatcctgctcttcctggcccccttcgtgctgctcatcttcttcttcttcttcggctggcggctgctgttctgcctcaagtgctgcaagaagaccaaggggctgctgaagtacaagcacctcaaggacaaggaggaggcgggctacaagaagatcatcgagcgcctgaacgggaagaagggcaagtcccagctgttcgacggcgagcgcctcgccaaccggaagatcgccgagctgttcagcacgaagatccacatcggg

SEQ ID NO: 12182 - RNA, 3495 nt, synthetic construct
  misc_feature 1..3495: note = derived and/or modified CDS sequence (opt1) from CCHVF(CCHVF Oman_812956)__KY362518.1__Gn-NSm-Gc
  source 1..3495: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctcaagcggagcagctggctgatcgtgctgctcgtgctgctgaccgtctccctcagccccgtgcagtccgcccccatcggccacgggaagacgatcgagacctaccagacccgcgagggctacaccagcatctgcctgttcgtgctgggctccatcctcttcatcgtcagccacctgatgaaggggctggtggactccgtgggcaacagcttcttcccggggctctccatctgcaagacgtgcagcatcggctccatcaacgggttcgagatcgagagccacaagtgctactgctccctgttctgctgcccctactgccggcactgcagcgcggacaaggagatccacaagctgcacctctccatctgcaagaagcgcaaggccggcagcaacgtcatgctggccgtgtgcaagcggatgtgcttccgcgccaccatggaggtctccaacaaggccctgctcatccggagcgtgatcaacaccaccttcgtggtctgcatcctgatcctggcggtgtgcgtggtctccacgagcgccgtggagatggagagcctccccgccggcacctgggagcgcgaggaggacctgaccaacttctgccaccaggagtgccaggtgaccgagacggagtgcctgtgcccctacgaggccctggtcctccggaagccgctgttcttcgactccatcgccaaggggatgaagaacctgctcaacagcacctccctggagaccagcctgtccatcgaggcgccctggggcgccatcaacgtgcagagcaccttcaagcccacggtgtccaccgccaacatcgccctcagctggtccagcgtcgagcaccgcgggaacaagatcctggtgtccggccgcagcgagtccatcatgaagctggaggagcggaccgggatcagctgggacctcggcgtggaggacgcctccgagagcaagctgctgaccgtctccgtgatggacctcagccagatgtacagccccgtgttcgagtacctgtccggcgaccgccaggtcgaggagtggccgaaggcgacctgcacgggggactgccccgagcggtgcggctgcaccagctccacgtgcctgcacaaggagtggccccacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctcatcgaggccggcacccggttcaacctggggccggtgaccatcaccctgtccgagccccgcaacatccagcagaagctcccgcccgagatcgtgacgctgcacccccggatcgaggagggcttcttcgacctgatgcacgtccagaaggtgctcagcgcctccaccgtgtgcaagctgcagagctgcacccacggggtccccggcgacctccaggtgtaccacatcggcaacctgctgaagggggacaaggtgaacggccacctgatccacaaggtcgagccccacttcaacacctcctggatgagctgggacgggtgcgacctcgactactactgcaacatgggcgactggccgtcctgcacgtacaccggggtgacccagcacaaccacgccgcgttcgtgaacctgctgaacatcgagaccgactacacgaagaacttccacttccacagcaagcgcgtcaccgcccacggcgacacgccccagctcgacctgaaggcccggcccaactacggcgccggggagatcaccgtgctggtggaggtcgcggacatggagctccacaccaagaagatcgagatctccggcctgaagttcgccagcctgacctgcaccgggtgctacgcctgctccagcggcatctcctgcaaggtgcgcatccacgtggacgagcccgacgagctcaccgtccacgtcaagagcgaggacccggacatcgtggccgccagctccagcctgatggcgcggaagctggagttcgggacggactccaccttcaaggccttcagcgccatgcccaagacctccctctgcttctacatcgtggagcgcgagtactgcaagagctgctccaaggaggacacccagaagtgcgtgaacgccaagctggagcggccccagagcatcctgatcgagcacaagggcacgatcatcggcaagcagaacgacacgtgcaccgccaaggcgtcctgctggctcgagagcgtgaagtccttcttctacgggctgaagaacatgctgagcggcatcttcgggaacgtcttcatcggcatcttcctcttcctggcccccttcatcctgctcatcctgttcttcatgttcgggtggcgcatcctgttctgcttcaagtgctgccggcgcacccggggcctcttcaagtaccgccacctgaaggacgacgaggagaccggctaccgcaagatcatcgagcggctgaacaacaagaaggggaagaacaagctcctggacggcgagcgcctggccgaccggaagatcgccgagctgttctccaccaagacccacatcggg

SEQ ID NO: 12183 - RNA, 3495 nt, synthetic construct
  misc_feature 1..3495: note = derived and/or modified CDS sequence (opt1) from CCHVF(CCHVF UCCR4405)__KY484029.1__Gn-NSm-Gc
  source 1..3495: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaagtgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccacgggaagaccatcgagacctaccagacccgggagggcttcacgagcatctgcctcttcatgctgggctccatcctgttcatcgtgagctgcctcgtgaaggggctggtcgactccgtgagcgactccttcttccccggcctgagcgtgtgcaagacctgctccatcgggagcatcaacggcttcgagatcgagtcccacaagtgctactgcagcctcttctgctgcccctactgccgccactactccgccgaccgggagatccaccagctgcacctgagcatctgcaagaagcgcaagaccgggtccaacgtcatgctcgccgtgtgcaagcggatgtgcttcaaggccaccatcgaggcgagccgccgggccctgctgatccgctccatcatcaacacgaccttcgtcatctgcatcctcatcctggccatctgcgtggtgagcaccagcgccgtcgagatggagaacctgcccgccggcacctgggagcgcgaggaggacctcacgaacttctgccaccaggagtgccaggtgaccgagaccgagtgcctgtgcccgtacgaggcgctggtgctgcggaagcccctcttcctggactccaccgtcaagggcatgaagaacctgctcaacagcacgtccctggagaccagcctgtccatcgaggccccctggggcgccatcaacgtgcagagcaccttcaagcccaccgtgtccaccgccaacatcgccctcagctggtccagcgtcgagcaccgcgggaacaagatcctggtgacggggcggtccgagagcatcatgaagctggaggagcgcaccggcgtgtcctgggacctcggggtcgaggacgcgagcgagtccaagctgctgaccgtgagcatcatggacctctcccagatgtacagcccggtgttcgagtacctgagcggcgaccggcaggtcgaggagtggcccaaggcgacctgcacgggcgactgccccgagcgctgcgggtgcacctccagcacgtgcctgcacaaggagtggccccactcccggaactggcgctgcaacccgacctggtgctggggcgtggggaccggctgcacgtgctgcggcgtggacgtcaaggacctcttcaccgaccacatgttcgtgaagtggaaggtggagtacatcaagaccgaggccatcgtctgcgtggagctgaccagccaggagcggcagtgctccctgatcgaggccgggacccgcttcaacctcggccccgtgaccatcaccctgagcgagccccggaacatccagcagaagctgcccccggagatcatcacgctccaccccaagatcgaggaggggttcttcgacctgatgcacgtccagaaggtgctgtccgccagcaccgtgtgcaagctccagtcctgcacccacggcatccccggggacctgcagatctaccacatcggcaacctgctcaagggcgaccgcgtcaacgggcacctgatccacaagatcgagccgcacttcaacaccagctggatgtcctgggacggctgcgacctggactactactgcaacatggggaactggcccagctgcacgtacaccggcgtgacccagcacaaccacgccgccttcgtgaacctcctgaacatcgagaccgactacacgaagaccttccacttccactccaagcgggtcaccgcccacggggacacgccccagctggacctcaaggcccgccccacctacggcgcgggcgagatcaccgtgctggtggaggtcgccgacatggagctgcacaccaagaaggtggagatcagcgggctcaagttcgcctccctggtgtgcaccggctgctacgcctgcagctccgggatcagctgcaaggtccggatccacgtggacgagccggacgagctgacggtgcacgtcaagtccagcgaccccgacgtggtggccgcgagcacctccctcatggcccgcaagctggagttcggcaccgacagcatcttcaaggccttctccgccatgcccaagaccagcctgtgcttctacatcgtcgagcgggagtactgcaagtcctgcagcgaggacgacacgaagaagtgcgtggacaccaagctcgagcagccccagtccatcctgatcgagcacaaggggaccatcatcggcaagcagaacgacacgtgcaccgccaaggcgagctgctggctggagtccgtcaagagcttcttctacggcctcaagaacatgctggggtccgtgttcggcaacttcttcgtggggatcctcctcttcctggccccgttcgtgctgctcgtcctgttcttcatgttcggctggaagatcctgttctgcttcaagtgctgccgccggacccgcggcctcttcaagtaccgccacctgaaggacgacgaggagaccgggtaccggcgcatcatcgagcggctgaacagcaagaagggcaagaaccgcctcctggacggggagcggctggccgaccgcaagatcgccgagctgttctccaccaagacccacatcggc

SEQ ID NO: 12184 - RNA, 3495 nt, synthetic construct
  misc_feature 1..3495: note = derived and/or modified CDS sequence (opt1) from CCHVF(CCHVF UCCR4459)__KY484032.1__Gn-NSm-Gc
  source 1..3495: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacgtgcatcctgtgcaaggtcatcttctacctgctcatcgtggtgggcaccctggggaagaagttcaagcagtaccgcgagctgaagccccagacctgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctccaggtgagcgagtccaccggggtcgccctgaagcgcagctcctggctcgtggtgctgctggtcctcctgaccgtgagcctgtcccccgtgcagagcgcccccatcggccacgggaagacggtcgagacctaccagacccgggagggctacacctccatctgcctcttcgtgctgggcagcatcctgttcatcgtgtcctgcctcatgaaggggctggtcgacagcgtgggcaactccttcttcccggggctgagcatctgcaagacgtgctccatcggcagcatcaacgggttcgagatcgagtcccacaagtgctactgcagcctcttctgctgcccctactgccgccactgctccgcggaccgggagatccacaagctgcacctgagcatctgcaagaagcgcaagaccggctccaacgtcatgctcgccgtgtgcaagcggatgtgcttccgcgccaccgtggaggtcagcaacaaggccctgctgatccggaacatcatcaacaccacgttcgtggtgtgcatcctcatcctggccgtctgcgtggtgagcacctccgcggtcgagatggagagcctgcccgccggcacctgggagcgcgaggaggacctcaccaacttctgccaccaggagtgccaggtgacggagaccgagtgcctgtgcccctacgaggccctggtgctgcgcaagcccctcttctccgacagcatcgtcaaggggatgaagaacctgctgaactccaccagcctcgagacctccctgagcatcgaggccccctggggcgccatcaacgtgcagtccacgttcaagcccaccgtgagcgcggccaacatcgccctgtcctggagctccgtcgagcaccgggggaacaagatcctcgtgagcggccgctccgagagcatcatgaagctggaggagcggaccgggatctcctgggacctgggcgtggaggacgccagcgagagcaagctcctgaccgtctccatcatggacctgagccagatgtactcccccgtgttcgagtacctcagcggcgaccgccaggtggaggagtggccgaaggcgacctgcacgggggactgccccgagcggtgcggctgcacctccagcacgtgcctgcacaaggagtggccccactcccgcaactggcggtgcaaccccacctggtgctggggcgtcgggaccggctgcacgtgctgcgggctggacgtgaaggacctcttcaccgactacatgttcgtgaagtggaaggtcgagtacatcaagaccgaggccatcgtgtgcgtggagctgaccagccaggagcgccagtgctccctgatcgaggccggcacccggttcaacctcgggccggtcaccatcaccctgagcgagccccgcaacatccagcagaagctgccgcccgagatcgtgacgctccacccgcggatcgaggagggcttcttcgacctgatgcacgtgaagaaggtcctgtccgccagcaccgtgtgcaagctccagtcctgcacccacggggtgcccggcgacctgcaggtctaccacatcggcaacctgctcaagggggacaaggtgaacggccacctgatccacaagatcgagccccacttcaacaccagctggatgtcctgggacgggtgcgacctggactactactgcaacatgggcgactggccgagctgctcctacacgggggtgacccagcacaaccacgccgccttcgtcaacatgctcaacatcgagaccgactacaccaagatcttccacttccacagcaagcgcgtgacggcgcacggcgacacgccccagctggacctgaaggcccggcccacctacggcgccggggagatcaccgtgctcgtcgaggtggccgacatggagctgcacaccaagaagatcgagatctccggcctgaagttcgcgagcctgacctgcaccgggtgctacgcctgcagctccggcatcagctgcaaggtgcgcatccacgtcgacgagcccgacgagctgaccgtgcacgtgaagtccgaggacccggacatcgtcgccgccagctccagcctgatggcccggaagctcgagttcgggacggactccaccttcaaggcgttcagcgccatgcccaagacctccctgtgcttctacatcgtggagcgcgagtactgcaagagctgctccaaggaggacacccagaagtgcgtgaacacgaagctggagcagccccagagcatcctcatcgagcacaagggcaccatcatcggcaagcagaacgacacgtgcacctccaaggccgggtgctggctggagagcgtcaagtccttcttctacggcctgaagaacatgctcagcgggatcttcggcaacgtgttcatcgggatcttcctgttcctggcccccttcatcctcctgatcctgttcttcatgttcggctggcggatcctcttctgcttcaagtgctgccgccggacccgcggcctgttcaagtaccgccacctgaaggacgacgaggagaccgggtaccggaagatcatcgagcgcctcaacaacaagaagggcaagaacaagctgctggacggggagcggctcgccgaccgcaagatcgcggagctgttctccaccaagacccacatcggc

SEQ ID NO: 12185 - RNA, 3495 nt, synthetic construct
  misc_feature 1..3495: note = derived and/or modified CDS sequence (opt1) from CCHVF(CCHVF UCCR4401)__KY484035.1__Gn-NSm-Gc
  source 1..3495: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtccgctccttcaagctctgcgagaacagcgccacgggcaagaactgcgagatcgactccgtgcccgtgaagtgccggcaggggtactgcctgcgcatcacccaggagggccgggggcacgtcaagctgagccgcggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtgggcaccctggggaagcgcctcaagcagtaccgggagctgaagccccagacctgcaccatctgcgagaccacccccgtcaacgccatcgacgcggagatgcacgacctgaactgcagctacaacatctgcccgtactgcgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgagagcaccggggtcgccctgaagcggtccagctggctgatcgtgctcctggtgctgttcaccgtcagcctctcccccgtgcagagcgcgccgatcggccaggggaagacgatcgaggcctaccgcgcccgggagggctacacctccatctgcctgttcgtgctgggcagcatcctcttcatcgtctcctgcctgatgaaggggctggtggacagcgtgggcaactccttcttccccgggctcagcatctgcaagacctgctccatcagctccatcaacggcttcgagatcgagagccacaagtgctactgctccctgttctgctgcccctactgccgccactgcagcaccgacaaggagatccacaagctgcacctctccatctgcaagaagcggaagacggggagcaacgtcatgctggccgtgtgcaagctgatgtgcttccgcgccaccatggaggtctccaaccgcgcgctgttcatccggagcatcatcaacaccaccttcgtgctgtgcatcctgatcctcgccgtgtgcgtcgtgtccacgagcgccgtggagatggagaacctgcccgccggcacctgggagcgcgaggaggacctgaccaacttctgccaccaggagtgccaggtcaccgagacggagtgcctgtgcccgtacgaggccctcgtgctgcggaagcccctgttcctcgacagcaccgcgaagggcatgaagaacctgctgaactccaccagcctcgagacctccctgagcatcgaggccccctggggcgccatcaacgtgcagtccacgtacaagcccaccgtcagcaccgccaacatcgccctgtcctggagctccgtggagcaccgcgggaacaagatcctcgtgagcgggcggtccgagagcatcatgaagctggaggagcgcaccggcatctcctgggacctgggggtcgaggacgcgagcgagtccaagctcctgaccgtgagcgtgatggacctgtcccagatgtacagcccggtcttcgagtacctcagcggcgaccgccaggtggaggagtggcccaaggccacgtgcaccggcgactgccccgagcggtgcgggtgcacctccagcacgtgcctgcacaaggagtggccccactcccggaactggcgctgcaacccgacctggtgctggggcgtggggaccggctgcacgtgctgcggcctggacgtcaaggacctcttcaccgactacatgttcgtgaagtggaaggtggagtacatcaagaccgaggccatcgtctgcgtggagctgaccagccaggagcggcagtgctccctgatcgaggccgggacccgcttcaacctcggccccgtgaccatcacgctgagcgagccccggaacatccagcagaagctgcccccggagatcatcaccctccacccccgcatcgaggaggggttcttcgacctgatgcacgtccagaaggtgctgtccgccagcaccgtgtgcaagctccagtcctgcacccacggcgtccccggggacctccaggtgtaccacatcggcaacctgctcaagggcgacaaggtgaacgggcacctgatccacaagatcgagccgcacttcaacacgagctggatgtcctgggacggctgcgacctggactactactgcaacatgggggactggcccagctgcacctacaccggcgtcacccagcacaaccacgcgtccttcgtgaacctcctgaacatcgagacggactacaccaagaacttccacttccacagcaagcgggtgaccgcccacggggacacgccccagctggacctcaaggcccgccccacctacggcgccggcgagatcaccgtcctggtggaggtggcggacatggagctgcacaccaagaagatcgagatctccgggctcaagttcgccagcctggcctgcaccggctgctacgcctgctccagcgggatctcctgcaaggtccggatccacgtggacgagccggacgagctgacggtgcacgtcaagagcgacgaccccgacgtggtggccgcgagctccagcctcatggcccgcaagctggagttcggcaccgactccaccttcaaggccttcagcgccatgcccaagacctccctgtgcttctacatcgtcgagcgggagcactgcaagagctgctccgaggaggacacgaagaagtgcgtgaacaccaagctcgagcagccccagagcatcctgatcgagcacaaggggaccatcatcggcaagcagaactccacgtgcaccgccaaggcgagctgctggctggagtccgtcaagagcttcttctacggcctcaagaacatgctgtccgggatcttcggcaacgtgttcatggggatcttcctgttcctcgccccgttcatcctgctgatcctcttcttcatgttcggctggcgcatcctgttctgcttcaagtgctgccgccggacccgcgggctgttcaagtaccggcacctcaaggacgacgaggagaccggctaccgccggatcatcgagaagctgaacaacaagaagggcaagaacaagctgctcgacggggagcgcctggccgaccggcgcatcgccgagctgttcagcaccaagacccacatcggc

SEQ ID NO: 12186 - RNA, 3495 nt, synthetic construct
  misc_feature 1..3495: note = derived and/or modified CDS sequence (opt1) from CCHVF(CCHVF UCCR4448)__KY484042.1__Gn-NSm-Gc
  source 1..3495: mol_type = other RNA
agcgaggagacctccgacgactgcatcagccgcacccagctgctccggacggagaccgccgagatccacggcgacaactacgggggccccggggacaagatcaccatctgcaacggctccaccatcgtggaccagcgcctggggagcgagctgggctgctacacgatcaaccgggtgaagtccttcaagctctgcgagaacagcgccaccggcaagtcctgcgagatcgacagcgtgccggtgaagtgccgccaggggtactgcctgcggatcacccaggagggccgcgggcacgtcaagctgtcccggggcagcgaggtggtgctcgacgcgtgcgacacctcctgcgagatcatgatccccaaggggacgggcgacatcctggtcgactgcagcggcgggcagcagcacttcctgaaggacaacctcatcgacctgggctgccccaagatccccctgctcgggaagatggccatctacatctgccgcatgtccaaccacccgaagaccaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacgcccgtgaacgccatcgacgcggagatgcacgacctgaactgctcctacaacatctgcccctactgcgccagccggctgacctccgacggcctcgcccgccacgtcacccagtgcccgaagcggaaggagaaggtggaggagaccgagctgtacctgaacctcgagcgcatcccctgggtggtccggaagctgctccaggtgagcgagtccacgggggtggccctcaagcgcagcagctggctgatcgtcctgctcgtgctgttcaccatctccctgagccccgtgcagtccgcgcccatcagccacggcaagaccatcgaggcctaccgggcccgcgaggggtacacctccatctgcctcttcgtcctgggcagcatcctgttcatcgtgtcctacctcatgaagggcctggtggacagcgtcgggaactccttcttcccgggcctgagcatctgcaagacgtgctccaccagctccatcaacgggttcgagatcgagagccacaagtgctactgctccctcttctgctgcccctactgccggcactgcagcgccgacaaggagatccacaagctgcacctgtccatctgcaagaagcgcaagaccggcagcaacgtgatgctcgccgtgtgcaagcggatgtgcttccgcgcgaccatggaggtctccaaccgcgccctgttcatccggagcatcatcaacacgaccttcgtgctgtgcatcctcatcctggccgtctgcgtggtgagcacctccgccgtcgagatggagaacctgcccgccgggacctgggagcgcgaggaggacctcacgaacttctgccaccaggagtgccaggtgaccgagaccgagtgcctgtgcccctacgaggcgctggtgctgcggaagcccctcttcctggacagcatcgtcaagggcatgaagaacctgctcaactccaccagcctggagacgtccctgagcatcgaggccccctggggcgccatcaacgtgcagtccacctacaagcccaccgtgagcaccgccaacatcgccctctcctggagctccgtcgagcaccgcgggaacaagatcctggtgagcggccggtccgagagcatcatgaagctggaggagaagaccgggatctcctgggacctcggcgtggaggacgcgagcgagtccaagctgctgacggtcagcgtgatggacctcagccagatgtactcccccgtgttcgagtacctgagcggggaccgccaggtcgaggagtggccgaaggcgacctgcaccggcgactgccccgagcggtgcggctgcacctccagcacgtgcctgcacaaggagtggccccactcccgcaactggcggtgcaaccccacctggtgctggggcgtggggaccgggtgcacgtgctgcggcctcgacgtgaaggacctgttcaccgactacatgttcgtcaagtggaaggtggagtacatcaagaccgaggccatcgtgtgcgtcgagctgaccagccaggagcgccagtgctccctcatcgaggccggcacccggttcaacctggggccggtgacgatcaccctgagcgagccccgcaacatccagcagaagctcccgcccgagatcatcaccctgcacccgcggatcgaggagggcttcttcgacctgatgcacgtgcagaaggtcctctccgccagcaccgtgtgcaagctgcagtcctgcacgcacggggtgcccggcgacctgcaggtctaccacatcgggaacctcctgaagggcgacaaggtgaacggccacctgatccacaagatcgagccccacttcaacaccagctggatgtcctgggacgggtgcgacctcgactactactgcaacatgggcgactggccgagctgcacctacaccggggtgacgcagcacaaccacgcctccttcgtcaacctgctgaacatcgagaccgactacaccaagaacttccacttccacagcaagcgcgtgaccgcccacggcgacacgccccagctcgacctgaaggcccggcccacctacggggccggcgagatcaccgtgctggtcgaggtggcggacatggagctccacaccaagaagatcgagatctccggcctgaagttcgccagcctgacgtgcaccgggtgctacgcctgctccagcggcatcagctgcaaggtgcgcatccacgtcgacgagcccgacgagctcaccgtgcacgtgaagtccgacgacccggacgtcgtggccgccagctccagcctgatggcgcggaagctggagttcgggaccgactccacgttcaaggccttcagcgccatgcccaagacctccctctgcttctacatcgtggagcgcgagcactgcaagagctgctccgaggaggacaccaagaagtgcgtcaacaccaagctggagcagccccagagcatcctgatcgagcacaagggcacgatcatcgggaagcagaactccacgtgcaccgccaaggccagctgctggctcgagtccgtcaagagcttcttctacggcctgaagaacatgctgtccggcatcttcgggaacgtgttcatcggcatcttcctcttcctggcgcccttcatcctgctcatcctgttcttcatgttcgggtggaagatcctgttctgcttcaagtgctgccggcgcacccgcggcctcttcaagtaccggcacctgaaggacgacgaggagaccgggtaccgccggatcatcgagcgcctgaacaacaagaagggcaagaacaagctcctggacggcgagatcctggccgaccggcgcatcgccgagctgttcagcaccaagacccacatcggg

SEQ ID NO: 12187 - RNA, 3495 nt, synthetic construct; identical to SEQ ID NO: 12103
  misc_feature 1..3495: note = derived and/or modified CDS sequence (opt1) from CCHVF(CCHVF SPU4/81 )__DQ157175.1__Gn-NSm-Gc
  source 1..3495: mol_type = other RNA

SEQ ID NO: 12188 - RNA, 3495 nt, synthetic construct; identical to SEQ ID NO: 12124
  misc_feature 1..3495: note = derived and/or modified CDS sequence (opt1) from CCHVF(CCHVF Sudan Al-Fulah 9-2008)__HQ378185.1__Gn-NSm-Gc
  source 1..3495: mol_type = other RNA

SEQ ID NO: 12189 - RNA, 3495 nt, synthetic construct; identical to SEQ ID NO: 12118
  misc_feature 1..3495: note = derived and/or modified CDS sequence (opt1) from CCHVF(CCHVF NIV161064)__KY213713.1__Gn-NSm-Gc
  source 1..3495: mol_type = other RNA

SEQ ID NO: 12190 - RNA, 3495 nt, synthetic construct; identical to SEQ ID NO: 12140
  misc_feature 1..3495: note = derived and/or modified CDS sequence (opt1) from CCHVF(CCHVF 5180-R-2011)__KR814874.1__Gn-NSm-Gc
  source 1..3495: mol_type = other RNA

SEQ ID NO: 12191 - RNA, 3495 nt, synthetic construct; identical to SEQ ID NO: 12148
  misc_feature 1..3495: note = derived and/or modified CDS sequence (opt1) from CCHVF(CCHVF 4574-ST-2008)__KR814870.1__Gn-NSm-Gc
  source 1..3495: mol_type = other RNA

SEQ ID NO: 12192 - RNA, 3495 nt, synthetic construct; identical to SEQ ID NO: 12100
  misc_feature 1..3495: note = derived and/or modified CDS sequence (opt1) from CCHVF(CCHVF 3010)__DQ019222.1__Gn-NSm-Gc
  source 1..3495: mol_type = other RNA

SEQ ID NO: 12193 - RNA, 3495 nt, synthetic construct; identical to SEQ ID NO: 12100
  misc_feature 1..3495: note = derived and/or modified CDS sequence (opt1) from CCHVF(CCHVF UG3010)__DQ211637.1__Gn-NSm-Gc
  source 1..3495: mol_type = other RNA

SEQ ID NO: 12194 - RNA, 2916 nt, synthetic construct
  misc_feature 1..2916: note = derived and/or modified CDS sequence (opt1) from CCHFV(10200, Artificial)__U39455.2__Gn-4aa-Gc
  source 1..2916: mol_type = other RNA
agcgaggagccctccgacgactgcgtgagccgcacccagctcctccggaccgagacggccgagatccacggcgacaactacgggggcccgggggacaagatcaccatctgcaacggctccaccatcgtggaccagcgcctggggagcgagctgggctgctacaccatcaaccgggtgcgctccttcaagctctgcgagaacagcgccacgggcaagaactgcgagatcgactccgtgcccgtcaagtgccggcaggggtactgcctgcgcatcacccaggagggccgggggcacgtgaagctgagccgcggctccgaggtggtcctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtcggcaccctggggcgccggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggccggaagcccctgttcctggactccacggccaaggggatgaagaacctcctgaacagcacctccctggagaccagcctctccatcgaggccccctggggcgccatcaacgtccagagcacctacaagcccacggtgtccaccgccaacatcgcgctgagctggtccagcgtggagcaccgcggcaacaagatcctggtctccgggcggagcgagtccatcatgaagctcgaggagcgcaccggcatcagctgggacctgggggtggaggacgcctccgagagcaagctgctcaccgtctccgtgatggacctgagccagatgtacagcccggtgttcgagtacctgtccggcgaccgccaggtcgaggagtggcccaaggccacgtgcaccggggactgccccgagcggtgcggctgcaccagctccacgtgcctccacaaggagtggccccacagccgcaactggcggtgcaacccgacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctgacctcccaggagcgccagtgcagcctcatcgaggccggcacccggttcaacctggggcccgtgaccatcaccctgtccgagccccgcaacatccagcagaagctgcccccggagatcatcacgctccacccccggatcgaggagggcttcttcgacctgatgcacgtgcagaaggtcctcagcgcgtccaccgtgtgcaagctgcagagctgcacccacggcgtgcccggggacctgcaggtctaccacatcggcaacctcctgaagggggacaaggtgaacggccacctgatccacaagatcgagccccacttcaacacctcctggatgagctgggacggctgcgacctcgactactactgcaacatgggggactggccgtcctgcacgtacaccggcgtgacccagcacaaccacgccagcttcgtcaacctgctgaacatcgagaccgactacacgaagaacttccacttccactccaagcgcgtgaccgcccacggggacacgccccagctcgacctgaaggcccggcccacctacggcgccggggagatcaccgtgctggtcgaggtggcggacatggagctccacaccaagaagatcgagatcagcggcctgaagttcgcctccctggcctgcaccggctgctacgcctgcagcagctccatcagctgcaaggtgcgcatccacgtcgacgagccggacgagctcaccgtgcacgtgaagtccgacgaccccgacgtcgtggccgcgagctccagcctgatggcccggaagctggagttcgggacggactccaccttcaaggccttcagcgccatgcccaagacctccctctgcttctacatcgtggagcgcgagcactgcaagagctgctccgaggaggacaccaagaagtgcgtcaacacgaagctggagcagccccagagcatcctgatcgagcacaagggcaccatcatcgggaagcagaactccacgtgcaccgcgaaggccagctgctggctcgagtccgtcaagagcttcttctacggcctgaagaacatgctgtccgggatcttcggcaacgtgttcatgggcatcttcctcttcctggccccgttcatcctgctcatcctgttcttcatgttcgggtggcggatcctgttctgcttcaagtgctgccgccggacccgcggcctcttcaagtaccggcacctgaaggacgacgaggagaccgggtaccgccggatcatcgagaagctgaacaacaagaagggcaagaacaagctcctggacggggagcgcctggccgacggccgcatcgccgagctgttcagcaccaagacccacatcggc

SEQ ID NO: 12195 - RNA, 2916 nt, synthetic construct
  misc_feature 1..2916: note = derived and/or modified CDS sequence (opt1) from CCHFV(IbAr10200, Artificial)__AF467768.2__Gn-4aa-Gc
  source 1..2916: mol_type = other RNA
agcgaggagccctccgacgactgcatcagccgcacccagctcctccggaccgagacggccgagatccacggcgacaactacgggggcccgggggacaagatcaccatctgcaacggctccaccatcgtggaccagcgcctggggagcgagctgggctgctacaccatcaaccgggtccgctccttcaagctctgcgagaacagcgccacgggcaagaactgcgagatcgactccgtgcccgtgaagtgccggcaggggtactgcctgcgcatcacccaggagggccgggggcacgtcaagctgagccgcggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtgggcaccctggggaagcgcctcaagcagtaccgggagctgaagccccagacctgcaccatctgcgagaccacccccgtcaacgccatcgacgcggagatgcacgacctgaactgcagctacaacatctgcccgtactgcgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgagagcaccggggtcgccctgaagcggtccagctggctgatcgtgctcctggtgctgttcaccgtcagcctctcccccgtgcagagcgcgccgatcggccgcaagcccctgttcctggactccacggccaaggggatgaagaacctcctgaacagcacctccctggagaccagcctctccatcgaggccccctggggcgccatcaacgtgcagagcacctacaagcccacggtctccaccgccaacatcgcgctgagctggtccagcgtggagcaccggggcaacaagatcctggtgtccgggcgcagcgagtccatcatgaagctcgaggagcggaccggcatcagctgggacctgggggtcgaggacgcctccgagagcaagctgctcaccgtgtccgtcatggacctgagccagatgtacagcccggtgttcgagtacctgtccggcgaccgccaggtgggggagtggcccaaggccacgtgcaccggcgactgccccgagcgctgcggctgcaccagctccacgtgcctccacaaggagtggccccacagccggaactggcgctgcaacccgacctggtgctggggcgtcgggaccgggtgcacgtgctgcggcctggacgtgaaggacctgttcaccgactacatgttcgtgaagtggaaggtcgagtacatcaagaccgaggccatcgtgtgcgtggagctgacctcccaggagcggcagtgcagcctcatcgaggccgggacccgcttcaacctgggccccgtcaccatcaccctgtccgagccccggaacatccagcagaagctgcccccggagatcatcacgctgcacccccgcatcgaggagggcttcttcgacctgatgcacgtgcagaaggtgctcagcgcgtccaccgtctgcaagctgcagagctgcacccacggggtgcccggcgacctccaggtgtaccacatcgggaacctcctgaagggcgacaaggtcaacggccacctgatccacaagatcgagccccacttcaacacctcctggatgagctgggacgggtgcgacctcgactactactgcaacatgggcgactggccgtcctgcacgtacaccggggtgacccagcacaaccacgccagcttcgtgaacctgctgaacatcgagaccgactacacgaagaacttccacttccactccaagcgggtcaccgcccacggcgacacgccccagctcgacctgaaggcccgccccacctacggggccggcgagatcaccgtgctggtggaggtcgcggacatggagctccacaccaagaagatcgagatcagcggcctgaagttcgcctccctggcctgcaccgggtgctacgcctgcagcagcggcatctcctgcaaggtgcggatccacgtggacgagccggacgagctcaccgtccacgtcaagagcgacgaccccgacgtggtggccgcgtccagctccctgatggcccgcaagctggagttcgggacggacagcaccttcaaggccttctccgccatgcccaagaccagcctctgcttctacatcgtggagcgggagcactgcaagtcctgcagcgaggaggacaccaagaagtgcgtgaacacgaagctggagcagccccagtccatcctgatcgagcacaagggcaccatcatcgggaagcagaacagcacgtgcaccgcgaaggcctcctgctggctcgagagcgtcaagtccttcttctacggcctgaagaacatgctgagcggcatcttcgggaacgtgttcatgggcatcttcctcttcctggccccgttcatcctgctcatcctgttcttcatgttcgggtggcgcatcctgttctgcttcaagtgctgccggcgcacccggggcctcttcaagtaccgccacctgaaggacgacgaggagaccgggtaccggcgcatcatcgagaagctgaacaacaagaagggcaagaacaagctcctggacggcgagcggctggccgaccgccgcatcgccgagctgttctccaccaagacccacatcggg

SEQ ID NO: 12196 - RNA, 2916 nt, synthetic construct
  misc_feature 1..2916: note = derived and/or modified CDS sequence (opt1) from CCHFV(Turkey-Kelkit06, Artificial)__GQ337054.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcaagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggcggatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtcaacgcgatcgacgccgagatgcacgacctcaactgctcctacaacatctgcccgtactgcgccagccggctgacgtccgacggcctggcccgccacgtgacccagtgccccaagcggaaggagaaggtggaggagaccgagctctacctgaacctggagcgcatcccctggatcgtccggaagctcctccaggtgagcgagtccaccggggtggcgctgaagcgcagcagctggctcatcgtcctgctggtgctcctgacggtgtccctgagccccgtccagtccgccccggtgggccggaagcccctcttcctggacagcatcgtgaaggggatgaagaacctgctcaactccaccagcctggagacctccctgagcatcgaggccccctggggcgccatcaacgtccagtccaccttcaagcccacggtgagcaccgccaacatcgcgctctcctggagctccgtggtccaccgcggcaacaagatcctggtgaccgggcggagcgagtccatcatgaagctggaggagcgcaccggcgtcagctgggacctcggggtggaggacgcctccgagagcaagctgctgacggtgtccatcatggacctcagccagatgtacagcccggtcttcgagtacctgtccggcgaccgccaggtggaggagtggcccaaggcgacctgcaccggggactgccccgagcggtgcggctgcaccagctccacgtgcctgcacaaggagtggagccactcccgcaactggcggtgcaaccccacctggtgctggggcgtggggaccggctgcacgtgctgcggggtcgacgtgaaggacctcttcaccgaccacatgttcgtgaagtggaaggtcgagtacatcaagaccgaggccatcgtgtgcgtggccctgaccagccaggagcgccagtgctccctgatcgaggccggcacccggttcaacctggggccggtcaccatcacgctcagcgagccccgcaacatccagcagaagctgccgcccgagatcatcaccctgcaccccaagatcgaggagggcttcttcgacctcatgcacgtgcagaaggtgctgtccgccagcaccgtctgcaagctgcagtcctgcacccacggcatccccggggacctccaggtgtaccacatcggcaacctgctgaagggggaccgggtgaacggccacctcatccacaagatcgagagccacttcaacacgtcctggatgagctgggacggctgcgacctggactactactgcaacatgggggactggccctcctgcacctacaccggcgtcacccagcacaaccacgccgccttcgtgaacctgctcaacatcgagacggactacaccaagaccttccacttccacagcaagcgcgtgaccgcccacggggacacgccccagctggacctgaaggcgcggccgacctacggcgccgggggcatcaccgtcctcgtggaggtggccgacatggagctgcacaccaagaaggtcgagatctccggcctgaagttcgccagcctcgcctgcacggggtgctacgcgtgcagctccggcatcagctgcaaggtgcgcatccacgtggacgagcccgacgagctgaccgtccacgtgaagtccagcgaccccgacgtggtcgccgcctccaccagcctgatggcccggaagctcgagttcgggaccgactccacgttcaaggcgttcagcgccatgccgaagacctccctgtgcttctacatcgtggagcgcgagtactgcaagagctgctccgaggacgacacccagaagtgcgtggacacccggctggagcagccccagagcatcctcatcgagcacaagggcacgatcatcgggaagcagaacgacacgtgcaccgccaaggcctcctgctggctggagagcgtcaagtccttcttctacggcctgaagaacatgctcggcagcgtgttcgggaacctgttcatcggcatcctcctgttcctggcccccttcgtgctgctcgtcctgttcttcatgttcgggtggaagatcctgttctgcttcaagtgctgccgccggacccgcggcctcttcaagtaccggcacctgaaggacgacgaggagaccgggtaccgccggatcatcgagcgcctgaactccaagaagggcaagaaccggctcctggacggcgaccgcctggcggaccgcaagatcgccgagctgttcagcaccaagacccacatcggg

SEQ ID NO: 12197 - RNA, 2919 nt, synthetic construct
  misc_feature 1..2919: note = derived and/or modified CDS sequence (opt1) from CCHFV(SR3, Artificial)__AJ538199.1__Gn-4aa-Gc
  source 1..2919: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggctccggcgcccgctgttcctggactccatcgtgaagggcatgaagaacctcctgaacagcacctccctggagaccagcctctccatcgaggccccctggggcgcgatcaacgtccagagcacctacaagcccacggtgtccaccgccaacatcgccctgagctggtccagcgtcgagcaccgggggaacaaggtgctggtgtccggccgcagcgagtccatcatgaagctcgaggagcggaccgggatcagctgggacctgggcgtcgaggacgcctccgagagcaagctgctcaccgtgagcgtgatggacctgtcccagatgtacagccccgtcttcgagtacctgtccggggaccgccaggtggaggagtggccgaaggccacgtgcaccggcgactgccccgagcgctgcggctgcaccagctccacgtgcctccacaaggagtggccccacagccggaactggcgctgcaaccccacctggtgctggggcgtggggaccgggtgcacgtgctgcggcctggacgtcaaggacctgttcaccgactacatgttcgtgaagtggaaggtggagtacatcaagaccgaggcgatcgtctgcgtggagctgacctcccaggagcggcagtgcagcctcatcgaggccgggacccgcttcaacctgggctccgtgaccatcaccctgagcgagccgcggaacatccagcagaagctcccgcccgagatcatcacgctgcaccccaagatcgaggagggcttcttcgacctgatgcacgtccagaaggtgctctccgccagcaccgtgtgcaagctgcagtcctgcacccacggggtccccggcgacctccaggtgtaccacatcgggaacctgctgaagggcgaccgcgtgaacggccacctgatccacaagatcgagcagcacttcaacaccagctggatgtcctgggacgggtgcgacctcgactactactgcaacatgggcgactggcccagctgcacgtacaccggggtcacccagcacaaccacgcctccttcgtgaacctgctgaacatcgagaccgactacacgaagaccttccacttccacagcaagcgggtgaccgcccacggcgacacgccccagctcgacctgaaggcgcgccccacctacggggccggcgagatcaccgtcctggtggaggtggccgacatggagctccacaccaagaagatcgagatcagcggcctgaagttcgccgggctgacctgcacgggctgctacgcctgctccagcgggatctcctgcaaggtccggatccacgtggacgagccggacgagctcaccgtgcacgtcaagagcgacgaccccgacgtggtggcggcctccagctccctgatggcccgcaagctggagttcggcaccgacagcaccttcaaggccttctccgccatgcccaagacgagcctctgcttctacatcgtcgagcgggagtactgcaagtcctgcaacaaggaggacacccagaagtgcgtgaacaccaagctggagcagccgcagagcatcctgatcgagcacaaggggaccatcatcggcaagcagaacaacacgtgcaccgcgaaggcctcctgctggctcgagagcgtgaagtccttcttctacggcctgaagaacatgctcgggggcatcttcgggaacgtcttcatcggcatcttcaccttcctgacccccttcatcctgctgatcctcttcttcatgttcgggtggcgcatcctgttctgcttcaagtgctgccggcgcacgcggggcctgttcaagtaccgccacctcaaggacgacgaggagaccggctaccggaagatcatcgagcgcctgaacaacaagaaggggaagaaccggctgctcgacggcgagcgcctggccgaccgcaagatcgccgagctgttcagcaccaagacccacatcggg

SEQ ID NO: 12198 - RNA, 2919 nt, synthetic construct
  misc_feature 1..2919: note = derived and/or modified CDS sequence (opt1) from CCHFV(UCCR4413, Artificial)__KY484038.1__Gn-4aa-Gc
  source 1..2919: mol_type = other RNA
agcgagtccagcgcctccggctgcatcagccgcacccagatgatcaagtccgagaccgccgagatccacgacgacatctacgggggccccggggagaagctgacgatctgcaacggcaccaccgtggtcgaccagcggctcgggagcgagctgggctgctacaccatcaaccgcatcaagacgtacaagctgtgcgagaactccgtgaaggagaagacctgcgagatcgacagcgtgccggtcaagtgccggcagggcctctgcctgaagatcacccaggaggggcgcggccacgtgaagctgtcccgggggagcgagatcgtgctcgacatctgcgactccagctgcgagctgatgatccccaagggcaccggggacatcctggtcgactgctccggcggccagcagcacttcctccaggacaacctggtggacctggggtgccccaacatccccctcctgggcaaggtggcgatctacatctgccgcatgagcaaccacccgaagacgaccatggccttcctgttctggttctccttcgggtacgtcatcacctgcatcctctgcaagatcctgttctacctgctcatcatcaccggcacgctgggcaagaagctgaagcagtaccgggagctcaagccccagacctgcaccatctgcgagagcacccccgtgaacgccatcgacgccgagatgcacgacctgaactgctcctacaacatctgcccctactgcgccagccgcctgacgtccgacgggctcatccggcacgtgaacctgtgcccgaagcgcaaggagaaggtcgaggagaccgagctgtacctcaacctggagcggatcccctggttcgtgcgcaagctgctccaggtgagcgagagcaccggcgtcgcgctgaagcggtccagctggctgctcatcctggtgatcctgctcaccgtgtccatgagccccgtccagtccgcccccatcaaccgcaagccgctgttcctgagctccatcgtgaaggggaagaagaacctcctgaacagcgcctccctggagacgagcctctccatcgaggccccctggggcgcgatcaacgcccagagcaccttcaagcccaccatctccaccgccaacatcgccctgagctggtccagcgtggagcaccgggggaacaaggtcctggtgtccggccgcagcgagtccatcatgaagctcgaggagcggacgggcatcagctggaacctgggggtggaggacgccagcgagtcccgcatgctgaccgtcagcgtgatggacctctcccagatgtacctgcccgtcttcgagtacctgagcggcgaccggcaggtggaggagtggccgaaggcgacctgcaccggggactgccccgagcgctgcggctgcacgtccagcacctgcctgcacaaggagtggccccactcccggaactggcgctgcaaccccacctggtgctggggggtgggcaccggctgcacgtgctgcgggctcgacgtcaaggacctgttcaccgactacatgttcgtgaagtggaaggtggagtacatcaagaccgaggccatcgtctgcgtggagctgaccagccaggagcgccagtgctccctcatcgaggccggcacgcggttcaacctggggccggtgaccatcaccctgagcgagccccgcaacatccagcagaagctcccctccgagatcgtcaccctgcaccccaagatcgaggagggcttcttcgacctgatgcacgtgcagaaggtgctcagcgcctccaccgtctgcaagctgcagagctgcacgcacggggtggccggcgacctgcaggtgtaccacgtcggcaacctcctgaagggggacaagatcaacggccactccatccacaagatcgagccgcacctgaacaccagctggatgtcctgggacgggtgcgacctcgactactactgcaacatgggcgactggcccagctgcacctacaccggcgtgacgcagcacaaccacgcggccttcgtgaacctgctgaacatcgagaccgactacaccaagagcttccacttccactccaagcgggtcaccgcccacggggacacgccccagctcgacctgaaggcccgccccatgtacggcgccggggagatcaccgtgctggtggaggtcgcggacatggagctccacagcaagaacatcgagatctccggcctgaagttcgccagcctgacctgctccgggtgctacgcctgcagctccggcatcagctgcaaggtgcggatccacgtggacgagccggacgagctcgccgtccacgtgaagtccgacgacctggacgtggtcgccgcgagctccagcctgatggcccgcaagatcgagttcggcaccgactccacgttcaaggccttcagctccatgcccaaggagagcctctgcttctacatcgtggagcgggacttctgcaagtcctgcgccgcggaggacacccagaagtgcgtgaaggccaagctggagcagccccagagcatcctgatcgagcacaaggggaccatcatcggcaagcagaacgacacctgctccacgaagaccagctgctggctcgagagcttcaagtccttcttctacgggctgaagaacatgctgagcggcgtcttcgggtccgccatcatgggcatcctcctgttcctggccccgttcatcctcctgatcctgttcttcttcttcggctggcgcatcctcttctgcctgcggtgctgccgccggacccgcgggctgttcaagtacaagcacatcaaggacgacgaggaggccggctacaagaagatcatcgagaagctcaacaacaagaaggggggcaccagcaagctgctggacggggagcggctcgcggaccgcaagatcgccgagctgttctccacgaaggcccacatcggc

SEQ ID NO: 12199 - RNA, 2916 nt, synthetic construct
  misc_feature 1..2916: note = derived and/or modified CDS sequence (opt1) from CCHFV(66019, Artificial)__AB069669.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtcgaccagcgcctgggcagcgagctgggctgctacaccatcaaccgggtgaagtccttcaagctctgcgagaacagcgggacgggcaagtcctgcaagatcgacaacaccccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagacgaccatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccacgaacgccatcgacgccgagatgcacgacctcaagtgctcctacaacatctgcccctactgcgccagccggctgacctccgacggcctggcgcgccacgtgacccagtgcccgaagcggaaggagaaggtcgaggagaccgagctctacctgaacctggagcgcatcccctggatcgtgcggaagctcctccaggtgagcgagtccacgggggtcgccctgaagcgcagcagctggctcatcgtgctgctggtgctcctgaccgtctccctgagccccgtgcagtccgcccccatcggccggaagcccctcttcagcgactccatcgtgaagggcatgaagaacctgctgaacagcacctccctcgagaccagcctgtccatcgaggccccctggggcgcgatcaacgtccagagcacgttcaagcccaccgtgtccaccgccaacatcgccctgagctggtccagcgtggagcaccgcgggaacaagatcctcgtctccgggcggagcgagtccatcatgaagctggaggagcgcaccggcatcagctgggacctgggggtggaggacgcctccgagagcaagctcctgacggtcagcgtgatggacctgtcccagatgtacagccccgtgttcgagtacctctccggcgaccggcaggtcgaggagtggccgaaggcgacctgcaccggcaactgccccgaccgctgcgggtgcaccagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaactcccaggagcgccagtgcagcctgatcgaggccggcacccggttcaacctgggcccggtgaccatcaccctctccgagccccgcaacatccagcagaagctgcccagcgagatcatcacgctgcacccccggatcgaggaggggttcttcgacctcatgcacgtgcagaaggtcctgtccgccagcaccgtgtgcaagctgcagtcctgcacccacggcgtgccgggggacctccagatctaccacatcggcaacctgctgaagggcgaccgcgtcaacgggcacctcatccacaagatcgagccccacttcaacaccagctggatgtcctgggacggctgcgacctggactactactgcaacatgggggactggcccagctgcacgtacaccggcgtgacccagcacaaccacgccgccttcgtgaacctgctcaacatcgagaccgactacacgaagaacttccacttccactccaagcgggtcaccgcgcacggggacaccccgcagctggacctgaaggcccgcccgacctacggcgccggcgagatcacggtgctcgtggaggtcgccgacatggagctgcacaccaagaagatcgccatcagcgggctgaagttcgcgagcctgacctgcaccggctgctacgcctgctccagcgggatctcctgcaaggtgcggatccacgtggacgagcccgacgagctgacggtccacgtcaagagcgaggaccccgacatcgtggccgcctccagctccctgatggcccgcaagctcgagttcggcaccgacagcaccttcaaggcgttctccgccatgccgaagaccagcctgtgcttctacatcgtggagcgggagtactgcgagtcctgcagcaaggaggacacgcagaagtgcgtgaacaccaagctggagcagccccagtccatcctcatcgagcacaaggggaccatcatcggcaagcagaacgacacgtgcaccgccaaggccagctgctggctggagtccgtcaagagcttcttctacggcctgaagaacatgctctccgggatcttcggcaacgtgttcatcgggatcttcctgttcctggcgcccttcatcctcctgatcctgttcttcatgttcggctggcgcatcctcttctgcttcaagtgctgccggcgcacccgggggctgttcaagtaccgctacctgaaggacgacgaggagagcggctaccggcgcatcatcgagcggctcaacaacaagaagggcaagaacaagctgctggacggggagcgcctcgccgaccggcgcatcgccgagctgttctccaccaagacccacatcggc

SEQ ID NO: 12200 - RNA, 2916 nt, synthetic construct
  misc_feature 1..2916: note = derived and/or modified CDS sequence (opt1) from CCHFV(7001, Artificial)__AB069670.1__Gn-4aa-Gc
  source 1..2916: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggctccgagctgggctgctacaccatcaaccgcgtgcggagctacaagctgtgcgagaactccgcgagcgggaagtcctgcgagatcgacagcatcccggtcaagtgcaagcagggcttctgcctcaagatcacccaggaggggcgcggccacgtgaagctgtcccgggggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccgcatgtccaaccacccgaagaccaccatggccttcctgttctggttcagcttcggctacgtgatcacgtgcatcgcctgccgggtgctgttctacctcctgatcgccatcgggaccgtcggcaagaagctgaagcagtaccgcgagctcaagccccagacctgcatcgtgtgcgagtccgtgcccgtcaacgcgatcgacgccgagatgcacgagctgaactgcagctacaacatctgcccctactgcgcctcccggctgagcaccgacgggctcatccgccacgtgacgcagtgcccgaagcggcgcgagaaggtggaggagaccgagctgttcctgaacctcgagcggatcccctggctggtccgcaagctgctccaggtgagcgagtccaccggcatggccctgaagcggagctgctggatgatcaccctgctcatcctgctgctcgtgtccatcagccccgtccagtccgcgcccgtggggcgcaagccgctgttcctggacaacatcgccaagggcatgaagtccctcctgaacagcacgagcctggagacctccctcagcatcgaggccccctggggcgccatcaacgtgcagtccaccttcaagcccaccgtcagcgccgcgaacatcgccctgtcctggagctccgtggagcaccgggggaacaagatcctggtcagcggccgctccgagagcatcatgaagctcgaggagcggacgggggtgtcctggaacctgggcgtggaggacgccagcgagagcaagaccctgaccgtctccgtgatggacctcagccagatgtactcccccgtgttcgagtacctgagcggggaccgccaggtcgaggagtggccgaaggcgacctgcacgggcgactgccccgagcggtgcggctgcacctccagcacgtgcctgcacaaggagtggccccactcccgcaactggcgctgcaaccccacctggtgctggggcgtggggaccgggtgcacgtgctgcggcctcgacgtgaaggacttcttcaccgactacatgctggtcaagtggaaggtggagtacatcaagaccgaggccatcgtgtgcgtcgagctgaccagccaggagcggcagtgctccctgatcgaggccgggacccgcttcaacctcggcccggtgaccatcaccctgagcgagccccggaacgtgcagcagcgcctgccgcccgagatcgtcacgctccaccccaagatcgaggagggcttcttcgacctgatgcacgtgcagaagatcctgtccgccagcaccgtgtgcaagctccagtcctgcacccacggggtccccggcgacttccaggtgtaccacgtggggaacctgctgcggggcgacaaggtcaacggccacagcatccacaagatcgagccccacttcaacacctcctggatgagctgggacgggtgcgacctcgactacttctgcaacatgggcgactggccctcctgcacctacacgggggtgacccagcacaaccgcgccgccttcatcaacatgctgaacatcgagaccgactacaccaagacgttccacttccacagcaagcgggtgaccgcccacggcgacaccccgcagctggacctcaaggcgcgccccgcctacggggccggcgaggtcaccgtgctggtggaggtcgccgacctggagctccacacgaagaagctggaggtgagcggcctgaagatcgcctccctgacctgcagcgggtgctacgcgtgctccagcggcatctcctgcaaggtgcggatccacgtcaacgagcccgacgagttcaccgtgcacgtgcgcagctccgacccggacgtcgtggccgccgggagctccctcatggcccggaagatcgagttcggcgcggacagcaccttcaaggccttctccagcatgcccaaggactccctgtgcttctacatcgtggagaaggactactgcagctcctgcacggacgacgacacccagaagtgcgtcaacaccaagctcgaccacccccagagcatcctgatcgagcacaaggggaccatcatcggcaagcagaacgacacgtgctccaccaagaccagctgctggctggagtccgtgaagggcttcttctacgggctcaagaacatgctgagcggcatcttcgggaacgtgttcctgggcatcttcctcttcctggcccccttcgtcctgctcatcttcttcttcttcttcgggtggcgcctgctgttctgcctcaagtgctgccggcgcacccggggcctgctgaagtacaagcacctcaaggacgaggaggaggccggctacaagaagatcatcgagcgcctgaacgggaagaagggcaagagccagctgttcgacggggagcggctcgccgaccgcaagatcgcggagctgttctccacgaagatccacatcggc

SEQ ID NO: 12201 - RNA, 2916 nt, synthetic construct
  misc_feature 1..2916: note = derived and/or modified CDS sequence (opt1) from CCHFV(75024, Artificial)__AB069671.1__Gn-4aa-Gc
  source 1..2916: mol_type = other RNA
agcgaggagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagatgggctgctacaccatcaaccgggtcaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcgtgctggacgcgtgcgactccagctgcgaggtgatgatccccaagggcaccggcgacatcctcgtcgactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaacatctgcccctactgcgccagccgcctgacctccgacgggctggcccggcacgtcacgcagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtgctgttcgccatctccctgagccccgtgcagtccgcccccatcgggcgccggccgctgttcctcgacagcatcgtccgcggcatgaagaaccagctgaactccaccagcctggagacgtccctcagcatcgaggccccctggggcgccatcaacgtgcagtccacctacaagcccaccgtgagcaccgcgaacatcgccctgtcctggagctccgtcgagcaccgggggaacaagatcctggtgagcggccgctccgagagcatcatgaagctcgaggagcggacggggatctcctgggacctgggcgtggaggacgccagcgagagcaagctgctcaccgtctccgtgatggacctgagccagatgtactcccccgtcttcgagtacctgagcggggaccgccaggtggaggagtggccgaaggcgacctgcaccggcgactgccccgagcgctgcggctgcacgacctccacgtgcctccacaaggagtggccccacagccggaactggcgctgcaaccccacctggtgctggggcgtggggaccgggtgcacgtgctgcggcctggacgtcaaggacctgttcaccgactacatgatcgtgaagtggaaggtggagtacatcaagaccgaggccatcgtctgcgtggagctcacctcccaggagcggcagtgcagcctgatcgaggccgggacccgcttcaacctgggctccgtgaccatcaccctgagcgagccgcggaacatccagcagaagctcccgcccgagatcatcaccctgcacccccgcatcgaggagggcttcttcgacctgatgcacgtccagaaggtgctctccgccagcacggtgtgcaagctgcagtcctgcacccacggggtccccggcgacctccaggtgtaccacgtggggaacctgctgaagggcgacaaggtcaacggccacctgatccacaagatcgagccccacctcaacaccagctggatgtcctgggacgggtgcgacctggactactactgcaacatgggcgactggcccagctgcacctacacgggggtgacccagcacaaccacgcctccttcgtgaacctgctcaacatcgagaccgactacaccaagagcttccacttccacagcaagcgggtcacggcccacggcgacacgccccagctggacctgaaggcccgcccgacctacggggcgggcgagatcaccgtgctcgtggaggtcgccgacatggagttcacccccaagaagatcgagatctccggcctgaagttcgccagcctgacctgcaccgggtgctacgcctgctccagcggcatctcctgcaaggtgcggatccacgtggacgagcccgacgagctcaccgtccacgtcaagagcgacgacccggacgtggtggccgcgtccagctccctgatggcccgcaagctggagttcgggacggacagcaccttcaaggccttctccgccatgcccaagaccagcctctgcttctacatcgtggagcgggagtactgcaagtcctgcagcaaggaggacacccagaagtgcgtgaacacgaagctggagcagccccagtccatcctgatcgagcacaagggcaccatcatcgggaagcagaacaacacgtgcaccgcgaaggccagctgctggctcgagtccgtcaagagcttcttctacggcctgaagaacatgctgtccggcatcttcgggaacctcttcatgggcatcttcctgttcctggcccccttcatcctcctgatcctgttcttcatgttcgggtggcgcatcctcttctgcttcaagtgctgccggcgcacccggggcctgttcaagtaccgccacctgaaggacgacgaggagaccgggtaccggcgcatcatcgagcggctcaacaacaagaagggcaagaacaagctgctggacggcgagcgcctcgccgaccgccggatcgccgagctgttcagcaccaagacccacatcggg

SEQ ID NO: 12202 - RNA, 2916 nt, synthetic construct
  misc_feature 1..2916: note = derived and/or modified CDS sequence (opt1) from CCHFV(7803, Artificial)__AB069672.1__Gn-4aa-Gc
  source 1..2916: mol_type = other RNA
agcgaggagtccggcgacgactgcatcagccgcacccagctcctccggaccgagacggccgagatccacggggacaactacggcgggcccggcgacaagatcaccatctgcaacgggtccaccatcgtggaccagcgcctgggcagcgagatgggctgctacaccatcaaccgggtcaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcatcctggacgcgtgcgactccagctgcgaggtgatgatccccaagggcaccggcgacatcctcgtggactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtcatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaacatctgcccctactgcgccagccgcctgacctccgacgggctggcccggcacgtgacgcagtgcccgaagcgcaaggagaaggtcgaggagaccgagctctacctgaacctggagcggatcccctgggtggtgcgcaagctcctgcaggtcagcgagagcaccggcgtggcgctgaagcggtccagctggctcatcgtgctgctggtcctcttcgccatctccctgagccccgtgcagtccgcccccatcagccgccggccgctgttcctcgactccatcgtgcgcgggatgaagaaccccctgaacagcacctccctggagacgagcctctccatcgaggccccctggggcgccatcaacgtccagagcacctacaagcccaccgtgtccaccgcgaacatcgccctgagctggtccagcgtggagcaccggggcaacaagatcctggtctccgggcgcagcgagtccatcatgaagctcgaggagcggacgggcatcagctgggacctgggggtggaggacgccagcgagtccaagctgctcaccgtgagcgtcatggacctgtcccagatgtacagcccggtgttcgagtacctgtccggcgaccgccaggtcgaggagtggcccaaggcgacctgcaccggggactgccccgagcgctgcggctgcacgaccagcacgtgcctccacaaggagtggccccactcccggaactggcgctgcaacccgacctggtgctggggcgtggggaccggctgcacgtgctgcgggctggacgtgaaggacctgttcaccgactacatgatcgtcaagtggaaggtggagtacatcaagacccggggcatcgtgtgcgtcgagctcaccagccaggagcgccagtgctccctgatcgaggccgggacccggttcaacctgggcagcgtgaccatcaccctgtccgagccccgcaacatccagcagaagctcccgcccgagatcatcaccctgcacccccggatcgaggagggcttcttcgacctgatgcacgtgcagaaggtcctcagcgcctccacggtgtgcaagctgcagagctgcacccacggggtgcccggcgacctgcaggtctaccacgtggggaacctcctgaagggcgacaaggtgaacggccacctgatccacaagatcgagccccacctcaacacctcctggatgagctgggacgggtgcgacctggactactactgcaacatgggcgactggccctcctgcacctacacgggggtcacccagcacaaccacgccagcttcgtgaacctgctcaacatcgagaccgactacaccaagagcttccacttccactccaagcgcgtgacggcccacggcgacaccccgcagctggacctgaaggcccggcccacctacggggccggcgagatcaccgtcctcgtggaggtggcggacatggagttcacgcccaagaagatcgagatcagcggcctgaagttcgcctccctgacctgcaccgggtgctacgcctgcagctccggcatcagctgcaaggtccgcatccacgtggacgagccggacgagctcaccgtgcacgtcaagtccgacgaccccgacgtggtggccgccagctccagcctgatggcgcggaagctggagttcgggacggactccaccttcaaggccttcagcgccatgcccaagacctccctctgcttctacatcgtcgagcgcgagtactgcaagagctgctccaaggaggacacccagaagtgcgtgaacacgaagctggagcagccccagagcatcctgatcgagcacaagggcaccatcatcgggaagcagaacaacacgtgcaccgccaaggcgtcctgctggctcgagagcgtgaagtccttcttctacggcctgaagaacatgctgagcggcatcttcgggaacttcttcatgggcatcttcctcttcctggccccgttcatcctgctcatcctgttcttcatgttcgggtggcggatcctgttctgcttcaagtgctgccgccggacccgcggcctcttcaagtaccggcacctgaaggacgacgaggagaccgggtaccgccggatcatcgagcgcctgaacaacaagaagggcaagaacaagctcctggacggcgagcgcctggccgaccggcgcatcgccgagctgttcagcaccaagacccacatcggg

SEQ ID NO: 12203 - RNA, 2916 nt, synthetic construct
  misc_feature 1..2916: note = derived and/or modified CDS sequence (opt1) from CCHFV(79121, Artificial)__AB069673.1__Gn-4aa-Gc
  source 1..2916: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagggcctcggctccgagctggggtgctacaccatcaaccgggtgcgcagctacaagctgtgcgagaactccgcgagcggcaagtcctgcgagatcgacagcatcccggtcaagtgcaagcaggggttctgcctcaagatcacccaggagggccgggggcacgtgaagctgtcccgcggcacggagatcgtgctggacgtctgcgacagctcctgcgagctcatgatccccaagggcaccggggacatcctggtggactgcagcggcgggcagcagcacttcctgcagaacaacctcatcgacctgggctgccccaacgtgcccctgctcggcaagatggccatctacgtctgccggatgtccaaccacccgaagaccaccatggccttcctgttctggttcagcttcgggtacgtgatcacgtgcatcgcctgccgcgtgctgttctacctcctgatcgccatcggcaccgtcgggaagaagctgaagcagtaccgggagctcaagccccagacctgcatcgtgtgcgagtccgtgcccgtcaacgcgatcgacgccgagatgcacgagctgaactgcagctacaacatctgcccctactgcgcctcccgcctgagcaccgacggcctcatccggcacgtgacgcagtgcccgaagcgccgggagaaggtggaggagaccgagctgttcctgaacctcgagcgcatcccctggctggtccggaagctgctccaggtgagcgagtccaccgggatggccctgaagcgcagctgctggatgatcaccctgctcatcctgctgctcgtgtccatcagccccgtccagtccgcgcccgtgggccggaagccgctgttcctggacagcacggccaagggcatgaagtccctcctgaacagcacctccctggagaccagcctctccatcgaggccccctggggcgccatcaacgtgcagagcaccttcaagcccacggtctccgccgcgaacatcgccctgagctggtccagcgtggagcaccgcgggaacaagatcctggtctccgggcggagcgagtccatcatgaagctcgaggagcgcaccggcgtgagctggaacctgggggtggaggacgccagcgagtccaagaccctgaccgtcagcgtgatggacctctcccagatgtacagccccgtgttcgagtacctgtccggcgaccggcaggtcgaggagtggccgaaggccacgtgcaccggcgactgccccgagcgctgcgggtgcaccagctccacgtgcctgcacaaggagtggccccacagccggaactggcgctgcaaccccacctggtgctggggcgtggggaccggctgcacgtgctgcgggctcgacgtgaaggacttcttcaccgactacatgctggtcaagtggaaggtggagtacatcaagaccgaggccatcgtgtgcgtcgagctgacctcccaggagcgccagtgcagcctgatcgaggcgggcacccggttcaacctcggcccggtgaccatcacgctgtccgagccccgcaacgtgcagcagcggctgccgcccgagatcgtcaccctccaccccaagatcgaggaggggttcttcgacctgatgcacgtgcagaagatcctgagcgcctccaccgtgtgcaagctccagagctgcacccacggcgtccccggggacttccagatctaccacgtgggcaacctgctgcgcggcgacaaggtgaacgggcactccatccacaagatcgagccccacttcaacaccagctggatgtcctgggacggctgcgacctcgactacttctgcaacatgggggactggcccagctgcacgtacaccggcgtcacccagcacaaccgggccgccttcatcaacatgctgaacatcgagaccgactacacgaagaccttccacttccacagcaagcgcgtgaccgcccacggggacaccccgcagctggacctcaaggcgcggcccgcctacggcgccggcgaggtgacggtcctggtggaggtggccgacctggagctccacaccaagaacctggaggtctccgggctgaagatcgccagcctgacctgctccggctgctacgcgtgcagctccgggatcagctgcaaggtgcgcatccacgtgaacgagcccgacgagttcaccgtccacgtgcggtccagcgacccggacgtggtcgccgccggctccagcctcatggcccgcaagatcgagttcggggcggactccacgttcaaggccttcagctccatgcccaaggacagcctgtgcttctacatcgtggagaaggactactgctccagctgcaccgacgacgacacccagaagtgcgtgaacaccaagctcgaccacccccagtccatcctgatcgagcacaagggcacgatcatcggcaagcagaacgacacgtgcagcaccaagacctcctgctggctggagagcgtcaaggggttcttctacggcctcaagaacatgctgagcgggatcttcggcaacgtgttcctggggatcttcctcttcctggcccccttcgtgctgctcatcttcttcttcttcttcggctggcggctgctgttctgcctcaagtgctgccgccggacccgcggcctgctgaagtacaagcacctcaaggacgaggaggaggccgggtacaagaagatcatcgagcggctgaacggcaagaaggggaagtcccagctgttcgacggcgagcgcctcgccgaccggaagatcgcggagctgttcagcaccaagatccacatcggg

SEQ ID NO: 12204 - RNA, 2916 nt, synthetic construct
  misc_feature 1..2916: note = derived and/or modified CDS sequence (opt1) from CCHFV(8402, Artificial)__AB069674.1__Gn-4aa-Gc
  source 1..2916: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtggtgacctgcatcctgtgcaaggtcatcttctacctcctgatcgtggtgggcaccctggggaagaagttcaagcagtaccgcgagctcaagccccagacgtgcaccatctgcgagaccacccccgtcaacgccatcgacgccgagatgcacgacctgaactgcagctacaacatctgcccctactgcgcgtcccggctgacgagcgacggcctcgcccgccacgtgatgcagtgcccgaagcggaaggagaagatcgaggagaccgagctgtacctgaacctcgagcgcatcccctgggtggtccggaagctgctgcaggtgtccgagagcaccggggtggccctcaagcgcagctcctggctggtcgtgctgctcgtgctgctgaccgtcagcctctcccccgtgcagagcgcccccatcggccggaagccgctgttctccgacagcatcgtgaaggggatgaagaacctgctcaactccacgagcctggagacctccctgagcatcgaggcgccctggggcgccatcaacgtccagtccaccttcaagcccaccgtgagcgccgccaacatcgccctctcctggagctccgtcgagcaccgcggcaacaagatcctggtgagcgggcggtccgagagcatcatgaagctggaggagcgcacgggcatctcctgggacctcggggtggaggacgcgagcgagagcaagctgctgaccgtctccgtgatggacctcagccagatgtactcccccgtgttcgagtacctgagcggcgaccggcaggtcgaggagtggccgaaggccacctgcaccggggactgccccgagcgctgcggctgcacgtccagcacctgcctgcacaaggagtggccccactcccggaactggcgctgcaaccccacctggtgctggggcgtggggaccggctgcacgtgctgcgggctcgacgtgaaggacctgttcaccgactacatgttcatcaagtggaaggtcgagtacatcaagaccgaggccatcgtgtgcgtggagctgaccagccaggagcgccagtgcacgctgatcgaggccggcacccggttcaacctcgggccggtcaccatcaccctgtccgagccccgcaacatccagcagaagctgccccccgagatcgtgaccctccacccgcggatcgaggagggcttcttcgacctgatgcacgtgcagaaggtcctgagcgcctccacggtgtgcaagctccagagctgcacccacggcgtgcccggggacctgcaggtctaccacatcggcaacctgctcaagggggacaaggtgaacggccacctgatccacaagatcgagccccacttcaacacctcctggatgagctgggacggctgcgacctggactactactgcaacatgggggactggccctcctgcacctacacgggcgtgacccagcacaaccacgcggccttcgtcaacatgctcaacatcgagaccgactacaccaagaacttccacttccacagcaagcgcgtgacggcccacggggacaccccgcagctggacctgaaggcccggcccacctacggcgccggggagatcaccgtgctcgtcgaggtggcggacatggagctgcacacgaagaagatcgagatctccggcctgaagttcgccagcctcacctgcaccggctgctacgcctgcagctccgggatcagctgcaaggtgcgcatccacgtcgacgagcccgacgagctgaccgtgcacgtgaagtccgaggacccggacatcgtcgccgccagctccagcctgatggcgcggaagctcgagttcggcacggactccaccttcaaggccttcagcgccatgcccaagacctccctgtgcttctacatcgtggagcgcgagtactgcaagagctgctccaaggaggacacccagaagtgcgtgaacacgaagctggagcagccccagagcatcctcatcgagcacaaggggaccatcatcggcaagcagtccaacacctgcaccgccaaggcgagctgctggctggagtccgtcaagagcttcttctacgggctgaagaacatgctctccggcatcttcggcaacgtgttcatcggggtgttcctgttcttcgcccccttcatcctgctcatcctgttcttcatgttcggctggcggatcctgttctgcttcaagtgctgccgccggacgcgcgggctcttcaagtaccggcacctgaaggacgacgaggagaccggctaccgcaagatcatcgagcggctgaacaacaagaaggggaagaacaagctcctggacggcgagcgcctggccgaccggaagatcgccgagctcttcagcaccaagacccacatcggc

SEQ ID NO: 12205 - RNA, 2916 nt, synthetic construct
  misc_feature 1..2916: note = derived and/or modified CDS sequence (opt1) from CCHFV(88166, Artificial)__AB069675.1__Gn-4aa-Gc
  source 1..2916: mol_type = other RNA
agcgaggagtccggcgacgactgcatcagccgcacccagctgctccggaccgagacggccgagatccactccgacaactacgggggccccggggacaagatcaccatctgcaacggcagcaccgtggtcgaccagcgcctggggtccgagctgggctgctacaccatcaaccgggtgaagagcttcaagctctgcgagaactccgccacgggcaagagctgcgagatcgactccaccccggtgaagtgccgccaggggttctgcctgaagatcacccaggagggccgggggcacgtcaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggtcatcttctacctcctgatcgtggtggggaccctgggcaagaagttcaagcagtaccgcgagctcaagccccagacgtgcaccatctgcgagaccacccccgtcaacgccatcgacgccgagatgcacgacctgaactgctcctacaacatctgcccctactgcgccagccggctgacgtccgacgggctcgcgcgccacgtgatgcagtgcccgaagcggaaggagaagatcgaggagaccgagctgtacctgaacctcgagcgcatcccctgggtggtccggaagctgctgcaggtgagcgagagcaccggcgtggccctcaagcgctccagctggctggtcgtgctgctcgtgctgctgaccgtctccctcagccccgtgcagtccgcccccatcgggcggaagccgctgttcagcgactccatcgtgaagggcatgaagaacctgctcaacagcacgtccctggagaccagcctgtccatcgaggccccctggggcgcgatcaacgtccagagcaccttcaagcccaccatgtccgccgccaacatcgccctcagctggtccagcgtggagcaccgcgggaacaagatcctggtctccggccggagcgagtccatcatgaagctggaggagcgcacggggatcagctggaacctcggcgtggaggacgccagcgagtccaagctgctgaccgtgagcgtcatggacctctcccagatgtacagccccgtgttcgagtacctgtccggggaccggcaggtggaggagtggccgaaggcgacctgcaccggcgactgccccgagcgctgcggctgcacgagctccacctgcctgcacaaggagtggccccacagccggaactggcgctgcaaccccacctggtgctggggggtcggcaccgggtgcacgtgctgcggcctcgacgtgaaggacctgttcaccgactacatgttcatcaagtggaaggtggagtacatcaagaccgaggccatcgtctgcgtggagctgacctcccaggagcgccagtgcacgctgatcgaggccgggacccggttcaacctcggcccggtgaccatcaccctgagcgagccccgcaacatccagcagaagctgccccccgagatcgtcaccctccacccgcggatcgaggagggcttcttcgacctgatgcacgtgcagaaggtgctgtccgccagcacggtctgcaagctccagtcctgcacccacggggtgcccggcgacctgcaggtgtaccacatcgggaacctgctcaagggcgacaaggtcaacggccacctgatccacaagatcgagccccacttcaacaccagctggatgtcctgggacgggtgcgacctggactactactgcaacatgggcgactggcccagctgcacctacacgggggtgacccagcacaaccacgccgcgttcgtgaacatgctcaacatcgagaccgactacaccaagaacttccacttccactccaagcgcgtcacggcccacggcgacaccccgcagctggacctgaaggcccggcccacctacggggccggcgagatcaccgtgctcgtggaggtcgccgacatggagctgcacacgaagaagatcgagatcagcggcctgaagttcgcgagcctcacctgcaccgggtgctacgcctgctccagcggcatctcctgcaaggtgcgcatccacgtggacgagcccgacgagctgaccgtccacgtgaagagcgaggacccggacctggtggccgcctccagctccctcatggcccggaagctggagttcgggacggacagcaccttcaaggcgttctccgccatgcccaagaccagcctgtgcttctacatcgtcgagcgcgagtactgcaagtcctgcagcaaggaggacacccagaagtgcgtgaacacgaagctcgagcagccccagtccatcctgatcgagcacaagggcaccatcatcgggaagcagaacaacacctgcaccgccaaggccagctgctggctggagtccgtgaagagcttcttctacggcctcaagaacatgctgtccggcatcttcgggaacgtcttcatcggcgtgttcctgttcttcgcgcccttcatcctcctgatcctgttcttcatgttcgggtggcggatcctcttctgcttcaagtgctgccgccggacgcgcggcctgttcaagtaccggcacctgaaggacgacgaggagaccgggtaccgcaagatcatcgagcggctcaacaacaagaagggcaagaacaagctgctggacggcgagcgcctcgccgaccggaagatcgccgagctgttcagcaccaagacccacatcggg

SEQ ID NO: 12206 - RNA, 2916 nt, synthetic construct
  misc_feature 1..2916: note = derived and/or modified CDS sequence (opt1) from CCHFV(BA88166, Artificial)__AF338470.1__Gn-4aa-Gc
  source 1..2916: mol_type = other RNA
agcgaggagtccggcgacgactgcatcagccgcacccagctgctccggaccgagacggccgagatccactccgacaactacgggggccccggggacaagatcaccatctgcaacggcagcaccgtggtcgaccagcgcctggggtccgagctgggctgctacaccatcaaccgggtgaagagcttcaagctctgcgagaactccgccacgggcaagagctgcgagatcgactccaccccggtgaagtgccgccaggggttctgcctgaagatcacccaggagggccgggggcacgtcaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggggatcttctacctcctgatcgtcgtgggcaccctggggaagaagttcaagcagtaccgcgagctcaagccccagacgtgcaccatctgcgagaccacccccgtgaacgccatcgacgccgagatgcacgacctgaactgctcctacaacatctgcccctactgcgccagccggctgacgtccgacggcctcgcgcgccacgtcatgcagtgcccgaagcggaaggagaagatcgaggagaccgagctgtacctgaacctcgagcgcatcccctgggtggtgcggaagctgctgcaggtcagcgagagcaccggggtggccctcaagcgctccagctggctggtggtcctgctcgtgctgctgaccgtgtccctcagccccgtccagtccgcccccatcggccggaagccgctgtacctggacagcatcgtgaagggcatgaagaacctcctgaactccacgagcctggagacctccctcagcatcgaggccccctggggggcgatcaacgtgcagtccaccttcaagcccaccatgagcgccgccaacatcgccctgtcctggagctccgtcgagcaccgcggcaacaagatcctggtgagcgggcggtccgagagcatcatgaagctcgaggagcgcacgggcatctcctggaacctgggggtcgaggacgccagcgagagcaagctgctcaccgtgtccgtgatggacctgagccagatgtactcccccgtcttcgagtacctgagcggcgaccggcaggtggaggagtggccgaaggcgacctgcaccggcgactgccccgagcgctgcgggtgcacgtccagcacctgcctccacaaggagtggccccactcccggaactggcgctgcaaccccacctggtgctggggcgtggggaccggctgcacgtgctgcgggctggacgtcaaggacctgttcaccgactacatgttcatcaagtggaaggtggagtacatcaagaccgaggccatcgtgtgcgtcgagctgaccagccaggagcgccagtgcacgctcatcgaggccggcacccggttcaacctgggcccggtgatcatcaccctgtccgagccccgcaacatccagcagaagctcccccccgagatcgtgaccctgcacccgcggatcgaggaggggttcttcgacctgatgcacgtccagaaggtgctcagcgcctccaccgtgtgcaagctgcagagctgcacgcacggcgtccccggggacctgcaggtgtaccacatcggcaacctcctgaagggcgacaaggtgaacgggcacctgatccacaagatcgagccccacttcaacacctcctggatgagctgggacggctgcgacctcgactactactgcaacatgggggactggccctcctgcacctacaccggcgtcacgcagcacaaccacgccgcgttcgtgaacatgctgaacatcgagaccgactacaccaagaacttccacttccacagcaagcgcgtgaccgcccacggggacacgccgcagctggacctcaaggcccggcccacctacggcgccggcgagatcaccgtcctggtggaggtggccgacatggagctgcacaccaagaagatcgagatctccgggctcaagttcgcgagcctgacgtgcaccggctgctacgcctgcagctccgggatcagctgcaaggtccgcatccacgtggacgagcccgacgagctgaccgtgcacgtcaagtccgaggacccggacatcgtggccgccagctccagcctcatggcccggaagctggagttcggcaccgactccacgttcaaggcgttcagcgccatgcccaagacctccctgtgcttctacatcgtggagcgcgagtactgcaagagctgctccaaggaggacacccagaagtgcgtcaacaccaagctcgagcagccccagagcatcctgatcgagcacaaggggacgatcatcggcaagcagaacaacacctgcaccgccaaggcctcctgctggctggagagcgtgaagtccttcttctacggcctcaagaacatgctgagcgggatcttcggcaacgtgttcatcggggtcttcctgttcttcgcgcccttcatcctcctgatcctgttcttcatgttcggctggcggatcctcttctgcttcaagtgctgccgccggacccgcgggctgttcaagtaccggcacctgaaggacgacgaggagacgggctaccgcaagatcatcgagcggctcaacaacaagaagggcaagaacaagctgctggacggggagcgcctcgccgaccggaagatcgccgagctgttctccaccaagacccacatcggc

SEQ ID NO: 12207 - RNA, 2916 nt, synthetic construct
  misc_feature 1..2916: note = derived and/or modified CDS sequence (opt1) from CCHFV(BA66019, Artificial)__AF350448.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtcgaccagcgcctgggcagcgagctgggctgctacaccatcaaccgggtgaagtccttcaagctctgcgagaacagcgggacgggcaagtcctgcaagatcgacaagcacccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagaccacgatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccaccaacgccatcgacgccgagatgcacgacctcaagtgctcctacaacatctgcccctactgcgccagccggctgacgtccgacggcctggcgcgccacgtgacccagtgcccgaagcggaaggagaaggtcgaggagaccgagctctacctgaacctggagcgcatcccctggatcgtgcggaagctcctccaggtgagcgagtccaccggggtcgccctgaagcgcagcagctggctcatcgtgctgctggtgctcctgacggtctccctgagccccgtgcagtccgcccccatcggccggaagcccctcttcagcgactccatcgtgaagggcatgaagaacctgctgaacagcacctccctcgagaccagcctgtccatcgaggccccctggggcgcgatcaacgtccagagcaccttcaagcccacggtgtccaccgccaacatcgccctgagctggtccagcgtggagcaccgcgggaacaagatcctcgtctccgggcggagcgagtccatcatgaagctggaggagcgcaccggcatcagctgggacctgggggtggaggacgcctccgagagcaagctcctgaccgtcagcgtgatggacctgtcccagatgtacagccccgtgttcgagtacctctccggcgaccggcaggtcgaggagtggccgaaggccacgtgcaccggcgactgccccgaccgctgcgggtgcaccagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggcgatcgtgtgcgtcgagctgaactcccaggagcgccagtgcagcctgatcgaggccggcacccggttcaacctgggcccggtgaccatcaccctctccgagccccgcaacatccagcagaagctgccgcccgagatcatcaccctgcacccgcggatcgaggaggggttcttcgacctcatgcacgtgcagaaggtcctgagcgcctccacggtgtgcaagctgcagagctgcacccacggcgtgcccggggacctccagatctaccacatcggcaacctgctgaagggcgaccgcgtcaacgggcacctcatccacaagatcgagccccacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagaacttccacttccacagcaagcgggtcacggcgcacggggacaccccgcagctggacctgaaggcccgccccacctacggcgccggcgagatcaccgtgctcgtggaggtcgccgacatggagctgcacacgaagaagatcgccatctccgggctgaagttcgcgagcctgacctgcaccggctgctacgcctgcagctccgggatcagctgcaaggtgcggatccacgtggacgagcccgacgagctgaccgtccacgtgaagtccgaggacccggacatcgtggccgccagctccagcctgatggcccgcaagctcgagttcggcacggactccaccttcaaggcgttcagcgccatgcccaagacctccctgtgcttctacatcgtcgagcgggagtactgcgagagctgctccaaggaggacacccagaagtgcgtgaacacgaagctggagcagccccagagcatcctcatcgagcacaaggggaccatcatcggcaagcagaacgacacgtgcaccgccaaggcctcctgctggctggagagcgtgaagtccttcttctacggcctgaagaacatgctcagcgggatcttcggcaacgtcttcatcgggatcttcctgttcctggcgcccttcatcctcctgatcctgttcttcatgttcggctggcgcatcctcttctgcttcaagtgctgccggcgcacccgggggctgttcaagtaccgctacctgaaggacgacgaggagtccggctaccggcgcatcatcgagcggctcaacaacaagaagggcaagaacaagctgctggacggggagcgcctcgccgaccggcgcatcgccgagctgttcagcaccaagacccacatcggc

SEQ ID NO: 12208 - RNA, 2916 nt, synthetic construct
  misc_feature 1..2916: note = derived and/or modified CDS sequence (opt1) from CCHFV(BA8402, Artificial)__AF350449.1__Gn-4aa-Gc
  source 1..2916: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaactccttcaacctctgcgagaacacggccaccggcaagagctgcgagatcgactccaccccggtgaagtgccgccaggggttctgcctgaagatcacccaggagggccgggggcacgtcaagctgagccgcggctccgaggtggtgctcgacgcgtgcgagagctcctgcgagatcatgatccccaaggggacgggcgacatcctggtcgactgcagcggcgggcagcagcacttcctgaaggacaacctcatcgacctgggctgccccaacatccccctgctcgggaagatggccatctacatctgccggatgtccaaccacccgaagaccaccatggccttcctgttctggttcagcttcggctacgtggtgacctgcatcctgtgcaaggtcatcttctacctcctgatcgtggtgggcacgctggggaagaagttcaagcagtaccgcgagctcaagccccagacctgcaccatctgcgagaccacgcccgtcaacgccatcgacgccgagatgcacgacctgaactgctcctacaacatctgcccctactgcgcgagccggccgacctccgacggcctggcccgccacgtgatgcagtgccccaagcggaaggagaagatcgaggagaccgccctctacctgaacctggagcgcatcccctgggtggtccggaagctcctccaggtgagcgagtccaccggggtggccctgaagcgcagcagctggctggtcgtgctgctggtgctcctgacggtctccctgagccccgtgcagtccgcgccgatcggccggaagcccctcttcagcgactccatcgtgaaggggatgaagaacctgctgaacagcacctccctcgagaccagcctgtccatcgaggccccctggggcgccatcaacgtccagagcaccttcaagcccacggtgtccgccgccaacatcgcgctgagctggtccagcgtcgagcaccgcggcaacaagatcctcgtgtccgggcggagcgagtccatcatgaagctggaggagcgcaccggcatcagctgggacctgggggtggaggacgcctccgagagcaagctcctgaccgtcagcgtgatggacctgtcccagatgtacagcccggtgttcgagtacctctccggcgaccggcaggtcgaggagtggcccaaggcgacctgcacgggggactgccccgagcgctgcggctgcaccagctccacgtgcctgcacaaggagtggccccacagccggaactggcgctgcaacccgacctggtgctggggcgtggggaccggctgcacgtgctgcgggctggacgtgaaggacctcttcaccgactacatgttcatcaagtggaaggtcgagtacatcaagaccgaggccatcgtgtgcgtggagctgacctcccaggagcgccagtgcaccctgatcgaggccggcacccggttcaacctggggcccgtcaccatcaccctcagcgagccccgcaacatccagcagaagctgcccccggagatcgtgacgctgcacccccggatcgaggagggcttcttcgacctcatgcacgtgcagaaggtcctgtccgccagcaccgtgtgcaagctgcagtcctgcacccacggcgtgcccggggacctccaggtctaccacatcggcaacctgctgaagggggacaaggtgaacggccacctcatccacaagatcgagccccacttcaacaccagctggatgtcctgggacggctgcgacctgcactactactgcaacatgggggactggccgagctgcacgtacaccggcgtgacccagcacaaccacgccgccttcgtcaacatgctgaacatcgagaccgactacacgaagaacttccacttccactccaagcgcgtgaccgcccacggggacacgccccagctcgacctgaaggcccggcccacctacggcgcgggggagatcaccgtgctggtcgaggtggccgacatggagctccacaccaagaagatcgagatcagcggcctgaagttcgcctccctgacctgcaccggctgctacgcctgcagcagcgggatctcctgcaaggtgcgcatccacgtcgacgagccggacgagctcacggtgcacgtcaagagcgaggaccccgacatcgtggccgcgtccagctccctgatggcccggaagctggagttcggcaccgacagcaccttcaaggccttctccgccatgcccaagaccagcctctgcttctacatcgtggagcgcgagtactgcgagtcctgcagcaaggaggacacgcagaagtgcgtgaacaccaagctggagcagccccagtccatcctgatcgagcacaaggggaccatcatcggcaagcagagcaacacgtgcaccgcgaaggcctcctgctggctcgagagcgtcaagtccttcttctacgggctgaagaacatgctgagcggcatcttcggcaacgtgttcatcggggtgttcctcttcttcgccccgttcatcctgctgatcctcttcttcatgttcggctggcggatcctgttctgcttcaagtgctgccgccggacccgcgggctgttcaagtaccggcacctcaaggacgacgaggagaccggctaccgcaagatcatcgagcggctgaacaacaagaaggggaagaacaagctgctcgacggcgagcgcctggccgaccggaagatcgccgagctgttctccaccaagacgcacatcggc

SEQ ID NO: 12209 - RNA, 2916 nt, synthetic construct
  misc_feature 1..2916: note = derived and/or modified CDS sequence (opt1) from CCHFV(Matin, Artificial)__AF467769.2__Gn-4aa-Gc
  source 1..2916: mol_type = other RNA
agcgaggagtccggcgacgactgcatcagccgcacccagctgctccggaccgagacggccgagatccactccgacagctacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggtgttcctgttctggttctccttcggctacgtgatcacctgcatcctgtgcaaggtcatcttctacctcctgatcgtggtgggcaccctggggaagaagttcaagcagtaccgcgagctcaagccccagacgtgcaccatctgcgagaccacccccgtcaacgccatcgacgccgagatgcacgacctgaactgcagctacaacatctgcccctactgcgcctcccggctgacgagcgacggcctcgcgcgccacgtgatgcagtgcccgaagcggaaggagaagatcgaggagaccgagctgtacctgaacctcgagcgcatcccctgggtggtccggaagctgctgcaggtgagcgagtccaccggggtggccctcaagcgcagctcctggctggtcgtgctgctcgtgctgctgaccgtcagcctctcccccgtgcagagcgcccccatcggccggaagccgctgttcctggactccatcatcaaggggatgaagaacctcctgaacagcacgtccctggagaccagcctctccatcgaggccccctggggcgcgatcaacgtgcagagcaccttcaagcccaccatgtccgccgccaacatcgccctgagctggtccagcgtcgagcaccgcggcaacaagatcctggtgtccgggcggagcgagtccatcatgaagctcgaggagcgcacgggcatcagctgggacctgggggtcgaggacgccagcgagtccaagctgctcaccgtgagcgtgatggacctgtcccagatgtacagccccgtcttcgagtacctgtccggcgaccggcaggtggaggagtggccgaaggcgacctgcaccggggactgccccgagcgctgcggctgcacgagctccacctgcctccacaaggagtggccccacagccggaactggcgctgcaaccccacctggtgctggggcgtggggaccggctgcacgtgctgcgggctggacgtcaaggacctgttcaccgactacatgttcgtgaagtggaaggtggagtacatcaagaccgaggtcatcgtgtgcgtggagctgacctcccaggagcgccagtgcagcctcatcgaggccggcacgcggttcaacctggggccggtcaccatcaccctgtccgagccccgcaacatccagcagaagctcccccccgagatcgtgaccctgcacccgcggatcgaggagggcttcttcgacctgatgcacgtgcagaaggtcctcagcgcctccaccgtgtgcaagctgcagagctgcacgcacggcgtgcccggggacctgcaggtctaccacatcggcaacctcctgaagggggacaaggtgaacggccacctgatccacaagatcgagccccacttcaacacctcctggatgagctgggacggctgcgacctcgactactactgcaacatgggggactggccctcctgcagctacaccggcgtgacccagcacaaccacgccgccttcgtcaacatgctgagcatcgagacggactacaccaagaacttccacttccactccaagcgcgtgaccgcgcacggggacaccccgcagctggacctcaaggcccggcccacgtacggcgccggggagatcaccgtgctggtcgaggtggccgacatggagctgcacaccaagaagatcgagatcagcggcctcaagttcgcctccctgacctgcacgggctgctacgcgtgcagctccgggatcagctgcaaggtgcgcatccacgtcgacgagcccgacgagctgaccgtgcacgtgaagtccgaggacccggacatcgtcgccgccagctccagcctcatggcccggaagctggagttcggcaccgactccaccttcaaggccttcagcgcgatgcccaagacgtccctgtgcttctacatcgtggagcgcgagtactgcaagagctgctccaaggaggacacccagaagtgcgtgaacaccaagctcgagcagccccagagcatcctgatcgagcacaaggggaccatcatcggcaagcagaacgacacgtgcaccgccaaggcctcctgctggctggagagcgtcaagtccttcttctacgggctcaagaacatgctgagcggcatcttcggcaacgtgttcatcgggatcttcctgttcctcgcccccttcgcgctgctgatcctcttcttcatgttcggctggcggatcctgttctgcttcaagtgctgccgccggacccgcgggctgttcaagtaccggcacctcaaggacgacgaggagaccggctaccgcaagatcatcgagcggctgaacaacaagaaggggaagaacaagctgctcgacggcgagcgcctggccgaccggaagatcgccgagctgttcagcacgaagacccacgtgggc

SEQ ID NO: 12210 - RNA, 2916 nt, synthetic construct
  misc_feature 1..2916: note = derived and/or modified CDS sequence (opt1) from CCHFV(Baghdad 12, Artificial)__AJ538197.2__Gn-4aa-Gc
  source 1..2916: mol_type = other RNA
agcgaggagtccggcgacgactgcatcagccgcacccggctgctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacgggcaagagctgcaagatcgactccatcccggtgaagtgccggcaggggtactgcctcaagatcacccaggaggggcgcggccacgtgaagctgagccgggggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccgcatgtccaaccacccgaagaccacgatggccttcctcttctggttcagcttcggctacgtgatcacgtgcatcctgtgcaaggccatcttctacctgctcatcatcgtggggaccctgggcaagcggttcaagcagtaccgcgagctgaagccccagacctgcacgatctgcgagaccacccccgtcaacgccatcgacgcggagatgcacgacctcaactgctcctacaacatctgcccctactgcgccagccggctgacctccgacgggctggcccgccacgtgacgcagtgcccgaagcggaaggagaaggtggaggagaccgagctctacctgaacctggagcgcatcccctgggtcgtgcggaagctcctccaggtgagcgagagcaccggcgtcgccctgaagcgctccagctggctcatcgtgctgctggtgctcctggcggtctccagctcccccgtgcagagcgcccccatcgggcggaagccgctgttcctcgactccatcgtgaagggcaccaagaacctgctgaacagcacgtccctcgagaccagcctgtccatcgaggccccctggggcgccatcaacgtccagagcacctacaagcccaccgtgtccacggccaacatcgcgctgagctggtccagcgtggagcaccgcgggaacaagatcctcgtctccggccggagcgagtccatcatgaagctggaggagcgcaccgggatcagctgggacctgggcgtggaggacgccagcgagtccaagctcctgaccgtcagcgtgatggacctgtcccagatgtacagccccgtgttcgagtacctctccggggaccggcaggtcgaggagtggccgaaggcgacctgcacgggcgactgccccgagcgctgcggctgcaccaccagcacgtgcctgcacaaggagtggccccactcccgcaactggcggtgcaaccccacctggtgctggggcgtggggaccgggtgcacgtgctgcggcctggacgtgaaggacctcttcaccgactacatgttcgtcaagtggaaggtggagtacatcaagaccgacgccatcgtgtgcgtcgagctgaccagccaggagcgccagtgctccctgatcgaggccgggacccggttcaacctgggcagcgtgaccatcaccctctccgagccgcgcaacatccagcagaagctgccgcccgagatcatcacgctgcacccccggatcgaggagggcttcttcgacctcatgcacgtgcagaaggtcctgagcgcctccaccgtgtgcaagctgcagagctgcacccacggggtgcccggcgacctccaggtctaccacatcgggaacctgctgaagggcgacaaggtgaacggccacctcatccacaagatcgagccccacttcaacacctcctggatgagctgggacgggtgcgacctggactactactgcaacatgggcgactggccctcctgcacgtacaccggggtgacccagcacaaccacgccagcttcgtcaacctgctcaacatcgagaccgactacaccaagagcttccacttccactccaagcgcgtgaccgcccacggcgacacgccccagctggacctgaaggtgcggccgacctacggggccggcgagatcaccgtcctcgtggaggtggccgacatggagctgcacaccaagaagatcgagatcagcggcctgaagttcgcgtccctgacctgcaccgggtgctacgcctgcagctccggcatcagctgcaaggtccgcatccacgtggacgagcccgacgagctgacggtgcacgtcaagtccgacgaccccgacgtggtggccgccagctccagcctgatggcccggaagctcgagttcgggaccgactccaccttcaaggcgttcagcgccatgccgaagacctccctgtgcttctacatcgtcgagcgcgagtactgcaagagctgctccaaggaggacacgcagaagtgcgtgaacaccaagctggagcagccccagagcatcctcatcgagcacaagggcaccatcatcgggaagcagaacaacacgtgcaccgccaagacctcctgctggctggagagcgtgaagtccttcttctacggcctgaagaacatgctcagcggcatcttcgggaacttcttcatgggcatcttcctgttcctggcccccttcatcctcctgatcctgttcttcatgttcgggtggcggatcctcttctgcttcaagtgctgccgccggacccgcggcctgttcaagtaccggcacctgaaggacgacgaggagaccgggtaccgccggatcatcgagcgcctcaacaacaagaagggcaagaacaagctgctggacggcgagcggctcgcggaccgccgcatcgccgagctgttcagcacgaagacccacatcggg

SEQ ID NO: 12211 - RNA, 2916 nt, synthetic construct
  misc_feature 1..2916: note = derived and/or modified CDS sequence (opt1) from CCHFV(VLG/TI29414, Artificial)__AY179961.1__Gn-4aa-Gc
  source 1..2916: mol_type = other RNA
agcgaggagcccggcgacgactgcatctcccgcacccagctgctccgggccgagccggccgagatccacgacgacaactacgggggccccggggacaagatcaccatctgcaacggcagcacgatcgtggaccagcgcctggggtccgagctgggctgctacaccatcaaccgggtcaagagcttcaagctctgcgagaactccgcgaccggcaagacctgcgagatcgacagcacgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccgcacatccccctgctcgggaagatggccatctacatctgccggatgagcaaccacccccgcaccacgatggccttcctgttctggttctccttcggctacgtgatcacctgcatcttctgcaaggccctgttctacagcctcatcatcatcggcaccctggggaagaagatcaagcagtaccgggagctgaagccccagacctgcacgatctgcgagaccgcgccggtgaacgccatcgacgccgagatgcacgacctcaactgctcctacaacatctgcccctactgcgccagccgcctgacctccgacggcctggcgcggcacgtcccccagtgccccaagcgcaaggagaaggtggaggagaccgagctctacctgaacctggagcggatcccgtggaacgtgcgcaagctcctgcaggtcagcgagtccacgggggtggccctgaagcggagcagctggctcatcgtgctgctggtcctcctgaccgtgtccctgagccccgtgcagtccgcccccgtcggccgcaagcccctcttcctggacagcatcgtgaaggggatgaagaacctgctcaactccaccaacctggagaccagcctgtccatcgaggccccgtggggcgccatcaacgtgcagagcacgttcaagcccaccgtctccaccgcgaacatcgccctcagctggtccagcgtggagcaccggggcaacaagatcctggtgaccgggcgctccgagagcatcatgaagctggaggagcggacgggcgtctcctgggacctcggggtggaggacgccagcgagtccaagctgctgaccgtcagcatcatggacctctcccagatgtacagccccgtgttcgagtacctgagcggcgaccgccaggtggaggagtggcccaaggccacctgcaccggggactgcccggagcggtgcggctgcacgtccagcacctgcctgcacaaggagtggccccactcccgcaactggcgctgcaaccccacctggtgctgggaggtcggcaccgggtgcacgtgctgcggctggaacgtgaaggacctcttcaccgaccacatgttcgtgaagtggaaggtcgagtacatcaagaccgaggccatcgtgtgcgtggagctgaccagccaggagcggcagtgctccctgatcgaggcggggacgcgcttcaacctgggccccgtcaccatcaccctcagcgagccgcggaacatccagcagaagctgccccccgagatcatcaccctgcaccccaaggtggaggaggggttcttcgacctcatgcacgtgcagaaggtcctgtccgccagcaccgtgtgcaagctgcagtcctgcacgcacggcatcccgggcgacctccaggtgtaccacatcgggaacctgctgaagggcgaccgcgtcaacgggcacctcatccacaagatcgagccccacttcaacaccagctggatgtcctgggacggctgcgacctggactactactgcaacatgggcgactggcccagctgcacctacaccgggatgacgcagcacaaccacgccgccttcgtgaacctgctcaacatcgagaccgactacaccaagaccttccacttccactccaagcgggtgacggcccacggcgacaccccgcagctggacctgaaggcgcgccccacctacggggccggcgagatcaccgtcctcgtggaggtggccgacatggagctgcacacgaagaaggtcgagatcagcgggctgaagttcgcctccctcgcctgcaccggctgctacgcgtgcagctccggcatcagctgcaaggtgcggatccacgtggacgagcccgacgagctgaccgtccacgtgaagagcaacgaccccgacgtgatcgccgcctccaccagcctgatggcccgcaagctcgagttcgggacggactccaccttcaaggcgttcagcgccatgccgaagacctccctgtgcttctacatcgccgagcgggagtactgcaagagctgctccgaggaggacacccagaagtgcgtcgacacgaagctggagcagccccagagcatcctcatcgagcacaagggcaccatcatcgggaagcagaacgacacctgcaccgccaaggcctcctgctggctggagagcgtgaagtccttcttctacggcctgaagaacatgctcgggagcgtgttcggcaacttcttcatcggcatcctgctgttcctcgcgcccttcgtcctgctggtgctcttcttcatgttcgggtggaagatcctgttctgcttcaagtgctgccgccggacgcgcggcctgctcaagtaccggctgctgaaggacgacgaggagaccgggtaccgccggatcatcgagcgcctcaacaacaagaagggcaagaaccggctgctggacggggagcgcctcgccgaccggaagatcgccgagctgttctccaccaagacccacatcggc

SEQ ID NO: 12212 - RNA, 2916 nt, synthetic construct
  misc_feature 1..2916: note = derived and/or modified CDS sequence (opt1) from CCHFV(TADJ/HU8966, Artificial)__AY179962.1__Gn-4aa-Gc
  source 1..2916: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagaactgcgagatcgactccgtgccggtgaagtgccgccagggctactgcctgaagatcacccaggaggggcggggccacgtcaagctgagccgcgggtccgaggtggtgctcgacgcgtgcgacagctcctgcgaggtcatgatccccaagggcaccggcgacatcagcgtggactgctccgggggccagcagcacttcctgaaggacaacctgatcgacctcgggtgccccaagatccccctgctgggcaagatggccatctacatctgccggatgagcaaccacccgaagaccacgatggccttcctcttctggttctccttcggctacgtgatcacccgcatcctgtgcaaggccatcttctacctgctcatcatcgtcgggaccctgggcaagcggttcaagcagtaccgcgagctgaagccccagacctgcacgatctgcgagaccacccccgccaacgcgatcgacgccgagatgcacgacctcaactgcagctacaacatctgcccctactgcgcctcccggctgaccagcgacgggctggcccgccacgtgacgcagtgcccgaagcggaaggagcgcgtggaggagaccgagctctacctgaacctggagcggatcccctggatcgtccgcaagctcctccaggtgtccgagagcaccggcgtggcgctgaagcggagctcctggctcatcgtcctgctggtgctgttcaccgtgagcctgtcccccgtccagagcgcccccatcgggcgccggccgctgttcctcgactccatcgtgaagggcatgaagaaccccctgaacagcacgtccctggagaccagcctctccatcgaggccccctggggcgccatcaacgtgcagagcacctacaagcccaccgtctccacggccaacatcgcgctgagctggtccagcatcgagcaccgcgggaacaacatcctggtgtccggccggagcgagtccatcatgaagctcgaggagcgcaccgggatcagcggcgacctgggggtggaggacgcctccgagagcaagctgctcaccgtcagcgtgatggacctgtcccagatgtacagcccggtcttcgagtacctgtccggcgaccgccaggtggaggagtggcccaaggcgacctgcacgggcgactgccccgagcggtgcgggtgcaccagctccacgtgcctccacaaggagtggccccacagccgcaactggcggtgcaacccgacctggtgctggggcgtggggaccggctgcacgtgctgcgggctggacgtcaaggacctgttcatcgactacatgttcgtgaagtggaaggtggactacatcaagaccgaggccatcgtctgcgtggagctcacctcccaggagcgccagtgcagcctggtggaggccggcacccggttcaacctgggccccgtcaccatcaccctgtccgagccccgcaacatccagcagaagctgcccccggagatcatcaccctgcacccccggatcgaggaggggttcttcgacctgatgcacgtgcagaaggtgctcagcgcctccaccgtctgcaagctgcagagctgcacgcacggcgtgcccggggacctccaggtgtaccacatcggcaacctcctgaagggcgacaaggagaacgggcacctgatccacaagatcgagccccacttcaacacctcctggatgagctgggacggctgcgacctcgactactactgcaacatgggggactggccgtcctgcacctacaccggcgtcacgcagcacaaccacgccagcttcgtgaacctgctgaacatcgagaccgactacaccaagtccttccacttccacagcaagcgcgtgaccgcccacggggacacgccccagctcgacctgaaggcccggcccacctacggcgccggcgagatcaccgtcctggtggaggtggcggacatggagctccacaccaagaagatcgagatcacggggctgaagttcgccagcctgacctgcaccggctgctacgcctgctccagcgggatctcctgcaaggtccgcatccacgtggacgagccggacgagctcaccgtgcacgtcaagagcgacgaccccgacgtggtggccgcctccagctccctgatggcgcggaagctggagttcggcacggacagcaccttcaaggccttctccgccatgcccaagaccagcctctgcttctacatcgtcgagcgcgagtaccggaagtcctgcagcaaggaggacacccagaagtgcgtgaacacgaagctggagcagccccagtccatcctgatcgagcacaaggggaccatcatcggcaagcagaacaacacgtgcaccgccaaggcgagctgctggctcgagtccgtcaagagcttcttctacggcctgaagaacatgctgtccgggatcttcggcaacgtgttcgtggggatcttcctcttcctggccccgttcatcctgctcatcctgttcttcatgttcggctggcgcatcctgagctgcttcaagtgctgccggcgcacccgggggctcctgaagcaccgccacctgaaggacgacgaggagaccggctaccggcgcatcatcgagcgcctcaacaacaagaagggcaagaacaagctgctggacggggagcggctcgccgaccgccggatcgccgagctgttctccaccaagacccacatcggc

SEQ ID NO: 12213 - RNA, 2916 nt, synthetic construct
  misc_feature 1..2916: note = derived and/or modified CDS sequence (opt1) from CCHFV(Hodzha, Artificial)__AY223476.1__Gn-4aa-Gc
  source 1..2916: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcaagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccgaagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcgggcggcgccccctcttcctggactccatcgtcaagggcacgaagaacctgctcaacagcacctccctggagaccagcctgtccatcgaggccccctggggcgccatcaacgtgcagagcacctacaagcccacggtgtccaccgcgaacatcgccctcagctggtccagcgtcgagcaccgggggaacaagatcctggtgtccggccgcagcgagtccatcatgaagctggaggagcggaccgggatcagctgggacctcggcgtggaggacgcctccgagagcaagctgctgaccgtcagcgtgatggacctctcccagatgtacagccccgtcttcgagtacctgtccggggaccgccaggtggaggagtggccgaaggccacgtgcaccggcgactgccccgagcgctgcggctgcaccagctccacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggactacatcaagaccgaggccatcgtctgcgtggagctgacctcccaggagcggcagtgcagcctggtggaggcggggacccgcttcaacctcggcccggtcaccatcaccctgtccgagccccggaacatccagcagaagctgccgcccgagatcatcacgctccacccgcgcatcgaggagggcttcttcgacctgatgcacgtgcagaaggtgctgagcgcctccaccgtctgcaagctccagagctgcacccacggggtgcccggcgacctccaggtgtaccacatcgggaacctgctgaagggcgacaaggtcaacggccacctgatccacaagatcgagccccacttcaacacctcctggatgagctgggacgggtgcgacctggactactactgcaacatgggcgactggccctcctgcacgtacaccggggtgacccagcacaaccacgccagcttcgtgaacctcctgaacatcgagaccgactacacgaagtccttccacttccacagcaagcgggtcaccgcccacggcgacaccccgcagctggacctcaaggcccgccccacctacggggcgggcgagatcacggtgctggtggaggtcgccgacatggagctgcacaccaagaagatcgagatcaccggcctcaagttcgccagcctgacctgcacggggtgctacgcctgctccagcggcatctcctgcaaggtgcggatccacgtggacgagcccgacgagctgaccgtccacgtcaagagcgacgacccggacgtggtggccgcgtccagctccctcatggcccgcaagctggagttcgggaccgacagcaccttcaaggccttctccgccatgcccaagacgagcctgtgcttctacatcgtggagcgggagtactgcaagtcctgcagcaaggaggacacccagaagtgcgtgaacaccaagctcgagcagccccagtccatcctgatcgagcgcaagggcaccatcatcgggaagcagaacaacacgtgcaccgcgaaggccagctgctggctggagtccgtcaagagcttcttctacggcctcaagaacatgctgtccggcatcttcgggaacgtgttcgtgggcatcttcctgttcctcgcccccttcatcctgctgatcctcttcttcatgttcgggtggcggatcctgttctgcttcaagtgctgccgccggacccgcggcctgttcaagtacaagcacctcaaggacgacgaggagaccgggtaccggcgcatcatcgagcggctgaacaacaagaagggcaagaacaagctgctcgacggcgagcgcctggccgaccgccggatcgccgagctgttcagcacgaagacccacatcggg

SEQ ID NO: 12214 - RNA, 2916 nt, synthetic construct
  misc_feature 1..2916: note = derived and/or modified CDS sequence (opt1) from CCHFV(Kosovo/9553/2001, Artificial)__AY675511.1__Gn-4aa-Gc
  source 1..2916: mol_type = other RNA
agcgaggagcccggcgacgactgcatctcccgcacccagctcctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatcgcccggatgagcaaccaccccaagaccaccatggccttcctgttctggttctccctgggctacgtgatcacgtgcatcctctgcaaggccctgttctacagcctgatcatcatcggcaccctcgggaagaagatcaagcagtaccgcgagctgaagccccagacctgcaccatctgcgagaccgcgcccgtgaacgccatcgacgccgagatgcacgacctgaactgctcctacaacatctgcccgtactgcgccagccggctcacgtccgacggcctggcgcgccacgtcaagcagtgccccaagcggaaggagaaggtggaggagaccgagctgtacctcaacctggagcgcatcccctgggtggtccggaagctgctccaggtgagcgagtccaccggggtggccctgaagcgcagcagctggctgatcgtcctcctggtgctgctcaccgtgtccctgagccccgtccagtccgccccggtgggccggaagcccctgttcctcgacagcatcgtgaaggggatgaagaacctgctgaactccacgagcctcgagacctccctgagcatcgaggccccctggggcgccatcaacgtccagtccaccttcaagcccaccgtgagcacggcgaacatcgccctgtcctggagctccgtggagcaccgcggcaacaagatcctcgtcaccgggcggagcgagtccatcatgaagctggaggagcgcaccggcgtgagctgggacctgggggtcgaggacgcctccgagagcaagctcctgaccgtgtccatcatggacctgagccagatgtacagcccggtgttcgagtacctctccggcgaccggcaggtcgaggagtggcccaaggccacgtgcaccggggactgccccgagcgctgcggctgcaccagctccacgtgcctgcacaaggagtggccccacagccggaactggcgctgcaacccgacctggtgctggggcgtggggaccggctgcacgtgctgcggggtggacgtcaaggacctgttcaccgaccacatgttcgtgaagtggaaggtggagtacatcaagaccgaggccatcgtctgcgtggagctgacctcccaggagcgccagtgcagcctcatcgaggcgggcacccggttcaacctggggcccgtgaccatcaccctgtccgagccccgcaacatccagcagaagctgcccccggagatcatcacgctccaccccaagatcgaggagggcttcttcgacctgatgcacgtccagaaggtgctcagcgcctccaccgtgtgcaagctgcagagctgcacccacggcatccccggggacctgcaggtctaccacatcggcaacctcctgaagggggaccgggtgaacggccacctgatccacaagatcgagccccacttcaacacctcctggatgagctgggacggctgcgacctcgactactactgcaacatgggggactggccgtcctgcacgtacaccggcgtgacccagcacaaccacgccgccttcgtcaacctgctgaacatcgagaccgactacacgaagaccttccacttccacagcaagcgcgtgaccgcccacggggacacgccccagctcgacctgaaggcgcggcccacctacggcgccggggagatcaccgtgctggtcgaggtggccgacatggagctccacaccaagaaggtggagatctccggcctgaagttcgccagcctggcctgcaccggctgctacgcgtgctccagcgggatcagctgcaaggtccgcatccacgtggacgagccggacgagctcacggtgcacgtcaagtccagcgaccccgacgtggtggccgcctccaccagcctgatggcccggaagctggagttcggcaccgactccaccttcaaggcgttcagcgccatgcccaagacgtccctctgcttctacatcgtcgagaaggagtactgcaagagctgctccgaggacgacaccaagaagtgcgtggacaccaagctggagcagccccagagcatcctgatcgagcaccgcgggaccatcatcggcaagccgaacgacacgtgccccgccaagacctcctgctggctcgagagcgtgaagtccttcttctacgggctgaagaacatgctgggcagcgtcttcggcaacttcttcatcgggatcctcctgttcctggcccccttcttcctctggatgctgtccttcatgttcggctggaagatcctgttctgcttcaagtgctgccggcgcacccggggcctcttcaagtaccgccacctgaaggacgacgaggagaccgggtaccggcgcatcatcgagcggctgaacaacaagaaggggaagaaccgcctcctggacggcgagcggctggccgaccgcaagatcgcggagctgttcagcacgaagacccacatcggc

SEQ ID NO: 12215 - RNA, 2916 nt, synthetic construct
  misc_feature 1..2916: note = derived and/or modified CDS sequence (opt1) from CCHFV(SPU41/84, Artificial)__AY900142.1__Gn-4aa-Gc
  source 1..2916: mol_type = other RNA
agcgaggagtccagcgacgactgcatctcccgcacccagctgctccggaccgagacggccgagatccacggcgacaactacgggggccccggggacaagatcaccatctgcaacggcagcaccgtggtcgaccagcgcctggggtccgagctgggctgctacaccatcaaccgggtgaagacgttcaagctctgcgagaacagcgccaccggcaagtcctgcgagatcgacagcgtgccggtcaagtgccgccaggggtactgcctgaagatcacccaggagggccgggggcacgtgaagctgtcccgcggcagcgaggtggtcctcgacgcgtgcgacacctcctgcgaggtgatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtcatcacgtgcatcatctgcaaggtgatcttctacctgctcatcatcgtgggcaccctggggaagcgcttcaagcagtaccgggagctgaagccccagacctgcaccatctgcgagaccacgcccgtcaacgccatcgacgccgagatgcacgacctcaactgctcctacaacatctgcccctactgcgcgagccgcctgacctccgacggcctggcccggcacgtgacccagtgcccgaagcgcaaggagaaggtggaggagaccgagctctacctgaacctggagcggatcccctgggtcgtgcgcaagctcctccaggtgagcgagtccacgggggtcgccctgaagcggagcagctggctggtggtgctgctggtcctcctgaccgtgtccctgagccccgtgcagtccgcccccatcagccgccggcccctcttcctggactccatcgtcaagggcatgaagaacctgctcaacagcacctccctggagaccagcctgtccatcgaggcgccctggggcgccatcaacgtgcagagcacgtacaagcccaccgtctccaccgccaacatcgccctcagctggtccagcgtggagcaccgcgggaacaagatcctggtgtccggccggagcgagtccatcatgaagctggaggagcgcaccgggatcagctgggacctcggcgtcgaggacgcctccgagagcaagctgctgacggtgagcgtgatggacctctcccagatgtacagccccgtcttcgagtacctgtccggggaccgccaggtggaggagtggccgaaggcgacctgcaccggcgactgccccgagcggtgcgggtgcaccagctccacgtgcctgcacaaggagtggccccacagccgcaactggcggtgcaaccccacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgacctcccaggagcgccagtgcagcctgatcgaggccgggacccggttcaacctcggcccggtgaccatcacgctgtccgagccccgcaacatccagcagaagctgccgcccgagatcatcaccctccacccgcggatcgaggaggggttcttcgacctgatgcacgtccagaaggtgctgagcgcctccaccgtgtgcaagctccagagctgcacccacggcgtccccggcgacctccaggtgtaccacatcgggaacctgctgaagggcgacaaggtgaacgggcacctggtccacaagatcgagccccacttcaacacgtcctggatgagctgggacggctgcgacctggactactactgcaacatgggcgactggccctcctgcacctacaccggggtgacccagcacaaccacgccagcttcgtgaacatgctcaacatcgagacggactacaccaagaacttccacttccactccaagcgcgtcaccgcgcacggcgacaccccgcagctggacctgaaggcccggcccacgtacggggccggcgagatcaccgtgctcgtggaggtcgccgacatggagctgcacaccaagaagatcgagatcagcgggctgaagttcaccagcctcacgtgcaccggctgctacgcctgctccagcggcatctcctgcaaggtgcgcatccacgtggacgagcccgacgagctgaccgtccacgtcaagagcgaggacccggacgtggtggcggcctccagctccctgatggcccggaagctcgagttcgggaccgacagcacgttcaaggccttctccgccatgcccaagaccagcctgtgcttctacatcgtggagcgcgagtactgcaagtcctgcagcgaggaggacacccagaagtgcgtgaacaccaagctggagcagccccagtccatcctcatcgagcggaagggcacgatcatcgggaagcagaacaacacgtgcaaggcgaaggccggctgctggctggagagcgtcaagtccttcttctacgggctgaagaacatgctcagcggcatcttcggcaacgtgttcatcgggatcttcctgttcctggcccccttcatcctcctgatcctgttcttcatgttcggctggcgcatcctcttctgcttcaagtgctgccggcgcacccgggggctgttcaagtaccgccacctgaaggacgacgaggagaccggctaccggaagatcatcgagcgcctcaacaacaagaaggggaagaacaagctgctggacggcgagcggctcgccgaccgccgcatcgcggagctgttctccaccaagacccacatcggc

SEQ ID NO: 12216 - RNA, 2916 nt, synthetic construct
  misc_feature 1..2916: note = derived and/or modified CDS sequence (opt1) from CCHFV(UG3010, Artificial)__AY900143.1__Gn-4aa-Gc
  source 1..2916: mol_type = other RNA
gccgagggcgtgagcaacgactgcgtgtcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcatcgtgtgcaaggtgctgttctacctcctgatcgtcatcggcaccctgagcaagaagctcaagcagtaccgcgagctgaagccccagacctgcatcgtgtgcgagtccacccccgtgaacgccatcgacgccgagatgcacgagctgaactgcaactacaacatctgcccctactgcgcgagccggctcacctccgacgggctggtccgccacgtgaaccagtgcccgaagcggaaggagaaggtggaggagacggagctgtacctcaacctggagcgcatcccctggctggtccggcgcctcctccaggtgagcgagtccaccggcatggccctgaagcggagctgctggatgaccaccctcctgatcctgctcgtggtctccctgagccccgtgcagagcgcccccgtcgggcgcaagccgctgtacctcgactccatcgccaagggcatgaagtccctgctgaacagcacgaacctcgagaccagcctgtccatcgaggcgccctggggcgccatcaacgtgcagagcaccttcaagcccaccgtgtccgccgccaacatcgccctgagctggtccagcgtcgagcaccgggggaacaagatcctcgtgtccggccgcagcgagtccatcatgaagctggaggagcggacggggatcagctggtccctgggcgtggaggacgcgagcgagtccaagaccctcaccgtcagcgtgatggacctgtcccagatgtacagccccgtgttcgagtacctgagcggggaccgccaggtcgaggagtggccgaaggcgacctgcacgggcgactgccaggagcggtgcgggtgcacctccagcacgtgcctccacaaggagtggccccactcccgcaactggcggtgcaaccccacctggtgctggggcgtgggcaccgggtgcacgtgctgcggcctggacgtgcgcgacctgttcaccgactacatgatggtcaagtggaaggtggagtacgtgaagaccgaggccatcatgtgcgtcgagctgaccagccaggagcgccagtgctccctcatcgaggccgggacccggttcaacctgggccccgtgaccatcaccctgagcgagccgcgcaacatccagcagcggctcccctccgagatcgtgaccctgcaccccaagatcgaggaggggttcttcgacctgatgcacgtccagaaggtgctcagcgcctccacggtgtgcaagctgcagagctgcacccacggcgtccccggcgacctccaggtgtaccacgtggggaacctcctgaagggcgacaaggtcaacgggcactccatccacaagatcgagagccacttcaacacctcctggatgagctgggacggctgcgacctggactacttctgcaacatgggcgactggccgtcctgcacctacacgggggtgacccagcacaaccgcgccgccttcatcaacatgctcaacatcgagaccgactacaccaagacgttccacttccacagcaagcgggtgaccgcccacggcgacacgccccagctggacctgaaggcccgccccacctacggggccggcgaggtcaccgtgctcgtggaggtcgcggacctggagctgcacaccaagaagatcgaggtgtccgggctcaagttcgccagcctgacctgcagcggctgctacgcctgctccagcggcatctcctgcaaggtgcggatccacgtcaacgagcccgacgagttcaccgtgcacgtcaagagctccgacccggacgtggtggccgccgggagctccctgatggcgcgcaagatcgagttcggcgccgacagcacgttcaaggccttctccagcatgcccaagaactccctctgcttctacatcgtggagcgggactactgcagctcctgcaccaacgacgacacccagaagtgcgtcgacaccaagctggagcacccccagagcatcctgatcgagcacaaggggacgatcatcggcaagcagaacgacacgtgctccaccaagaccagctgctggctcgagtccgtcaagagcttcttctacgggctgaagaacatgctgggcggcatcttcgggaacgtgttcctcggcatcttcctgttcctggccccgttcgcgctcctgatcttcttcttcttcttcgggtggcgcctgctgttctgcctgaagtgctgccggcgcacccggggcctgctcaagtacaagcagctgaaggacgaggaggaggccgggtacaagaagatcatcgagcgcctgaacgacaagaagggcaagtcccggctgttcgacggcgagcgcctggccgaccggaagatcgccgagctgttcagcaccaagacccacatcggg

SEQ ID NO: 12217 - RNA, 2916 nt, synthetic construct
  misc_feature 1..2916: note = derived and/or modified CDS sequence (opt1) from CCHFV(Hy13, Artificial)__AY900145.1__Gn-4aa-Gc
  source 1..2916: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacctgcatcctgtgcaaggtcatcttctacctgctcatcgtggtgggcaccctggggaagaagttcaagcagtaccgcgagctgaagccccagacgtgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctgcaggtgagcgagtccaccggggtcgccctgaagcgcagctcctggctcgtggtgctgctggtcctcctgaccgtgagcctgtcccccgtgcagagcgcccccatcggccggaagccgctcttctccgacagcatcgtcaaggggatgaagaacctgctgaactccacgagcctcgagacctccctgagcatcgaggcgccctggggcgccatcaacgtgcagtccaccttcaagcccaccgtgagcgccgccaacatcgccctgtcctggagctccgtcgagcaccgcggcaacaagatcctcgtgagcgggcggtccgagagcatcatgaagctggaggagcgcacgggcatcagctgggacctgggggtcgaggacgcgtccgagagcaagctcctgaccgtgtccatcatggacctgagccagatgtactcccccgtgttcgagtacctcagcggcgaccggcaggtcgaggagtggccgaaggccacctgcaccggggactgccccgagcgctgcggctgcacgtccagcacctgcctgcacaaggagtggccccactcccggaactggcgctgcaaccccacctggtgctggggcgtggggaccggctgcacgtgctgcgggctggacgtgaaggacctcttcaccgaccacatgttcgtcaagtggaaggtggagtacatcaagaccgaggccatcgtgtgcgtcgagctgaccagccaggagcgccagtgctccctgatcgaggccggcacgcggttcaacctggggccggtgaccatcaccctcagcgagccccgcaacatccagcagaagctgccccccgagatcgtgaccctgcacccgcggatcgaggagggcttcttcgacctcatgcacgtcaagaaggtgctgtccgccagcaccgtgtgcaagctgcagtcctgcacgcacggcgtccccggggacctccaggtgtaccacatcggcaacctgctgaagggggacaaggtgaacggccacctcatccacaagatcgagccccacttcaacaccagctggatgtcctgggacggctgcgacctggactactactgcaacatgggggactggcccagctgcagctacaccggcgtcacccagcacaaccacgcggccttcgtgaacatgctgaacatcgagacggactacaccaagatcttccacttccactccaagcgcgtgaccgcccacggggacaccccgcagctcgacctgaaggcccggcccacgtacggcgccggggagatcaccgtcctggtggaggtggcggacatggagctccacaccaagaagatcgagatcagcggcctgaagttcgcctccctgacctgcacgggctgctacgcctgcagctccgggatcagctgcaaggtccgcatccacgtggacgagcccgacgagctcaccgtgcacgtcaagtccgaggacccggacatcgtggccgccagctccagcctgatggcgcggaagctggagttcggcaccgactccaccttcaaggccttcagcgccatgcccaagacgtccctctgcttctacatcgtggagcgcgagtactgcaagagctgctccaaggaggacacccagaagtgcgtcaacaccaagctggagcagccccagagcatcctgatcgagcacaaggggaccatcatcggcaagcagaacgacacgtgcacctccaaggccgggtgctggctcgagagcgtgaagtccttcttctacggcctgaagaacatgctgagcggcatcttcgggaacgtgttcatcggcatcttcctcttcctggcgcccttcatcctgctcatcctgttcttcatgttcgggtggcggatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggcgagcgcctggccgaccggaagatcgccgagctcttcagcacgaagacccacatcggg

SEQ ID NO: 12218 - RNA, 2916 nt, synthetic construct
  misc_feature 1..2916: note = derived and/or modified CDS sequence (opt1) from CCHFV(Semunya, Artificial)__DQ094832.1__Gn-4aa-Gc
  source 1..2916: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgccatcgacgccgagatgcacgagctgaactgcaactacaacatctgcccctactgcgcgtcccggctcaccagcgacggcctggtgcgccacgtgacccagtgcccgaagcggaaggagaaggtcgaggagacggagctgtacctcaacctggagcgcatcccctggctggtgcggcgcctcctccaggtgtccgagagcaccgggatggccctgaagcggtcctgctggatgaccaccctcctgatcctgctcgtcgtgagcctgtcccccgtccagagcgcccccgtgggccgcaagccgctgttcctcgacagcatcgccaaggggaagaagtccctgctgaacagcacgaacctcgagacctccctgagcatcgaggcgccctggggcgccatcaacgtgcagtccaccttcaagcccaccgtcagcgccgccaacatcgccctgtcctggagctccgtggagcaccggggcaacaagatcctcgtgagcgggcgctccgagagcatcatgaagctggaggagcggacgggcatctcctggagcctgggggtcgaggacgcgtccgagagcaagaccctcaccgtgtccgtgatggacctgagccagatgtactcccccgtcttcgagtacctgagcggcgaccgccaggtggaggagtggccgaaggcgacctgcacgggggactgccccgagcggtgcggctgcaccagctccacgtgcctccacaaggagtggccccacagccgcaactggcggtgcaaccccacctggtgctggggcgtggggaccggctgcacgtgctgcgggctggacgtccgcgacctgttcaccgactacatgatggtgaagtggaaggtggagtacgtcaagaccgaggccatcatgtgcgtggagctgacctcccaggagcgccagtgcagcctcatcgaggccggcacccggttcaacctggggccggtgaccatcaccctgtccgagccccgcaacgtccagcagcggctccccagcgagatcgtgaccctgcaccccaagatcgaggagggcttcttcgacctgatgcacgtgcagaaggtcctcttctgcaagtactccctgcaggccacgagctgcacccacggcgtgccgggggacctccaggtgtaccacgtcggcaacctgctgaagggggacaaggtgaacggccactccatccacaagatcgagagccacttcaacacctcctggatgagctgggacggctgcgacctggactacttctgcaacatgggggactggccctcctgcacctacacgggcgtgacccagcacaaccgcgccgccttcgtcaacatgctcaacatcgagaccgactacaccaagacgttccacttccacagcaagcgggtgaccgcccacggggacacgccccagctggacctgaaggcccgccccacctacggcgccggggaggtgaccgtcctcgtggaggtggcggacctggagctgcacaccaagaagatcgaggtctccggcctcaagttcgccagcctgacctgctccggctgctacgcctgcagcagcgggatctcctgcaaggtgcggatccacgtgaacgagccggacgagttcaccgtccacgtcaagagcaacgaccccgacgtggtggccgccggctccagcctgatggcgcgcaagatcgagttcggggccgactccacgttcaaggccttcagctccatgcccaagaacagcctctgcttctacatcgtggagcgggactactgctccagctgcaccgacgacgacacccagaagtgcgtgaacatcaagctggagcacccgcagtccatcctgatcgagcacaagggcaccatcatcgggaagcagaacgacacgtgccccaccaagaccagctgctggctcgagtccgtcaagagcttcttctacggcctgaagaacatgctgggcgggatcttcggcaacgtgttcctcgggatcttcctgttcctggcccccttcgcgctcctgatcctgttcttcttcttcggctggcgcctcctgttctgcctgaagtgctgccggcgcacccgggggctcctgaagtacaagcagctgaaggacgaggaggaggccggctacaagaagatcatcgagcgcctcaacgacaagaagggcaagtcccggctgttcgacggggagcgcctggccgaccggaagatcgccaagctgttcagcacgaagacccacatcggc

SEQ ID NO: 12219 - RNA, 2916 nt, synthetic construct
  misc_feature 1..2916: note = derived and/or modified CDS sequence (opt1) from CCHFV(SPU128/81/7, Artificial)__DQ157174.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgagagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctcaagcgcagcagctggctgatcgtcctgctcgtgctgttcacggtgtccctgagccccgtccagtccgcgccgatcggccggaagcccctcttcctggacagcatcgtgaaggggatgaagaacctgctcaactccaccagcctggagacctccctgagcatcgaggccccctggggcgccatcaacgtgcagtccacctacaagcccacggtcagcaccgccaacatcgccctctcctggagctccgtggagcaccgcggcaacaagatcctggtgagcgggcggtccgagagcatcatgaagctggaggagcgcaccggcatctcctgggacctcggggtcgaggacgcgagcgagtccaagctgctgaccgtgagcgtcatggacctcagccagatgtactccccggtgttcgagtacctgagcggcgaccgccaggtggaggagtggcccaaggccacgtgcaccggggactgccccgagcggtgcggctgcacctccagcacgtgcctgcacaaggagtggccccactcccgcaactggcggtgcaacccgacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcgccagtgctccctgatcgaggccggcacccggttcaacctcgggcccgtcaccatcaccctgagcgagccccgcaacatccagcagaagctgcccccggagatcatcacgctccacccccggatcgaggagggcttcttcgacctgatgcacgtgcagaaggtgctgtccgccagcaccgtctgcaagctccagtcctgcacccacggcgtgcccggggacctccaggtgtaccacatcggcaacctgctgaagggggacaaggtcaacggccacctgatccacaagatcgagccccacttcaacaccagctggatgtcctgggacggctgcgacctggactactactgcaacatgggggactggccgagctgcacgtacaccggcgtgacccagcacaaccacgcgtccttcgtgaacctcctgaacatcgagaccgactacacgaagaacttccacttccacagcaagcgcgtcaccgcccacggggacacgccccagctggacctcaaggcccggcccacctacggcgccggggagatcaccgtgctggtggaggtcgccgacatggagctgcacaccaagaagatcgagatctccggcctcaagttcgcgagcctgacctgcaccggctgctacgcctgcagctccgggatcagctgcaaggtgcgcatccacgtggacgagccggacgagctgacggtccacgtgaagtccgacgaccccgacgtggtcgccgccagctccagcctcatggcccggaagctggagttcggcaccgactccaccttcaaggcgttcagcgccatgcccaagacctccctgtgcttctacatcgtggagcgcgagcactgcaagagctgctccgaggaggacacgaagaagtgcgtgaacaccaagctcgagcagccccagagcatcctgatcgagcacaaggggaccatcatcggcaagcagaactccacgtgcaccgccaaggccagctgctggctggagtccgtcaagagcttcttctacgggctcaagaacatgctgtccggcatcttcggcaacgtgttcatcgggatcttcctgttcctcggcccgttcatcctgctgatcctcttcttcatgttcgggtggcggatcctgttctgcttcaagtgctgccgccggacccgcggcctgctcaagtaccggcacctgaaggaggacgaggagaccgggtaccgccggatcatcgagcgcctgaacaacaagaagggcaagaacaagctcctggacggcgagcggctggcggaccgccgcatcgccgagctgttcagcaccaagacgcacatcggg

SEQ ID NO: 12220 - RNA, 2916 nt, synthetic construct
  misc_feature 1..2916: note = derived and/or modified CDS sequence (opt1) from CCHFV(ROS/HUVLV-100, Artificial)__DQ206448.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggatgaagaacctgctcaactccacgagcctggagacctccctgagcatcgaggccccctggggcgccatcaacgtgcagtccaccttcaagccgaccgtcagcacggccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgaccgtctccatcatggacctcagccagatgtacagccccgtgttcgagtacctgtccggcgaccgccaggtggaggagtggcccaaggccacgtgcaccggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcaccctctccgagccccggaacatccagcagaagctgccgcccgagatcatcacgctgcaccccaaggtggaggagggcttcttcgacctcatgcacgtccagaaggtgctgagcgcgtccaccgtgtgcaagctgcagagctgcacccacggcatccccggggacctccaggtctaccacatcggcaacctgctgaagggggaccgcgtgaacggccacctcatccacaagatcgagccgcacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaccttccacttccacagcaagcgggtgaccgcccacggggacacgccccagctggacctgaaggcccgcccgacctacggcgcgggggagatcaccgtgctcgtcgaggtggccgacatggagctgcacaccaagaaggtggagatctccggcctgaagttcgccagcctcgcctgcaccggctgctacgcctgctccagcgggatcagctgcaaggtccggatccacgtggacgagcccgacgagctgacggtgcacgtcaagtccagcgaccccgacgtggtggcggcctccaccagcctgatggcccgcaagctcgagttcggcaccgactccaccttcaaggccttcagcgcgatgcccaagacgtccctgtgcttctacatcgtcgagcgggagtactgcaagagctgctccgaggaggacacccagaagtgcgtggacaccaagctggagcagccgcagagcatcctcatcgagcacaaggggaccatcatcggcaagcagaacgacacgtgcaccgccaaggcctcctgctggctggagagcgtgaagtccttcttctacgggctgaagaacatgctcggcagcgtcttcggcaacttcttcatcgggatcctgctgttcctcgcccccttcgtgctgctggtgctgttcttcatgttcggctggaagatcctcttctgcttcaagtgctgccgccggacccgcgggctgctcaagtaccggctgctgaaggacgacgaggagaccggctaccgccggatcatcgagcgcctcaacaacaagaaggggaagaaccggctgctggacggcgagcgcctcgccgaccggaagatcgcggagctgttctccacgaagacccacatcggc

SEQ ID NO: 12221 - RNA, 2916 nt, synthetic construct
  misc_feature 1..2916: note = derived and/or modified CDS sequence (opt1) from CCHFV(AP92, Artificial)__DQ211625.1__Gn-4aa-Gc
  source 1..2916: mol_type = other RNA
agcgagggcggggacggcgggtgcatctcccgcacccagctgatcaagaccgagacggccgaggtgcacggcgacgactacgggggccccggcgagaagatcaccatctgcaacgggagcaccatcgtcgaccagcggctcggctccgagctggggtgctacaccatcaaccgcatcaagagcttcaagctgtgcgagaactccgcccagggcaagaactgcgagatcgacagcgcgccggtgcagtgccggcaggggtactgcctcaagatctcccaggagggccgcggccacgtgaagctgagccgggggtccgagatcgtcctggacgtgtgcgacacgagctgcgagatcatgatccccaagggcaccggggacatcctcgtggactgctccggcggccagcagcacttcctgcagagcaacctggtcgacctcgggtgccccaacatccccctgctgggcaagatggccatctacatctgccgcatgtccaaccacccgaagaccaccatggccttcctcttctggttcagcttcgggtacgtgatcacgtgcatcctgtgcaagaccctgttctacatcctcatcatcatcggcaccctggggaagaagctgaagcagtaccgggagctcaagccccagacctgcacgatctgcgagtccgtgcccgtcaacgccatcgacgccgagatgcacgacctgaactgcagctacaacatctgcccctactgcgcgtcccgcctgaccagcgagggcctcacccggcacgtgaaccagtgcccgaagcgcaaggagaaggtggaggagaccgagctgtacctgaacctcgagcggatcccctggatcgtccgcaagctgctccaggtgtccgagagcacgggcgtggccctcaagcggagctcctggatgatcgtcctgctgatcctcctgatcgtgagcatgtcccccgtgcagagcgcccccatctcccgcaagccgctgttcctcgacagcatcgccaagggggtcaagaacctgctgaactccaccagcctcgagacctccctgagcatcgaggcgccctggggcgccatcaacgcccagtccacctacaagcccacggccagctccgccaacatcgcgctgacctggagctccgtggagcaccgggggaacaagatcctcgtgagcggccgctccgagagcatcatgaagctggaggagcggaccgggatctcctggaacctgggcgtcgaggacgccagcgagagccgcaccctcacgatctccgtgatggacctgagccagatgtactcccccgtgttcgagtacctgagcggcgaccggcaggtcgaggagtggccgaaggcgacctgcaccgggaactgccccgagcgctgcggctgcacctccagcacgtgcctctacaaggagtggccccactcccggaactggcgctgcaaccccacctggtgctggggcgtggggaccgggtgcacgtgctgcggcctggacgtcaaggagctgttcaccgaccacatgctcgtgaagtggaaggtggagtacatcaagaccgaggccatcgtctgcgtggagctgaccagccaggagcgccagtgctccctgatcgaggccggcacccggttcagcctggggccggtgacgatcaccctctccgagccccgcaacatccagcagaagctgccgcccgagctgatcaccctccaccccaagatcgaggacggctacttcgacctgatgcacgtccagaaggtgatgagcgcctccaccgtgtgcaagctgcagagctgcacccacggggtccccggcgacctccagatctaccacgtgggcaacctgctgaagggggaccgggtgaacggccacctcatccacaaggtcgagccccacctgaacacgtcctggatgagctgggacgggtgcgacctggactacttctgcaacatgggcgactggccctcctgcacctacaccggggtgacccagcacaaccacgccgccttcgccaacctcctgaacatcgagacggactacaccaagaccttccacttccacagcaagcgcgtgaccgcccacggcgacacgccgcagctggacctcaaggcgcggccccgctacggcgccggggagatcaccgtcctggtggaggtggccgacatggagctgcacaccaagaaggtcgaggtgaccggcctcaagttcgccagcctgacgtgctccgggtgctacgcctgcagctccggcatcagctgcaaggtgcggatccacgtcgacgagcccgacgagctgaccgtgcacgtgaagtccagcgacccggacatcgtcgcggcctccagctccctcatggcccgcaagatcgagttcggggtggacagcaccttcaaggccttctccagcatgcccaaggactccctgtgcttctacatcgtggagcgggactactgcaacagctgcaagaacgaggagacccagcgctgcgtcaacgcgaagctggagcagccccagtccatcctcatcgagcacacgggcaccatcatcggcaagcagaacgacacgtgcgggagccggacctcctgctggctggacagcttcaagtccttcttctacggcctcaagagcatgctgagcgggatcttcggcaacgtgttcctggggatcttcctgttcctcgcccccttcgccctgctgctgttcttcttcttcttcggctggcgcatcctgttctgcttcaagtgctgccggcgcacccggggcctgttcaagtaccgccacatcaaggacgacgaggaggtggggtacaagaagatcatcgagcggctcaacaacaagaagggcaagcaccgcctgctggacggggagcggctcgccgaccgcaagatcgccgagctgttctccaccaagacccacatcggc

SEQ ID NO: 12222 - RNA, 2916 nt, synthetic construct
  misc_feature 1..2916: note = derived and/or modified CDS sequence (opt1) from CCHFV(ArD8194, Artificial)__DQ211626.1__Gn-4aa-Gc
  source 1..2916: mol_type = other RNA
gccgagggcgggagcaacgactgcgtgtcccgcacccagctggtcaagaccgaggtggccgagatccacgaggacagctacggcgggcccggcgagaagatcacgatctgcaacgggtccaccatcgtggaccagcggctcggcagcgagctgggctgctacaccatcaaccgcgtccggacctacaagctgtgcgagaactccgcgacggagaagtcctgcgagatcgacagcgtgccggtgaagtgcaagcaggggttctgcctcaagatcacccaggagggccgcgggcacgtcaagctgagccggggcaccgagatcgtgctggacgtgtgcgacacctcctgcgagctcatgatccccaaggggacgggcgacatcctggtcgactgcagcggcgggcagcagcacttcctgcaggacaacctcatcgacctgggctgccccaacatccccctgctcgggcgcaccgccatctacgtgtgccggatgtccaaccacccgaagaccaccatggccttcctgttctggttcagcttcggctacgtgatcacgtgcgtcgtgtgcaaggtgctgttctacctcctgatcgtcatcggcaccctggggaagcgcctcaagcagtaccgggagctgaagccccagacctgcatcgtgtgcgagtccatccccgtgaacgccatcgacgccgagatgcacgacctgaactgcaactacaacatctgcccctactgcgcgagccgcctcacctccgacggcctggtccggcacgtgacgcagtgcccgaagcgcaaggagaaggtggaggagaccgagctgtacctcaacctggagcggatcccctggctggtccgcaagctcctccaggtgagcgagtccaccggggtggccctgaagcggagctgctggatgatcaccctgctgatcctgctcacggtctccatgagccccgtgcagagcgcccccgtcggccgcaagccgctgttcctggaccggatcgccaaggggatgaagtccctcctgaacagcacctccctggagaccagcctctccatcgaggcgccctggggcgccatcaacgtgcagagcaccttcaagcccacggtgtccgccgccaacatcgccctgagctggtccagcgtcgagcacaagggcaacaagatcctggtgtccgggcgcagcgagtccatcatgaagctcgaggagcggaccggcatcagctggtgcctgggggtggaggacgcgtccgagagcaagaccctgaccgtctccgtgatggacctcagccagatgtactcccccgtgttcgagtacctgagcggcgaccgccaggtcgaggagtggccgaaggccacgtgcaccggggactgccccgagcggtgcggctgcaccagctccacgtgcctgcacaaggagtggccccacagccgcaactggcgctgcaaccccacctggtgctggggcgtggggaccggctgcacgtgctgcgggctcgacgtgaaggacctgttcaccgactacatgctggtcaagtggaaggtggagtacatcaagaccgaggccatcatctgcgtggagctgacctcccaggagcggcagtgcagcctcatcgaggccggcacccgcttcaacctggggccggtcaccatcaccctgtccgagccccggaacgtgcagcagcgcctcccgcccgagatcatcacgctgcaccccaagatcgaggagggcttcttcgacctgatgcacgtgcagaaggtcatgagcgcctccaccgtgtgcaagctccagagctgcacccacggcgtgcccggggacctgcaggtctaccacgtgggcaacctgctcaagggggacaaggtgaacggccactccatccacaagatcgagagccacctgaacacctcctggatgagctgggacggctgcgacctggactacttctgcaacatgggggactggccctcctgcacgtacaccggcgtcacccagcacaaccacgcggccttcatcaacatgctcaacatcgagaccgactacacgaagaccttccacttccacagcaagcgggtgaccgcccacggggacacgccccagctggacctgaaggcccgcccggcctacggcgcgggggagatcaccgtgctcgtcgaggtggccgacctggagctgcacaccaagaagatcgaggtgtccggcctcaagttcgccagcctgtcctgcagcggctgctacgcctgcagctccgggatcagctgcaaggtccggatccacgtgaacgagcccgacgagttcaccgtgcacgtcaagtccaacgaccccgacgtggtggccgcgggcagctccctgatggcccgcaagatcgagagcggggccgactccaccttcaaggccttcagctccatgccgaagaacagcctctgcttctacatcgtcgagcgggactactgctccagctgcacggacgacgacacccagaagtgcgtggacatcaagctggagcacccccagtccatcctgatcgagcacaagggcaccatcatcgggaagcagaacgacacgtgccccaccaagaccagctgctggctcgagtccatcaagagcttcttctacggcctgaagaacatgctgtccggcatcttcgggaacgtgttcctcggcatgctgctgttcctcgcgcccttcatcctgctgatcctcttcttcttcttcgggtggcgcctgctgttctgcctcaagtgctgccggcgcacccggaagctgctgaagtacaagcacctccgcgacgaggaggagagcggctacaagaagatcatcgagcggctgaacgacaagaaggggaagtcccgcctgttcgacggcgagcggctcgccgaccgcaagatcgccgagctgttcagcaccaagacgcacatcggc

SEQ ID NO: 12223 - RNA, 2916 nt, synthetic construct
  misc_feature 1..2916: note = derived and/or modified CDS sequence (opt1) from CCHFV(ArD15786, Artificial)__DQ211627.1__Gn-4aa-Gc
  source 1..2916: mol_type = other RNA
gccgagggcgggagcaacgactgcgtgtcccgcacccagctggtcaagaccgaggtgacggagatccacgaggacagctacggcgggcccggcgagaagatcaccatctgcaacgggtccaccatcgtggaccagcggctcggcagcgagctgggctgctacaccatcaaccgcgtccggacgtacaagctgtgcgagaactccgccaccgagaagtcctgcgagatcgacagcgtgccggtgaagtgcaagcaggggttctgcctcaagatcacccaggagggccgcgggcacgtcaagctgagccggggcaccgagatcgtgctggacgtgtgcgacacgtcctgcgagctcatgatccccaaggggaccggcgacatcctggtcgactgcagcggcgggcagcagcacttcctgcaggacaacctcatcgacctgggctgccccaacatccccctgctcgggcagaccgcgatctacgtgtgccgcatgtccaaccacccgaagaccacgatggccttcctgttctggttcagcttcggctacgtgatcacgtgcgtcgtgtgcaaggtgctgttctacctcctgatcgtcatcggcaccctggggaagcggctcaagcagtaccgcgagctgaagccccagacctgcatcgtgtgcgagtccatccccgtgaacgccatcgacgccgagatgcacgacctgaactgcaactacaacatctgcccctactgcgccagccggctcacctccgacggcctggtccgccacgtgacccagtgcccgaagcggaaggagaaggtggaggagaccgagctgtacctcaacctggagcgcatcccctggctggtccggaagctcctccaggtgagcgagtccaccggggtggcgctgaagcgcagctgctggatcatcacgctgctgatcctgctcaccgtctccatgagccccgtgcagagcgcccccgtcggccggaagccgctgtccctggacagcatcgccaaggggatgaagtccctcctgaacagcacctccctggagaccagcctctccatcgaggccccctggggcgcgatcaacgtgcagagcacgttcaagcccaccatctccgccgccaacatcgccctgagctggtccagcgtggagcacaagggcaacaagatcctggtctccgggcgcagcgagtccatcatgaagctcgaggagcggaccggcatcagctggtgcctgggggtggaggacgcctccgagagcaagaccctgacggtgtccgtcatggacctcagccagatgtacagccccgtgttcgagtacctgtccggcgaccgccaggtggaggagtggccgaaggcgacctgcaccggggactgccccgagcggtgcggctgcaccagctccacgtgcctgcacaaggagtggccccacagccgcaactggcggtgcaaccccacctggtgctggggcgtcgggaccggctgcacgtgctgcgggctcgacgtgaaggacctgttcaccgactacatgctggtgaagtggaaggtcgagtacatcaagaccgaggccatcatctgcgtggagctgacctcccaggagcgccagtgcagcctcatcgaggccggcacccgcttcaacctggggccggtgaccatcacgctgtccgagccccggaacgtccagcagcgcctcccgcccgagatcatcaccctgcaccccaagatcgaggagggcttcttcgacctgatgcacgtgcagaaggtgatgagcgcctccaccgtctgcaagctccagagctgcacccacggcgtgcccggggacctccaggtgtaccacgtcggcaacctgctgaagggggacaaggtgaacggccactccatccacaagatcgagagccacctgaacacgtcctggatgagctgggacggctgcgacctggactacttctgcaacatgggggactggccctcctgcacctacaccggcgtgacccagcacaaccgggccgcgttcatcaacatgctcaacatcgagacggactacaccaagaccttccacttccacagcaagcgcgtcaccgcccacggggacacgccccagctggacctgaaggcccggccgacctacggcgccggggagatcaccgtgctcgtggaggtcgccgacctggagctgcacaccaagaagatcgaggtgtccggcctcaagttcgcgagcctgacgtgcagcggctgctacgcctgctccagcgggatctcctgcaaggtgcgcatccacgtcaacgagcccgacgagttcaccgtgcacgtcaagagcaacgaccccgacgtggtggccgccggctccagcctgatggcccggaagatcgagtccggggcggacagcaccttcaaggccttctccagcatgccgaagaactccctctgcttctacatcgtggagcgcgactactgcagctcctgcaccgacgacgacacgcagaagtgcgtcgacatcaagctggagcacccccagagcatcctgatcgagcacaagggcaccatcatcgggaagcagaacgacacgtgccccaccaagacctcctgctggctcgagagcatcaagtccttcttctacggcctgaagaacatgctgagcggcatcttcgggaacatcttcctcggcatgctgctgttcctcgcccccttcgtgctgctgatcctcttcttcttcttcgggtggcggctgctgttctgcctcaagtgctgccgccggacccgcaagctgctgaagtacaagcacctccgggacgaggaggagtccggctacaagaagatcatcgagcgcctgaacgacaagaagggcaagagccggctgttcgacggggagcgcctcgccgaccggaagatcgcggagctgttcagcaccaagacccacgtgggc

SEQ ID NO: 12224 - RNA, 2916 nt, synthetic construct
  misc_feature 1..2916: note = derived and/or modified CDS sequence (opt1) from CCHFV(ArD39554, Artificial)__DQ211628.1__Gn-4aa-Gc
  source 1..2916: mol_type = other RNA
agcgagtccaacaacaacgactgcgtgagccgcacccagctgatcaagaccgagaacgccgagatccacggcgacgactacgggggccccggggagaagatcacgatctgcaacggctccaccatcgtcgagcagcggctcgggagcgagctgggctgctacaccatcaaccgcatcaagtccttcaagctgtgcgagaacagcgcctccggcaaggggtgcgagatcgacagcaccccggtgaagtgcaagcagggcttctgcctcaagatcacgcaggaggggcggggccacgtgaagctgtcccgcgggagcgagatcatcctggacgtctgcgactccagctgcgagatgatgatccccaagggctccggcgacatcctcgtggactgcagcgggggccagcagcacttcctgcaggacaacctggtggacctcgggtgccccaacgtccccctgctgggcaagatggcgatctacatctgccggatgtccaaccacccgaagaccaccatggccttcctcttctggttcagcttcggctacgtgatcacgtgcatcttctgcaaggtgatcttctacgtcctgatcatcatcgggaccctgggcaagcgcatcaagcagtaccgggagctcaagccccagacctgcaccatctgcgaggccacccccgtgaacgccatcgacgccgagatgcacgacctgaactgctcctacaacatctgcccctactgcgcgagccgcctgacgtccgaggggctcgtgcggcacgtcacccagtgcccgaagcgcaaggagaagatcgaggagaccgagctgtacctgaacctcgagcggatcccctggttcgtgcgcaagctgctccaggtgagcgagagcaccggcgtcgccctcaagcggtccagctggctggtgacgctgctcgtgctgctgaccgtctccctcagccccgtgcagtccgcccccatcgggcgcaagccgctgttcctggacagcaccgccaagtccatgaagtccctcctgaacagcaccagcctggagacgtccctcagcatcgaggcgccctggggcgccatcaacgtgcagtccaccttcaagcccaccgccagcaccgccaacatcgccctgtcctggagctccgtcgagcaccggggcaacaagatcctggtgacggggcgcagcgagtccatcatgaagctcgaggagcggaccggcatcagctggaacctgggggtggaggacgcgagcgagtccaagaccctgaccgtcagcgtgatggacctctcccagatgtacagcacggtcttcgagtacctgtccggcgaccgccaggtggaggagtggcccaaggcgacctgcaccggggactgcccggagcggtgcggctgcaccagctccacgtgcctgcacaaggcctggccccacagccgcaactggcggtgcaaccccacctggtgctggggcgtggggaccggctgcacgtgctgcgggctcgacgtcaagaacctgttcaccgactacatgctgatcaagtggaaggtggagttcatcaagaccgaggccatcgtgtgcgtcgagctcacctcccaggagcgccagtgcagcctgatcgaggccggcacccgcttcaacctggggcccgtgaccatcacgctgtccgagccgcggaacatccagcagaagctcccgcccgagctggtgaccctgcacccccgcgtcgaggagggcttcttcgacctcatgcacgtgcagaaggtgctgagcgcctccaccgtctgcaagctgcagagctgcacccacggcgtgcccggggacctccaggtgtaccacgtcggcaacctgctgaagggggacaagatcaacggcaactccttccacaagatcgagcccaacctcaacacgagctggatgtcctgggacggctgcgacctggactactactgcaacatgggggactggcccagctgcacctacaccggcgtgacccagcacaaccacgccgccttcgtgaacctgctcaacatcgagacggactacaccaagaacttccacttccacagcaagcgggtcaccgcccacggggagacgccccagctggacctgaaggcccgcccgaagtacggcgcgggggaggtgaccgtgctcgtcgaggtggccgacatggagctgcacaccaagaagatcgagatctccggcctgaagttcgccagcctgacctgcaccggctgctacgcctgctccagcgggatctcctgcaaggtgcggctgcacgtcgacgagcccgacgagctgacggtgcacgtcaagagcgacgaccccgacgtggtggccgcgtccagctccctcatggcccgcaagatcgagttcggcaccgacagcaccttcaaggccttctccagcatgccgaaggacaagctgtgcttctacatcgtggagcgggactactgctccagctgctccaaggaggacacccagaagtgcgtcaacgccaagctggagcagccccagagcatcctcatcgagcacaaggggacgatcatcggcaagcagaacgacacgtgcaccgtgaaggcgtcctgctggctggagagcgtgaagtccttcttctacgggctgaagaacatgctcggcggcatcttcgggaacgtcatcctgggcatcatcatgttcctggcccccttcgccctcctgctcctcttcttcctgttcgggtggcgcatcctgttctgcctccggtgctgccgccggacccgcggcctgttcaagtacaagcacatcaaggacgacgaggagagcgggtacaagcggatcatcgagcgcctgaacaacaagaagggcaagaacaagctgttcgacggcgagcggctggccgacaagaagatcgccgagctgttcagcaccaagacccacatcggg

SEQ ID NO: 12225 - RNA, 2916 nt, synthetic construct
  misc_feature 1..2916: note = derived and/or modified CDS sequence (opt1) from CCHFV(C-68031, Artificial)__DQ211629.1__Gn-4aa-Gc
  source 1..2916: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacctgcatcctgtgcaaggtcatcttctacctgctcatcgtggtgggcaccctggggaagaagttcaagcagtaccgcgagctgaagccccagacgtgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctgcaggtgagcgagtccaccggggtcgccctgaagcgcagctcctggctcgtggtgctgctggtcctcctgaccgtgagcctgtcccccgtgcagagcgcccccatcggccggaagccgctcttctccgacagcatcgtcaaggggatgaagaacctgctgaactccacgagcctcgagacctccctgagcatcgaggcgccctggggcgccatcaacgtgcagtccaccttcaagcccaccgtgagcgccgccaacatcgccctgtcctggagctccgtcgagcaccgcggcaacaagatcctcgtgagcgggcggtccgagagcatcatgaagctggaggagcgcacgggcatcagctgggacctgggggtcgaggacgcgtccgagagcaagctcctgaccgtgtccatcatggacctgagccagatgtactcccccgtgttcgagtacctcagcggcgaccggcaggtcgaggagtggccgaaggccacctgcaccggggactgccccgagcgctgcggctgcacgtccagcacctgcctgcacaaggagtggccccactcccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcgccagtgctccctgatcgaggccggcacgcggttcaacctggggccggtgaccatcaccctcagcgagccccgcaacatccagcagaagctgccccccgagatcgtgaccctgcacccgcggatcgaggagggcttcttcgacctcatgcacgtcaagaaggtgctgtccgccagcaccgtgtgcaagctgcagtcctgcacgcacggcgtccccggggacctccaggtgtaccacatcggcaacctgctgaagggggacaaggtgaacggccacctcatccacaagatcgagccccacttcaacaccagctggatgtcctgggacggctgcgacctggactactactgcaacatgggggactggcccagctgcagctacaccggcgtcacccagcacaaccacgcggccttcgtgaacatgctgaacatcgagacggactacaccaagatcttccacttccactccaagcgcgtgaccgcccacggggacaccccgcagctcgacctgaaggcccggcccacgtacggcgccggggagatcaccgtcctggtggaggtggcggacatggagctccacaccaagaagatcgagatcagcggcctgaagttcgcctccctgacctgcacgggctgctacgcctgcagctccgggatcagctgcaaggtccgcatccacgtggacgagcccgacgagctcaccgtgcacgtcaagtccgaggacccggacatcgtggccgccagctccagcctgatggcgcggaagctggagttcggcaccgactccaccttcaaggccttcagcgccatgcccaagacgtccctctgcttctacatcgtggagcgcgagtactgcaagagctgctccaaggaggacacccagaagtgcgtcaacaccaagctggagcagccccagagcatcctgatcgagcacaaggggaccatcatcggcaagcagaacgacacgtgcacctccaaggccgggtgctggctcgagagcgtgaagtccttcttctacggcctgaagaacatgctgagcggcatcttcgggaacgtgttcatcggcatcttcctcttcctggcgcccttcatcctgctcatcctgttcttcatgttcgggtggcggatcctgttctgcttcaagtgctgccgccggacccgcggcctcttcaagtaccggcacctgaaggacgacgaggagaccgggtaccgcaagatcatcgagcggctgaacaacaagaagggcaagaacaagctcctggacggcgagcgcctggccgaccggaagatcgccgagctcttcagcacgaagacccacatcggg

SEQ ID NO: 12226 - RNA, 2916 nt, synthetic construct
  misc_feature 1..2916: note = derived and/or modified CDS sequence (opt1) from CCHFV(Drosdov, Artificial)__DQ211630.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacctgcatcttctgcaaggccctgttctacagcctcatcatcatcggcacgctggggaagaagatcaagcagtaccgcgagctgaagccccagacctgcaccatctgcgagaccgcccccgtgaacgcgatcgacgccgagatgcacgacctcaagtgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccggaagcccctcttcctggacagcaccgtgaaggggatgaagaacctgctcaactccaccagcctggagacctccctgagcatcgaggccccctggggcgccatcaacgtgcagtccacgttcaagcccaccgtcagcaccgccaacatcgcgctctcctggagctccgtggagcaccgcggcaacaagatcctggtgaccgggcggagcgagtccatcatgaagctggaggagcgcacgggcgtcagctgggacctcggggtggaggacgcctccgagagcaagctgctgaccgtctccatcatggacctcagccagatgtacagcccggtgttcgagtacctgtccggcgaccggcaggtggaggagtggcccaaggccacctgcaccggggactgccccgagcgctgcggctgcacgagctccacctgcctgcacaaggagtggccccacagccggaactggcgctgcaacccgacctggtgctggggcgtcgggaccggctgcacgtgctgcggggtggacgtgaaggacctcttcaccgaccacatgttcgtcaagtggaaggtggagtacatgaagaccgaggccatcgtgtgcgtcgagctgacctcccaggagcgccagtgcagcctgatcgaggccggcacccggttcaacctggggcccgtgacgatcaccctctccgagccccgcaacatccagcagaagctgcccccggagatcatcaccctgcaccccaagatcgaggagggcttcttcgacctcatgcacgtgcagaaggtcctgagcgcgtccaccgtgtgcaagctgcagagctgcacgcacggcatccccggggacctccagatctaccacatcggcaacctgctgaagggggaccgggtgaacggccacctcatccacaagatcgagccccacttcaacacctcctggatgagctgggacggctgcgacctggactactactgcaacatggggaactggccgtcctgcacctacaccggcgtcacgcagcacaaccacgccgccttcgtgaacctgctcaacatcgagaccgactacaccaagaccttccacttccacagcaagcgcgtgacggcccacggggacaccccccagctggacctgaaggcccggcccacctacggcgcgggggagatcaccgtcctcgtggaggtggccgacatggagctgcacacgaagaaggtcgagatctccggcctgaagttcgccagcctcgtgtgcaccggctgctacgcctgctccagcgggatcagctgcaaggtgcgcatccacgtcgacgagccggacgagctgaccgtgcacgtgaagtccagcgaccccgacgtcgtggccgcgtccaccagcctgatggcccggaagctcgagttcggcacggactccatcttcaaggccttcagcgccatgcccaagacctccctgtgcttctacatcgtggagcgcgagtactgcaagagctgctccgaggacgacaccaagaagtgcgtcgacaccaagctggagcagccccagagcatcctcatcgagcacaaggggacgatcatcggcaagcagaacgacacctgcaccgcgaaggcctcctgctggctggagagcgtgaagtccttcttctacgggctgaagaacatgctcggcagcgtgttcggcaacttcttcgtcgggatcctgctgttcctcgccccgttcgtgctgctggtgctcttcttcatgttcggctggaagatcctgttctgcttcaagtgctgccggcgcacccgggggctgttcaagtaccgccacctcaaggacgacgaggagacgggctaccggcgcatcatcgagcggctgaactccaagaaggggaagaaccgcctgctcgacggcgagcggctggccgaccgcaagatcgccgagctgttcagcaccaagacccacatcggc

SEQ ID NO: 12227 - RNA, 2916 nt, synthetic construct
  misc_feature 1..2916: note = derived and/or modified CDS sequence (opt1) from CCHFV(Kashmanov, Artificial)__DQ211631.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggatgaagaactccctgaacagcacgtccctcgagaccagcctgtccatcgaggccccctggggcgccatcaacgtgcagagcaccttcaagccgaccgtctccacggccaacatcgcgctgagctggtccagcgtggagcaccggggcaacaagatcctcgtgaccgggcgctccgagagcatcatgaagctggaggagcggaccggcgtctcctgggacctgggggtggaggacgccagcgagtccaagctcctgaccgtcagcatcatggacctgagccagatgtactcccccgtgttcgagtacctcagcggcgaccgccaggtggaggagtggcccaaggccacgtgcaccggggactgccccgagcggtgcggctgcacctccagcacgtgcctgcacaaggagtggccgcactcccgcaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctcaccagccaggagcggcagtgctccctgatcgaggccggcacccgcttcaacctggggcccgtgaccatcaccctgagcgagccccggaacatccagcagaagctcccgcccgagatcatcacgctgcaccccaaggtggaggagggcttcttcgacctgatgcacgtccagaaggtgctctccgcgagcaccgtgtgcaagctgcagtcctgcacccacggcatccccggggacctgcaggtctaccacatcggcaacctcctgaagggggaccgcatcaacggccacctgatccacaagatcgagccgcacttcaacaccagctggatgtcctgggacggctgcgacctcgactactactgcaacatgggggactggcccagctgcacgtacaccggcgtgacccagcacaaccacgccgccttcgtgaacctgctgaacatcgagaccgactacacgaagaccttccacttccactccaagcgggtcaccgcccacggggacacgccccagctcgacctgaaggcccgcccgacctacggcgcgggggagatcaccgtgctggtggaggtcgccgacatggagctccacaccaagaaggtggagatcagcggcctgaagttcgcctccctggcctgcaccggctgctacgcctgcagcagcgggatctcctgcaaggtgcggatccacgtcgacgagcccgacgagctcacggtgcacgtcaagagctccgaccccgacgtggtggcggccagcacctccctgatggcccgcaagctggagttcggcaccgacagcaccttcaaggccttctccgcgatgcccaagacgagcctctgcttctacatcgtggagcgggagtactgcaagtcctgcagcgaggaggacacccagaagtgcgtcgacaccaagctggagcagccgcagtccatcctgatcgagcacaaggggaccatcatcggcaagcagaacgacacgtgcaccgccaaggccagctgctggctcgagtccgtcaagagcttcttctacgggctgaagaacatgctgggctccgtgttcggcaacttcttcatcgggatcctcctgttcctggcccccttcgtgctcctggtgctgttcttcatgttcggctggaagatcctcttctgcttcaagtgctgccgccggacccgcgggctgctgaagtaccggcacctcaaggacgacgaggagaccggctaccgccggatcatcgagcgcctgaacaacaagaaggggaagaaccggctgctcgacggcgagcgcctggccgaccggaagatcgcggagctgttcagcacgaagacccacatcggc

SEQ ID NO: 12228 - RNA, 2916 nt, synthetic construct
  misc_feature 1..2916: note = derived and/or modified CDS sequence (opt1) from CCHFV(Oman, Artificial)__DQ211632.1__Gn-4aa-Gc
  source 1..2916: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctcaagcggagcagctggctgatcgtgctgctcgtgctgctgaccgtctccctcagccccgtgcagtccgcccccatcggccgcaagccgctgttcctggacagcatcgcgaaggggatgaagaacctcctgaactccacgagcctggagacctccctcagcatcgaggccccctggggcgccatcaacgtgcagtccaccttcaagcccaccgtcagcacggccaacatcgccctgtcctggagctccgtggagcaccggggcaacaagatcctggtgagcgggcgctccgagagcatcatgaagctcgaggagcggaccggcatctcctgggacctgggggtcgaggacgcgagcgagtccaagctgctcaccgtgagcgtcatggacctgagccagatgtactcccccgtgttcgagtacctgagcggcgaccgccaggtggaggagtggccgaaggcgacctgcacgggggactgccccgagcggtgcggctgcacctccagcacgtgcctccacaaggagtggccccactcccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctgaccagccaggagcgccagtgctccctcatcgaggccggcacccgcttcaacctggggccggtcaccatcaccctgagcgagccccggaacatccagcagaagctcccgcccgagatcgtgaccctgcacccccgcatcgaggagggcttcttcgacctgatgcacgtgcagaaggtcctctccgccagcacggtgtgcaagctgcagtcctgcacccacggcgtgcccggggacctgcaggtctaccacatcggcaacctcctgaagggggacaaggtgaacggccacctgatccacaaggtggagccccacttcaacaccagctggatgtcctgggacggctgcgacctcgactactactgcaacatgggggactggcccagctgcacctacacgggcgtcacccagcacaaccacgccgccttcgtgaacctgctgaacatcgagaccgactacaccaagaacttccacttccactccaagcgggtgacggcccacggggacaccccgcagctcgacctgaaggcccgccccaactacggcgccggggaggtcaccgtgctggtggaggtcgcggacatggagctccacaccaagaagatcgagatcagcggcctgaagttcgcctccctgacgtgcaccggctgctacgcctgcagcagcgggatctcctgcaaggtgcggatccacgtggacgagcccgacgagctcaccgtccacgtcaagagcgaggacccggacatcgtggccgcctccagctccctgatggcgcgcaagctggagttcggcaccgacagcacgttcaaggccttctccgccatgcccaagaccagcctctgcttctacatcgtggagcgggagtactgcaagtcctgcagcaaggaggacacccagaagtgcgtgaacgccaagctggagcgcccccagtccatcctgatcgagcacaaggggaccatcatcggcaagcagaacgacacgtgcaccgcgaaggccagctgctggctcgagtccgtcaagagcttcttctacgggctgaagaacatgctgtccggcatcttcggcaacgtgttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaaggggaagaacaagctcctggacggcgagcgcctggccgaccggaagatcgccgagctgttcagcacgaagacccacatcggc

SEQ ID NO: 12229 - RNA, 2916 nt, synthetic construct
  misc_feature 1..2916: note = derived and/or modified CDS sequence (opt1) from CCHFV(SPU97/85, Artificial)__DQ211633.1__Gn-4aa-Gc
  source 1..2916: mol_type = other RNA
agcgaggagtccgacggcgactgcatcagccgcacccagctgctccggaccgagacggccgagatccactccgacaactacgggggccccggggacaagatcaccatctgcaacggcagcaccatcgtggaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgagatcgtcctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggcggatggccatctacatctgccgcatgtccaaccacccgaagacgaccatggccttcctgttctggttcagcttcggctacgtgatcacctgcatcctgtgcaaggtcatcttctacctcctgatcgtggccggcaccgtggggaagaagttcaagcagtaccgggagctgcgcccccagacgtgcaccatctgcgagaccacccccgtcaacgccatcgacgcggagatgcacgacctcaactgctcctacaacatctgcccctactgcgccagccggctgacgtccgacggcctggcccgccacgtgatgcagtgcccgaagcggaaggagaagatcgaggagaccgagctctacctgaacctggagcgcatcccctgggtggtccggaagctcctgcaggtgagcgagagcaccggggtggccctgaagcgctccagctggctcaccgtcctgctggtgctcctgatcgtgtccctgagccccgtccagtccgcgcccatcggccggaagccgctcttcctggacagcatcgtgaaggggaagaagaacctgctcaactccacgagcctggagacctccctgagcatcgaggccccctggggcgccatcaacgtgcagtccaccttcaagcccaccgtcagcgccgccaacatcgcgctctcctggagctccgtggagcaccgcggcaacaagatcctggtgagcgggcggtccgagagcatcatgaagctggaggagcgcacgggcatctcctgggacctcggggtcgaggacgccagcgagagcaagctgctgaccgtgtccgtcatggacctcagccagatgtactcccccgtgttcgagtacctgagcggcgaccggcaggtggaggagtggccgaaggccacctgcaccggggactgccccgagcgctgcggctgcacgtccagcacctgcctgcacaaggagtggccccactcccgcaactggcggtgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcgccagtgctccctgatcgaggccggcacgcggttcaacctcgggccggtcaccatcaccctgagcgagccccgcaacatccagcagaagctgccccccgagatcatcaccctccacccgcggatcgaggagggcttcttcgacctgatgcacgtgcagaaggtgctgtccgcgagcaccgtctgcaagctccagtcctgcacgcacggcgtgcccggggacctgcaggtgtaccacatcggcaacctgctcaagggggacaaggtcaacggccacctgatccacaagatcgagccccacttcaacaccagctggatgtcctgggacggctgcgacctggactactactgcaacatgggggactggcccagctgcacctacaccggcgtgacgcagcacaaccacgccgccttcgtgaacctcctgaacatcgagaccgactacaccaagaacttccacttccactccaagcgcgtcaccgcccacggggacacgccgcagctggacctcaaggcccggcccacctacggcgcgggggaggtgaccgtgctggtcgaggtggccgacatggagctgcacaccaagaagatcgagatcagcggcctcaagttcgccagcctgtcctgcacgggctgctacgcctgcagctccgggatcagctgcaaggtgcgcatccacgtcgacgagcccgacgagctgaccgtgcacgtgaagtccgaggacccggacatcgtcgccgcgggcagctccctcatggcccggaagctggagttcggggccgacagcaccttcaaggccttctccgcgatgcccaagaccagcctgtgcttctacatcgtggagcgcgagtactgcaagtcctgcagccgggaggacacgcagaagtgcgtgaacaccaagctcgagcgcccccagtccatcctgatcgagcacaagggcaccatcatcgggaagcagaacgacacctgcacggccaaggccagctgctggctggagtccgtcaagagcttcttctacggcctcaagtccatgctgagcggcatcttcgggaacgtgttcatcggcatcttcctgttcatcgcccccttcgtgctcctgatcctgttcttcatgttcgggtggcggatcctcttctgcttcaagtgctgccgccggacccgcggcctgttcaagtaccggcacctgaaggacgacgaggagaccgggtaccgcaagatcatcgagcggctcaacaacaagaagggcaagaacaagctgctggacggcgagcgcctcgccgaccgcaagatcgcggagctgttctccaccaagagccacatcggg

SEQ ID NO: 12230 - RNA, 2916 nt, synthetic construct
  misc_feature 1..2916: note = derived and/or modified CDS sequence (opt1) from CCHFV(SPU103/87, Artificial)__DQ211634.1__Gn-4aa-Gc
  source 1..2916: mol_type = other RNA
agcgaggagtccagcgacgactgcatctcccgcacccagctgctccggaccgagacggccgagatccacggcgacaactacgggggccccggggacaagatcaccatctgcaacggcagcaccatcgtggaccagcgcctggggtccgagctgggctgctacaccatcaaccgggtcaagacgttcaagctctgcgagaacagcgccaccggcaagtcctgcgagatcgacagcgtgccggtgaagtgccgccaggggtactgcctgaagatcacccaggagggccgggggcacgtcaagctgtcccgcggcagcgaggtggtgctcgacgcgtgcgacacctcctgcgaggtcatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtgatcacgtgcgtcctgtgcaaggccatcttctacctcctgatcatcgtgggcaccctggggaagcgcctcaagcagtaccgggagctgaagccccagacctgcaccatctgcgagaccacgcccgtgaacgccatcgacgcggagatgcacgacctgaactgctcctacaacatctgcccctactgcgccagccgcctcacctccgacggcctggcccggcacgtcacccagtgcccgaagcgcaaggagaaggtggaggagaccgagctgtacctcaacctggagcggatcccctgggtggtccgccggctgctccaggtgagcgagtccacgggggtggccctgaagcgcagcagctggctgatcgtcctcctggtgctgttcaccgtgtccctcagccccgtccagtccgcgcccatcagccggcgcccgctgttcctggacaacatcgtgaagggcatgaagaacctcctgaactccaccagcctggagacctccctcagcatcgaggccccctggggcgccatcaacgtgcagtccacgtacaagcccaccgtcagcaccgccaacatcgccctgtcctggagctccgtggagcaccgggggaacaagatcctggtcagcggccgctccgagagcatcatgaagctcgaggagcggaccgggatctcctgggacctgggcgtggaggacgcgagcgagtccaagctgctcacggtgagcgtcatggacctgagccagatgtactcccccgtgttcgagtacctgagcggggaccgccaggtggaggagtggccgaaggcgacctgcaccggcgactgccccgagcgctgcgggtgcacctccagcacgtgcctccacaaggagtggccccactcccggaactggcgctgcaaccccacctggtgctggggcgtcggcaccgggtgcacgtgctgcggcctggacgtgaaggacctgttcaccgactacatgttcgtgaagtggaagatcgagtacatcaagaccgaggccatcgtctgcgtggagctgaccagccaggagcggcagtgctccctcatcgaggccgggacccgcttcaacctgggcccggtgaccatcacgctgagcgagccccggaacatccagcagaagctcccctccgagatcatcaccctgcacccccgcatcgaggaggggttcttcgacctgatgcacgtccagaaggtgctcagcgcctccaccgtgtgcaagctgcagagctgcacccacggcgtcccgggcgacctccaggtgtaccacatcgggaacctcctgaagggcgacaaggtgaacgggcacctggtccacaagatcgagccccacttcaacacgtcctggatgagctgggacggctgcgacctcgactactactgcaacatgggcgactggccctcctgcacctacaccggggtgacccagcacaaccacgccagcttcgtgaacctgctgaacatcgagacggactacaccaagaacttccacttccactccaagcgggtcaccgcccacggcgacacgccccagctcgacctgaaggcccgcccgacctacggggccggcgagatcaccgtgctggtggaggtcgccgacatggagctccacaccaagaagatcgagatcagcgggctgaagttcaccagcctgacgtgcaccggctgctacgcgtgctccagcggcatctcctgcaaggtgcggatccacgtggacgagcccgacgagctcaccgtccacgtcaagagcgacgaccccgacgtggtggccgcctccagctccctgatggcccgcaagctggagttcgggaccgacagcacgttcaaggccttctccgcgatgccgaagaccagcctctgcttctacatcgtggagcgggagtactgcaagtcctgcagcgaggaggacacccagaagtgcgtgaacaccaagctggagcagccccagtccatcctgatcgagcacaagggcacgatcatcgggaagcagaacaacacgtgcaaggcccgcgccggctgctggctcgagagcgtcaagtccttcttctacgggctgaagaacatgctgagcggcatcttcggcaacgtgttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaaggggaagaacaagctcctggacggcgagcgcctggcggaccgccggatcgccgagctgttctccaccaagacccacatcggc

SEQ ID NO: 12231 - RNA, 2916 nt, synthetic construct
  misc_feature 1..2916: note = derived and/or modified CDS sequence (opt1) from CCHFV(SPU415/85, Artificial)__DQ211635.1__Gn-4aa-Gc
  source 1..2916: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtggaccagcgcctggggtccgagctgggctgctacacgatcaaccgggtcaagagcttcaagctctgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgacagcaactgcgagatcatgatccccaaggggacgggcgacatcctggtggactgctccggcgggcagcagcacttcctgaaggacaacctcatcgacctgggctgccccaacatccccctgctcgggaagatggcgatctacatctgccggatgagcaaccacccgaagaccaccatggccttcctgttctggttctccttcggctacgtgatcacctgcatcctgtgcaaggtcatcttctacctcctgatcgtggccggcacggtggggaagaagttcaagcagtaccgcgagctgcggccccagacctgcaccatctgcgagaccatccccgtcaacgccatcgacgccgagatgcacgacctcaactgcagctacaacatctgcccctactgcgcgtcccgcctgacgagcgacggcctggcccggcacgtgatgcagtgcccgaagcgcaaggagaaggtggaggagaccgagctctacctgaacctggagcggatcccctgggtcgtgcgcaagctcctgcaggtgtccgagagcaccggggtcgccctgaagcggagctcctggctcaccgtgctgctggtgctcctgatcgtcagcctgtcccccgtgcagagcgcccccatcggccgcaagccgctcttcctggactccatcgtgaaggggatgaagaacctgctcaacagcacgtccctggagaccagcctgtccatcgaggcgccctggggcgccatcaacgtccagagcaccttcaagcccaccgtgtccgccgccaacatcgccctcagctggtccagcgtggagcaccggggcaacaagatcctggtctccgggcgcagcgagtccatcatgaagctggaggagcggacgggcatcagctgggacctcggggtggaggacgcgtccgagagcaagctgctgaccgtcagcgtgatggacctctcccagatgtacagccccgtgttcgagtacctgtccggcgaccgccaggtcgaggagtggccgaaggccacctgcaccggggactgccccgagcggtgcggctgcacgagctccacctgcctgcacaaggagtggccccacagccgcaactggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcggcagtgcagcctgatcgaggccggcacgcgcttcaacctcgggccggtgaccatcaccctgtccgagccccggaacatccagcagaagctgccccccgagatcatcaccctccacccgcgcatcgaggagggcttcttcgacctgatgcacgtgcagcgggtcctgagcgcctccaccgtgtgcaagctccagagctgcacgcacggcgtgcccggggacctgcaggtctaccacatcggcaacctgctcaagggggacaaggtgaacggccacctgatccacaagatcgagccccacttcaacacctcctggatgagctgggacggctgcgacctggactactactgcaacatgggggactggccctcctgcacctacaccggcgtgacgcagcacaaccacgcggccttcgtcaacctcctgaacatcgagaccgactacaccaagaacttccacttccacagcaagcgcgtgaccgcccacggggacacgccgcagctggacctcaaggcccggcccacctacggcgccggggaggtgaccgtcctggtggaggtggcggacatggagctgcacaccaagaagatcgagatctccggcctcaagttcgccagcctgacgtgcaccggctgctacgcctgcagctccgggatcagctgcaaggtcaagatccacgtggacgagcccgacgagctgaccgtgcacgtcaagtccgaggacccggacatcgtggccgccggcagctccctcatggcgcgcaagctggagttcggggccgacagcaccttcaaggccttctccgccatgcccaagacgagcctgtgcttctacatcgtggagcgggagtactgcaagtcctgcagccgcgaggacacccggaagtgcgtcaacaccaagctcgaccgcccccagtccatcctgatcgagcacaagggcaccatcatcgggaagcagaacaacacgtgcaccgcgaaggccagctgctggctggagtccgtgaagagcttcttctacggcctcaagaacatgctgtccggcatcttcgggaacgtgttcatcggcatcttcctgttcatcgcccccttcgtcctcctgatcctgttcttcatgttcgggtggcggatcctcttctgcttcaagtgctgccgccggacccgcggcctgttcaagtaccggcacctgaaggacgacgaggagaccgggtaccgcaagatcatcgagcggctcaacaacaagaagggcaagaacaagctgctggacggcgagcgcctcgccgaccgcaagatcgccgagctgttcagcacgaagtcccacatcggg

SEQ ID NO: 12232 - RNA, 2916 nt, synthetic construct
  misc_feature 1..2916: note = derived and/or modified CDS sequence (opt1) from CCHFV(Turkey200310849, Artificial)__DQ211636.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcagctgcaaggccctgttctactccctcatcatcatcggcaccctggggaagaagatcaagcagtaccgggagctgaagccccagacctgcaccatctgcgagaccgcccccgtcaacgcgatcgacgccgagatgcacgacctcaactgcagctacaacatctgcccgtactgcgcctcccgcctgacgagcgacggcctggcccggcacgtgacccagtgccccaagcgcaaggagaaggtggaggagaccgagctctacctgaacctggagcggatcccctggatcgtccgcaagctcctccaggtgtccgagagcaccggggtggcgctgaagcggagctcctggctcatcgtcctgctggtgctcctgacggtgagcctgtcccccgtccagagcgccccggtgggccgcaagcccctcttcctggactccatcgtgaaggggatgaagaacctgctcaacagcacctccctggagaccagcctgtccatcgaggccccctggggcgccatcaacgtccagagcaccttcaagcccgccgtgtccacggcgaacatcgccctcagctggtccagcgtggagcaccggggcaacaagatcctggtcaccgggcgctccgagagcatcatgaagctggaggagcggaccggcgtgtcctgggacctcggggtcgaggacgccagcgagtccaagctgctgaccgtgagcatcatggacctcagccagatgtactccccggtgttcgagtacctgagcggcgaccgccaggtcgaggagtggcccaaggccacgtgcaccggggactgccccgagcggtgcggctgcacctccagcacgtgcctgcacaaggagtggccccactcccgcaactggcgctgcaacccgacctggtgctggggcgtggggaccggctgcacgtgctgcggggtggacgtcaaggacctcttcaccgaccacatgttcgtgaagtggaaggtggagtacatcaagaccgaggccatcgtctgcgtggagctgaccagccaggagcggcagtgctccctgatcgaggcgggcacccgcttcaacctggggcccgtgaccatcaccctcagcgagccccggaacatccagcagaagctgcccccggagatcatcacgctgcaccccaagatcgaggagggcttcttcgacctcatgcacgtccagaaggtgctgtccgccagcaccgtgtgcaagctgcagtcctgcacccacggcatccccggggacctccaggtctaccacatcggcaacctgctgaagggggaccgcgtgaacggccacctcatccacaagatcgagagccacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaccttccacttccacagcaagcgggtgaccgcccacggggacaccccgcagctggacctgaaggcgcgccccacgtacggcgccggggagatcaccgtgctcgtcgaggtggccgacatggagctgcacaccaagaaggtggagatctccggcctgaagttcgccagcctcgcctgcaccggctgctacgcgtgcagctccgggatcagctgcaaggtccggatccacgtggacgagcccgacgagctgacggtgcacgtcaagtccagcgacccggacgtggtggccgcctccaccagcctgatggcccgcaagctcgagttcggcaccgactccaccttcaaggcgttcagcgccatgcccaagacgtccctgtgcttctacatcgtcgagcgggagtactgcaagagctgctccgaggacgacacccagaagtgcgtggacacccgcctggagcagccccagagcatcctcatcgagcacaaggggaccatcatcggcaagcagaacgacacgtgcaccgccaaggcctcctgctggctggagagcgtgaagtccttcttctacgggctgaagaacatgctcggcagcgtcttcggcaacctgttcatcgggatcctcctcttcctggcccccttcgtgctgctcgtgctgttcttcatgttcggctggaagatcctgttctgcttcaagtgctgccggcgcacccgggggctgttcaagtaccgccacctgaaggacgacgaggagaccggctaccggcgcatcatcgagcggctgaactccaagaaggggaagaaccgcctcctggacggcgaccggctggcggaccgcaagatcgccgagctgttcagcacgaagacccacatcggc

SEQ ID NO: 12233 - RNA, 2916 nt, synthetic construct
  misc_feature 1..2916: note = derived and/or modified CDS sequence (opt1) from CCHFV(Iran-52, Artificial)__DQ446215.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcggcgccccctcttcctggactccatcgtgaagggcatgaagaacctgctcaacagcacctccctggagaccagcctgtccatcgaggccccctggggcgcgatcaacgtccagagcacctacaagcccacggtgtccaccgccaacatcgccctcagctggtccagcgtcgagcaccgggggaacaaggtgctggtgtccggccgcagcgagtccatcatgaagctggaggagcggaccgggatcagctgggacctcggcgtcgaggacgcctccgagagcaagctgctgaccgtgagcgtgatggacctctcccagatgtacagccccgtcttcgagtacctgtccggggaccgccaggtggaggagtggccgaaggccacgtgcaccggcgactgccccgagcgctgcggctgcaccagctccacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggagtacatcaagaccgaggcgatcgtctgcgtggagctgacctcccaggagcggcagtgcagcctgatcgaggccgggacccgcttcaacctcggctccgtgaccatcaccctgagcgagccgcggaacatccagcagaagctgccgcccgagatcatcacgctccaccccaagatcgaggagggcttcttcgacctgatgcacgtccagaaggtgctgtccgccagcaccgtgtgcaagctccagtcctgcacccacggggtcccgggcgacctccaggtgtaccacatcgggaacctgctgaagggcgaccgcgtgaacggccacctgatccacaagatcgagcagcacttcaacaccagctggatgtcctgggacgggtgcgacctggactactactgcaacatgggcgactggcccagctgcacgtacaccggggtcacccagcacaaccacgcctccttcgtgaacctcctgaacatcgagaccgactacacgaagaccttccacttccacagcaagcgggtgaccgcccacggcgacacgccccagctggacctcaaggcgcgccccacctacggggccggcgagatcaccgtcctggtggaggtggccgacatggagctgcacaccaagaagatcgagatcagcggcctcaagttcgccgggctgacctgcacgggctgctacgcctgctccagcgggatctcctgcaaggtccggatccacgtggaggagccggacgagctgaccgtgcacgtcaagagcgacgaccccgacgtggtggcggcctccagctccctcatggcccgcaagctggagttcggcaccgacagcaccttcaaggccttctccgccatgcccaagacgagcctgtgcttctacatcgtcgagcgggagtactgcaagtcctgcagcaaggaggacacccagaagtgcgtgaacaccaagctcgagcagccgcagtccatcctgatcgagcacaaggggaccatcatcggcaagcagaacaacacgtgcaccgcgaaggccagctgctggctggagtccgtcaagagcttcttctacggcctcaagaacatgctcgggggcatcttcgggaacgtgttcatcggcatcttcaccttcctgacccccttcatcctgctgatcctgttcttcatgttcgggtggcgcatcctcttctgcttcaagtgctgccggcgcacgcggggcctgttcaagtaccgccacctgaaggacgacgaggagaccggctaccggaagatcatcgagcgcctcaacaacaagaaggggaagaaccggctgctggacggcgagcgcctcgccgaccgcaagatcgccgagctgttctccaccaagacccacatcggg

SEQ ID NO: 12234 - RNA, 2916 nt, synthetic construct
  misc_feature 1..2916: note = derived and/or modified CDS sequence (opt1) from CCHFV(Iran-53, Artificial)__DQ446216.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcggcgccccctcttcctggactccatcgtgaagggcatgaagaacctgctcaacagcacctccctggagaccagcctgtccatcgaggccccctggggcgcgatcaacgtccagagcacctacaagcccacggtgtccaccgccaacatcgccctcagctggtccagcgtcgagcaccgggggaacaaggtgctggtgtccggccgcagcgagtccatcatgaagctggaggagcggaccgggatcagctgggacctcggcgtcgaggacgcctccgagagcaagctgctgaccgtgagcgtgatggacctctcccagatgtacagccccgtcttcgagtacctgtccggggaccgccaggtggaggagtggccgaaggccacgtgcaccggcgactgccccgagcgctgcggctgcaccagctccacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggagtacatcaagaccgaggcgatcgtctgcgtggagctgacctcccaggagcggcagtgcagcctgatcgaggccgggacccgcttcaacctcggctccgtgaccatcaccctgagcgagccgcggaacatccagcagaagctgccgcccgagatcatcacgctccaccccaagatcgaggagggcttcttcgacctgatgcacgtccagaaggtgctgtccgccagcaccgtgtgcaagctccagtcctgcacccacggggtcccgggcgacctccaggtgtaccacatcgggaacctgctgaagggcgaccgcgtgaacggccacctgatccacaagatcgagcagcacttcaacaccagctggatgtcctgggacgggtgcgacctggactactactgcaacatgggcgactggcccagctgcacgtacaccggggtcacccagcacaaccacgcctccttcgtgaacctcctgaacatcgagaccgactacacgaagaccttccacttccacagcaagcgggtgaccgcccacggcgacacgccccagctggacctcaaggcgcgccccacctacggggccggcgaggtcaccgtgctggtggaggtcgccgacatggagctgcacaccaagaagatcgagatcagcggcctcaagttcgccgggctgacctgcacgggctgctacgcctgctccagcgggatctcctgcaaggtgcggatccacgtggacgagccggacgagctgaccgtccacgtcaagagcgacgaccccgacgtggtggcggcctccagctccctcatggcccgcaagctggagttcggcaccgacagcaccttcaaggccttctccgccatgcccaagacgagcctgtgcttctacatcgtggagcgggagtactgcaagtcctgcagcaaggaggacacccagaagtgcgtgaacaccaagctcgagcagccgcagtccatcctgatcgagcacaaggggaccatcatcggcaagcagaacaacacgtgcaccgcgaaggccagctgctggctggagtccgtcaagagcttcttctacggcctcaagaacatgctcgggggcatcttcgggaacgtgttcatcggcatcttcaccttcctgacccccttcatcctgctgatcctgttcttcatgttcgggtggcgcatcctcttctgcttcaagtgctgccggcgcacgcggggcctgttcaagtaccgccacctgaaggacgacgaggagaccggctaccggaagatcatcgagcgcctcaacaacaagaaggggaagaaccggctgctggacggcgagcgcctcgccgaccgcaagatcgccgagctgttctccaccaagacccacatcggg

SEQ ID NO: 12235 - RNA, 2916 nt, synthetic construct
  misc_feature 1..2916: note = derived and/or modified CDS sequence (opt1) from CCHFV(Kosova Hoti, Artificial)__EU037902.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccagaagggccgggggcacgtgaagctgtcccgcggcagcgaggtcgtgctcgacgcgtgcgactccaactgcgaggtgatgatccccaaggggacgggcgacatcctggtcgactgcagcggcgggcagcagcacttcctgaaggacaacctcatcgacctgggctgcccccacatcccgctgctcgggaagatggccatctacatctgccggatgtccaaccaccccaagaccaccatggccttcctgttctggttcagcttcggctacgtgatcacgtgcatcttctgcaaggccctgttctactccctcatcatcatcggcaccctggggaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacggcctggcccgccacgtcaagcagtgccccaagcggaaggagaaggtggaggagaccgagctctacctgaacctggagcgcatcccctgggtggtccggaagctcctccaggtgtccgagagcaccggggtggcgctgaagcgctccagctggctcatcgtcctgctggtgctcctgaccgtgagcctgtcccccgtccagagcgccccggtgggccggaagcccctcttcctggactccatcgtgaaggggatgaagaacctgctcaacagcacgtccctggagaccagcctgtccatcgaggccccctggggcgccatcaacgtccagagcaccttcaagcccaccgtgtccacggccaacatcgcgctcagctggtccagcgtggagcaccgcggcaacaagatcctggtcaccgggcggtccgagagcatcatgaagctggaggagcgcaccggcatctcctgggacctcggggtggaggacgccagcgagtccaagctgctgaccgtcagcatcatggacctctcccagatgtacagcccggtgttcgagtacctgagcggcgaccgccaggtggaggagtggcccaaggccacgtgcaccggggactgcccccagcggtgcggctgcacctccagcacgtgcctgcacaaggagtggccccactcccggaactggcgctgcaacccgacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgaccagccaggagcgccagtgctccctgatcgaggccggcacccggttcaacctggggcccgtgaccatcaccctcagcgagccccgcaacatccagcagaagctgcccccggagatcatcacgctgcaccccaagatcgaggagggcttcttcgacctcatgcacgtgcagaaggtcctgtccgcgagcaccgtgtgcaagctgcagtcctgcacccacggcatccccggggacctccaggtgtaccacatcggcaacctgctgaagggggaccgggtcaacggccacctcatccacaagatcgagccccacttcaacaccagctggatgtcctgggacggctgcgacctggactactactgcaacatgggggactggccgagctgcacgtacaccggcgtgacccagcacaaccacgccgccttcgtgaacctgctcaacatcgagaccgactacacgaagaccttccacttccactccaagcgcgtcaccgcccacggggacacgccccagctggacctgaaggcccggcccacctacggcgcgggggagatcaccgtgctcgtggaggtcgccgacatggagctgcacaccaagaaggtggagatcagcggcctgaagttcgcctccctcgcctgcaccggctgctacgcctgcagctccgggatcagctgcaaggtgcgcatccacgtcgacgagccggacgagctgacggtgcacgtcaagagctccgaccccgacgtggtggcggccggcaccagcctgatggcccggaagctcgagttcgggaccgactccaccttcaaggccttcagcgcgatgcccaagacgtccctgtgcttctacatcgtggagaaggagtactgcaagagctgctccgaggacgacaccaagaagtgcgtcgacaccaagctggagcagccccagagcatcctcatcgagcaccgcggcaccatcatcgggaagcagaacgacacgtgcaccgccaaggcctcctgctggctggagagcgtgaagtccttcttctacggcctgaagaacatgctcggcagcgtgttcgggaacttcttcatcggcatcctgctgttcctcgccccgttcgtcctgctggtgctgttcttcatgttcgggtggaagatcctgttctgcttcaagtgctgccggcgcacccggggcctgttcaagtaccgccacctcaaggacgacgaggagaccgggtaccggcgcatcatcgagcggctgaacaacaagaagggcaagaaccgcctgctcgacggcgagcggctggccgaccgcaagatcgcggagctgttctccacgaagacccacatcggg

SEQ ID NO: 12236 - RNA, 2916 nt, synthetic construct
  misc_feature 1..2916: note = derived and/or modified CDS sequence (opt1) from CCHFV(YL04057, Artificial)__FJ562094.1__Gn-4aa-Gc
  source 1..2916: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggccgcgagctgggctgctacaccatcaaccgggtgcgctcctacaagctgtgcgagaacagcgcgtccggcaagagctgcgagatcgactccatcccggtcaagtgcaagcaggggttctgcctcaagatcacccaggaggggcggggccacgtgaagctgagccgcgggacggagatcgtgctggacgtctgcgactccagctgcgagctcatgatccccaagggcaccggcgacatcctggtggactgctccgggggccagcagcacttcctgcagaacaacctcatcgacctggggtgccccaacgtgcccctgctcggcaagatggccatctacgtctgccggatgagcaaccacccgaagaccaccatggccttcctgttctggttctccttcggctacgtgatcacgtgcatcgcctgccgcgtgctgttctacctcctgatcgccatcgggaccgtcggcaagaagctgaagcagtaccgggagctcaagccccagacctgcatcgtgtgcgagagcgtgcccgtcaacgcgatcgacgccgagatgcacgagctgaactgctcctacaacatctgcccctactgcgccagccgcctgtccaccgacgggctcatccggcacgtgacgcagtgcccgaagcgccgggagaaggtggaggagaccgagctgttcctgaacctcgagcgcatcccctggctggtccggaagctgctccaggtgagcgagagcaccggcatggccctgaagcgctcctgctggatgatcaccctgctcatcctgctgctcgtgagcatctcccccgtccagagcgcgcccgtggggcggaagccgctgttcctggactccatcgccaagggcaagaagtccctcctgaacagcacgagcctggagacctccctcagcatcgaggccccctggggcgccatcaacgtgcagtccaccttcaagcccaccgtcagcgccgcgaacatcgccctgtcctggagctccgtggagcaccgcgggaacaagatcctggtcagcggccggtccgagagcatcatgaagctcgaggagcgcacgggggtgtcctggaacctgggcgtggaggacgccagcgagagcaagaccctgaccgtctccgtgatggacctcagccagatgtactcccccgtgttcgagtacctgagcggggaccggcaggtcgaggagtggccgaaggcgacctgcacgggcgactgccccgagcgctgcggctgcacctccagcacgtgcctgcacaaggagtggccccactcccgcaactggcggtgcagccccacctggtgctggggcgtggggaccgggtgcacgtgctgcggcctcgacgtgaaggacttcttcaccgactacatgctggtcaagtggaaggtggagtacatcaagaccgaggccatcgtgtgcgtcgagctgacctcccaggagcgccagtgcagcctgatcgaggccgggacccggttcaacctcggcccggtgaccatcaccctgtccgagccccgcaacgtgcagcagcggctgccgcccgagatcgtcacgctccaccccaagatcgaggagggcttcttcgacctgatgcacgtgcagaagatcctgagcgcctccaccgtgtgcaagctccagagctgcacccacggggtccccggcgacttccaggtgtaccacgtggggaacctgctgcgcggcgacaaggtcaacggccactccatccacaagatcgagccccacttcaacaccagctggatgtcctgggacgggtgcgacctcgactacttctgcaacatgggcgactggcccagctgcacctacacgggggtgacccagcacaaccgggccgccttcatcaacatgctgaacatcgagaccgactacaccaagacgttccacttccacagcaagcgcgtgaccgcccacggcgacaccccgcagctggacctcaaggcgcggcccgcctacggggccggcgaggtcaccgtgctggtggaggtcgccgacctggagctccacacgaagaagctggaggtgtccggcctgaagatcgccagcctgacctgctccgggtgctacgcgtgcagctccggcatcagctgcaaggtgcgcatccacgtcaacgagcccgacgagttcaccgtgcacgtgcggtccagcgacccggacgtcgtggccgccgggtccagcctgatggcccgcaagatcgagttcggcgcggactccaccttcaaggccttcagctccatgcccaaggacagcctgtgcttctacatcgtggagaaggactactgctccagctgcacggacgacgacacccagaagtgcgtcaacaccaagctcgaccacccccagtccatcctgatcgagcacaaggggaccatcatcggcaagcagaacgacacgtgcagcaccaagacctcctgctggctggagagcgtgaagggcttcttctacgggctcaagaacatgctgagcggcatcttcgggaacgtgttcctgggcatcctcctgttcctggcccccttcgtcctcctgatcttcttcttcttcttcgggtggcggctcctcttctgcctgaagtgctgccgccggacccgcggcctgctcaagtacaagcacctgaaggacgaggaggaggccggctacaagaagatcatcgagcggctgaacgggaagaagggcaagtcccagctgttcgacggggagcgcctcgccgaccggaagatcgcggagctgttcagcacgaagatccacatcggc

SEQ ID NO: 12237 - RNA, 2916 nt, synthetic construct
  misc_feature 1..2916: note = derived and/or modified CDS sequence (opt1) from CCHFV(V42/81, Artificial)__GU477490.1__Gn-4aa-Gc
  source 1..2916: mol_type = other RNA
agcaaggagcccggcgacgactgcatctcccgcacccagctgatgcggaccgagacggccgagatccacgacgacaactacgggggcccgggggacaagatcaccatctgcaacggcagcaccatcgtggaccagcgcctcgggtccgagctgggctgctacaccatcaaccgggtcaagagcttcaagctgtgcgagaactccgccacgggcaaggcgtgcgaggtggacagcacccccgtgaagtgccgccaggggttctgcctcaagatcacccaggagggccgggggcacgtcaagctgtcccgcggcagcgaggtggtgctggacgcctgcgactccagctgcgaggtcatgatccccaaggggaccggcgacatcctcgtggactgctccggcgggcagcagcacttcctgaaggacaacctgatcgacctcgagtgcccccacatcccgctgctgggcaagctcgccatctacatctgccggatgagcaaccacccccgcacgaccatggccttcctgttctggttcgggttcggctacgtgatcacctgcatcctgtgcaaggccctcttctactccctgatcatcatcggcaccctggggaagaagatcaagcagtaccgggagctcaagccccagacgtgcaccatctgcgagaccgcgcccgtcaacgccatcgacgccgagatgcacgacctgaactgcagctacaacatctgcccgtactgcgcctcccgcctgaccagcgacggcctcgcgcggcacgtgacgcagtgccccaagcgcaaggagaaggtggaggagaccgagctgtacctgaacctcgagcggatcccctggatcgtccgcaagctgctgcaggtgtccgagagcaccggggtggtcctcaagcggtccagctggctgatcgtgctgctcgtgctgctgaccgtcagcctctcccccgtgcagagcgccccggtgggccgcaagcccctgttcctggactccatcgtcaaggggaagaagaacctcctgaacagcacgtccctggagaccagcctctccatcgaggccccctggggcgccatcaacatccagagcaccttcaagcccaccgtgtccgccgcgaacatcgccctgagctggtccagcgtggagcaccggggcaacaagatcctggtctccgggcgcagcgagtccatcatgaagctcgaggagcggacgggcgtgagctggaacctgggggtcgaggacgcctccgagagcaagctgctcaccgtgtccatcatggacctgagccagatgtacagcccggtgttcgagtacctgtccggcgaccgccaggtcgaggagtggcccaaggccacctgcaccggggactgccccgagcggtgcggctgcacgagctccacctgcctccacaaggagtggccccacagccgcaactggcgctgcaacccgacctggtgctggggcgtggggaccggctgcacgtgctgcggggtggacgtcaaggacctgttcatcgaccacatgttcgtgaagtggaaggtggagtacatcaagaccgaggccatcgtctgcgtggagctgacctcccaggagcggcagtgcagcctgatcgaggcgggcacccgcttcaacctcgggcccgtgacgatcaccctgtccgagccccggaacatccagcagaagctgcccccggagatcatcaccctccaccccaagatcgaggagggcttcttcgacctgatgcacgtccagaaggtgctgagcgcctccaccgtgtgcaagctccagagctgcacccacggcatccccggggacctgcaggtctaccacatcggcaacctgctcaagggggaccgcgtgaacggccacctgatccacaagatcgagccccacttcaacacgtcctggatgagctgggacggctgcgacctggactactactgcaacatgggggactggccgtcctgcacctacaccggcgtgacccagcacaaccacgccgccttcgtcaacctcctgaacatcgagacggactacaccaagaccttccacttccacagcaagcgggtgaccgcccacggggagacgccccagctggacctcaaggcgcgccccgcctacggcgccggggagatcaccgtgctggtcgaggtggccgacatggagctgcacaccaagaaggtggagatctccggcctcaagttcgccagcctggcgtgcaccggctgctacgcctgctccagcgggatcagctgcaaggtccggatccacgtggacgagccggacgagctgacggtgcacgtcaagtccaacgaccccgacgtggtggccgccagcacctccctcatggcgcgcaagctggagagcggcaccgactccaccttcaaggccttcagcgccatgcccaagacgtccctgtgcttctacatcgtcgagcgggagtactgcaagagctgctccgaggacgacacccagaagtgcgtggagaccaagctcgagcagccccagagcatcctgatcgagcacaaggggaccatcatcggcaagcagaacgacacgtgcaccgccaaggcctcctgctggctggagagcgtgaagtccttcttctacgggctcaagaacatgctgggcagcgtcttcggcaacttcttcatcgggatcctgctcttcctggcgccgttcgtgctgctcgtgctgttcttcatgttcggctggaagatcctgttctgcttcaagtgctgccgccggacccgcgggctcttcaagtaccggcacctgaaggaggacgaggagaccggctaccgccggatcatcgagcgcctgaactccaagaaggggaagaaccggctcctggacggcgagcgcctggccgaccggaagatcgccgagctcttcagcacgaagacccacatcggc

SEQ ID NO: 12238 - RNA, 2916 nt, synthetic construct
  misc_feature 1..2916: note = derived and/or modified CDS sequence (opt1) from CCHFV(79121M18, Artificial)__GU477493.1__Gn-4aa-Gc
  source 1..2916: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagggcctcggctccgagctggggtgctacaccatcaaccgggtgcgcagctacaagctgtgcgagaactccgcgagcggcaagtcctgcgagatcgacagcatcccggtcaagtgcaagcaggggttctgcctcaagatcacccaggagggccgggggcacgtgaagctgtcccgcggcacggagatcgtgctggacgtctgcgacagctcctgcgagctcatgatccccaagggcaccggggacatcctggtggactgcagcggcgggcagcagcacttcctgcagaacaacctcatcgacctgggctgccccaacgtgcccctgctcggcaagatggccatctacgtctgccggatgtccaaccacccgaagaccaccatggccttcctgttctggttcagcttcgggtacgtgatcacgtgcatcgcctgccgcgtgctgttctacctcctgatcgccatcggcaccgtcgggaagaagctgaagcagtaccgggagctcaagccccagacctgcatcgtgtgcgagtccgtgcccgtcaacgcgatcgacgccgagatgcacgagctgaactgcagctacaacatctgcccctactgcgcctcccgcctgagcaccgacggcctcatccggcacgtgacgcagtgcccgaagcgccgggagaaggtggaggagaccgagctgttcctgaacctcgagcgcatcccctggctggtccggaagctgctccaggtgagcgagtccaccgggatggccctgaagcgcagctgctggatgatcaccctgctcatcctgctgctcgtgtccatcagccccgtccagtccgcgcccgtgggccggaagccgctgttcctggacagcacggccaagggcatgaagtccctcctgaacagcacctccctggagaccagcctctccatcgaggccccctggggcgccatcaacgtgcagagcaccttcaagcccacggtctccgccgcgaacatcgccctgagctggtccagcgtggagcaccgcgggaacaagatcctggtctccgggcggagcgagtccatcatgaagctcgaggagcgcaccggcgtgagctggaacctgggggtggaggacgccagcgagtccaagaccctgaccgtcagcgtgatggacctctcccagatgtacagccccgtgttcgagtacctgtccggcgaccggcaggtcgaggagtggccgaaggccacgtgcaccggcgactgccccgagcgctgcgggtgcaccagctccacgtgcctgcacaaggagtggccccacagccggaactggcgctgcaaccccacctggtgctggggcgtggggaccggctgcacgtgctgcgggctcgacgtgaaggacttcttcaccgactacatgctggtcaagtggaaggtggagtacatcaagaccgaggccatcgtgtgcgtcgagctgacctcccaggagcgccagtgcagcctgatcgaggcgggcacccggttcaacctcggcccggtgaccatcacgctgtccgagccccgcaacgtgcagcagcggctgccgcccgagatcgtcaccctccaccccaagatcgaggaggggttcttcgacctgatgcacgtgcagaagatcctgagcgcctccaccgtgtgcaagctccagagctgcacccacggcgtccccggggacttccagatctaccacgtgggcaacctgctgcgcggcgacaaggtgaacgggcactccatccacaagatcgagccccacttcaacaccagctggatgtcctgggacggctgcgacctcgactacttctgcaacatgggggactggcccagctgcacgtacaccggcgtcacccagcacaaccgggccgccttcatcaacatgctgaacatcgagaccgactacacgaagaccttccacttccacagcaagcgcgtgaccgcccacggggacaccccgcagctggacctcaaggcgcggcccgcctacggcgccggcgaggtgacggtcctggtggaggtggccgacctggagctccacaccaagaagctggaggtctccgggctgaagatcgccagcctgacctgctccggctgctacgcgtgcagctccgggatcagctgcaaggtgcgcatccacgtgaacgagcccgacgagttcaccgtccacgtgcggtccagcgacccggacgtggtcgccgccggctccagcctcatggcccgcaagatcgagttcggggcggactccacgttcaaggccttcagctccatgcccaaggacagcctgtgcttctacatcgtggagaaggactactgctccagctgcaccgacgacgacacccagaagtgcgtgaacaccaagctcgaccacccccagtccatcctgatcgagcacaagggcacgatcatcggcaagcagaacgacacgtgcagcaccaagacctcctgctggctggagagcgtcaaggggttcttctacggcctcaagaacatgctgagcgggatcttcggcaacgtgttcctggggatcttcctcttcctggcccccttcgtgctgctcatcttcttcttcttcttcggctggcggctgctgttctgcctcaagtgctgccgccggacccgcggcctgctgaagtacaagcacctcaaggacgaggaggaggccgggtacaagaagatcatcgagcggctgaacggcaagaaggggaagtcccagctgttcgacggcgagcgcctcgccgaccggaagatcgcggagctgttcagcaccaagatccacatcggg

SEQ ID NO: 12239 - RNA, 2916 nt, synthetic construct
  misc_feature 1..2916: note = derived and/or modified CDS sequence (opt1) from CCHFV(Afg09-2990, Artificial)__HM452306.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcactacctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcggcgccccctcttcctggactccatcgtgaagggcatgaagaacctgctcaacagcacctccctggagaccagcctgtccatcgaggccccctggggcgcgatcaacgtccagagcacctacaagcccacggtgtccaccgccaacatcgccctcagctggtccagcgtcgagcaccgggggaacaaggtgctggtgtccggccgcagcgagtccatcatgaagctggaggagcggaccgggatcagctgggacctcggcgtcgaggacgcctccgagagcaagctgctgaccgtgagcgtgatggacctctcccagatgtacagccccgtcttcgagtacctgtccggggaccgccaggtggaggagtggccgaaggccacgtgcaccggcgactgccccgagcgctgcggctgcaccagctccacgtgcctgcacaaggagtggccccacagccggaactggcgctgcaaccccacctggtgctggggcgtggggaccgggtgcacgtgctgcggcctcgacgtcaaggacctgttcaccgactacatgttcgtgaagtggaaggtggagtacatcaagaccgaggcgatcgtctgcgtggagctgacctcccaggagcggcagtgcagcctgatcgaggccgggacccgcttcaacctcggctccgtgaccatcaccctgagcgagccgcggaacatccagcagaagctgccgcccgagatcatcacgctccaccccaagatcgaggagggcttcttcgacctgatgcacgtccagaaggtgctgtccgccagcaccgtgtgcaagctccagtcctgcacccacggggtcccgggcgacctccaggtgtaccacatcgggaacctgctgaagggcgaccgcgtgaacggccacctgatccacaagatcgagcagcacttcaacaccagctggatgtcctgggacgggtgcgacctggactactactgcaacatgggcgactggcccagctgcacgtacaccggggtcacccagcacaaccacgcctccttcgtgaacctcctgaacatcgagaccgactacacgaagaccttccacttccacagcaagcgggtgaccgcccacggcgacacgccccagctggacctcaaggcgcgccccacctacggggccggcgagatcaccgtcctggtggaggtggccgacatggagctgcacaccaagaagatcgagatcagcggcctcaagttcgccgggctgacctgcacgggctgctacgcctgctccagcgggatctcctgcaaggtccggatccacgtggacgagccggacgagctgaccgtgcacgtcaagagcgacgaccccgacgtggtggcggcctccagctccctcatggcccgcaagctggagttcggcaccgacagcaccttcaaggccttctccgccatgcccaagacgagcctgtgcttctacatcgtcgagcgggagtactgcaagtcctgcagcaaggaggacacccagaagtgcgtgaacaccaagctcgagcagccgcagtccatcctgatcgagcacaaggggaccatcatcggcaagcagaacaacacgtgcaccgcgaaggccagctgctggctggagtccgtcaagagcttcttctacggcctcaagaacatgctcgggggcatcttcgggaacgtgttcatcggcatcttcaccttcctgacccccttcatcctgctgatcctgttcttcatgttcgggtggcgcatcctcttctgcttcaagtgctgccggcgcacgcggggcctgttcaagtaccgccacctgaaggacgacgaggagaccggctaccggaagatcatcgagcgcctcaacaacaagaaggggaagaaccggctgctggacggcgagcgcctcgccgaccgcaagatcgccgagctgttctccaccaagacccacatcggg

SEQ ID NO: 12240 - RNA, 2916 nt, synthetic construct
  misc_feature 1..2916: note = derived and/or modified CDS sequence (opt1) from CCHFV(Sudan Al-Fulah 3-2008, Artificial)__HQ378184.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtgaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcgtggacctgggctgccccaagatcccgctgctcgggaagatggccatctacatctgccgcatgtccaaccaccccaagacgaccatggccttcctgttctggttcagcttcggctacgtcatcacgtgcatcctgtgcaaggccatcttctacctcctgatcatcatcggcaccctggggaagcggttccgccagtaccgggagctcaagccccagacctgcaccatctgcgagaccacccccgtgaacgccatcgacgcggagatgcacgacctgaactgctcctacaacatctgcccgtactgcgccagccgcctgacgtccgacggcctcgcccggcacgtgacccagtgccccaagcgcaaggagaaggtcgaggagaccgagctgtacctgaacctcgagcggatcccctgggtggtgcgcaagctgctgcaggtcagcgagtccaccggggtggccctcaagcggagcagctggctgatcgtgctgctcgtcctgttcacggtgtccctgagccccgtgcagtccgcgccgatcggccgccggcccctcttcctggacagcatcgtcaaggggatgaagaacctgctcaactccaccagcctggagacctccctgagcatcgaggccccctggggcgccatcaacgtgcagtccacctacaagcccacggtgagcaccgccaacatcgccctctcctggagctccgtcgagcaccgcggcaacaagatcctggtgagcgggcggtccgagagcatcatgaagctggaggagcgcaccggcatctcctgggacctcggggtcgaggacgcgagcgagtccaagctgctgaccgtgagcgtgatggacctcagccagatgtactccccggtcttcgagtacctgagcggcgaccgccaggtggaggagtggcccaaggccacgtgcaccggggactgccccgagcggtgcggctgcacctccagcacgtgcctgcacaaggagtggccccactcccgcaactggcggtgcaacccgacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgaccagccaggagcgccagtgctccctgatcgaggccggcacccggttcaacctcgggcccgtgaccatcaccctgagcgagccccgcaacatccagcagaagctgcccccggagatcatcacgctccacccccggatcgaggagggcttcttcgacctgatgcacgtccagaaggtgctgtccgccagcaccgtgtgcaagctccagtcctgcacccacggcgtccccggggacctccaggtgtaccacatcggcaacctgctcaagggggacaaggtgaacggccacctgatccacaagatcgagccccacttcaacaccagctggatgtcctgggacggctgcgacctggactactactgcaacatgggggactggccgagctgcacgtacaccggcgtcacccagcacaaccacgcgtccttcgtgaacctcctgaacatcgagaccgactacacgaagaacttccacttccacagcaagcgcgtgaccgcccacggggacacgccccagctggacctcaaggcccggcccacctacggcgccggggagatcaccgtcctggtggaggtggccgacatggagctgcacaccaagaagatcgagatctccggcctcaagttcgcgagcctgacctgcaccggctgctacgcctgcagctccgggatcagctgcaaggtccgcatccacgtggacgagccggacgagctgacggtgcacgtcaagtccgacgaccccgacgtggtggccgccagctccagcctcatggcccggaagctggagttcggcaccgactccaccttcaaggcgttcagcgccatgcccaagacctccctgtgcttctacatcgtcgagaaggagtactgcaagagctgctccgaggaggacacgaagaagtgcgtgaacaccaagctcgagcagccccagagcatcctgatcgagcacaaggggaccatcatcggcaagcagaactccacgtgcaccgccaaggtgagctgctggctggagtccgccaagagcttcttctacgggctcaaggacatgctgtccggcatcttcggcaacgtcttcatcgggatcttcctgttcctcgcgccgttcgtgctgctggtcctcttcttcatgttcggctggcgcatcctgctgtgcttccggtgctgccgccggacccgcggcctcttcaagtaccggcacctgaaggacgacgaggagaccgggtaccgccggatcatcgagcgcctgaacaacaagaaggggaagaacaagctcctggacggcgagcgcctggccgaccggaagatcgccgagctgttcagcaccaagacgcacatcggc

SEQ ID NO: 12241 - RNA, 2916 nt, synthetic construct
  misc_feature 1..2916: note = derived and/or modified CDS sequence (opt1) from CCHFV(Sudan AB1-2009, Artificial)__HQ378187.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtgaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacctgatcacgtgcatcctctgcaaggccatcttctacctgctgatcatcatcggcaccctcgggaagcggctgaagcagtaccgcgagctgaagccccagacctgcaccatctgcgagaccacccccgtgaacgccatcgacgcggagatgcacgacctcaactgcagctacaacatctgcccgtactgcgcctcccggctgacgagcgacggcctggcccgccacgtgatccagtgccccaagcggaaggagaaggtcgaggagaccgagctctacctgaacctggagcgcatcccctgggtggtgcggaagctcctgcaggtctccgagagcaccggggtggccctgaagcgctccagctggctcatcgtgctgctggtcctcttcaccgtgagcctgtcccccgtgcagagcgcgccgatcggccggaagcccctgttcctcgactccatcgccaaggggatgaagaacctgctgaacagcacgtccctcgagaccagcctgtccatcgaggccccctggggcgccatcaacgtccagagcacctacaagcccaccgtgtccacggccaacatcgcgctgagctggtccagcgtggagcaccgcggcaacaagatcctcgtctccgggcggagcgagtccatcatgaagctggaggagcgcaccggcatcagctgggacctgggggtggaggacgcctccgagagcaagctcctgaccgtgtccgtcatggacctgagccagatgtacagcccggtgttcgagtacctctccggcgaccggcaggtcgaggagtggcccaaggcgacctgcacgggggactgccccgagcgctgcggctgcaccagctccacgtgcctgcacaaggagtggccccacagccgcaactggcggtgcaacccgacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccaggagcgccagtgcagcctgatcgaggccggcacccggttcaacctggggcccgtgaccatcaccctctccgagccccgcaacatccagcagaagctgcccccggagatcatcaccctgcacccccggatcgaggagggcttcttcgacctcatgcacgtgcagaaggtcctgagcgcctccacggtgtgcaagctgcagagctgcacccacggcgtgcccggggacctccaggtctaccacatcggcaacctgctgaagggggacaaggtgaacggccacctcatccacaagatcgagccccacttcaacacctcctggatgagctgggacggctgcgacctggactactactgcaacatgggggactggccgtcctgcacctacacgggcgtgacccagcacaaccacgccagcttcgtcaacctgctcaacatcgagaccgactacaccaagaacttccacttccactccaagcgcgtgacggcccacggggacacgccccagctggacctgaaggcccggcccacctacggcgccggggagatcaccgtgctcgtcgaggtggcggacatggagctgcacaccaagaagatcgagatcagcggcctgaagttcgcctccctgacctgcaccggctgctacgcctgcagcagcgggatctcctgcaaggtgcgcatccacgtcgacgagccggacgagctcaccgtgcacgtcaagagcgacgaccccgacgtggtggccgcctccagctccctgatggcgcggaagctcgagttcggcacggacagcaccttcaaggccttctccgccatgcccaagaccagcctgtgcttctacatcgtggagcgcgagcactgcaagtcctgcaacgaggaggacaccaagaagtgcgtcaacacgaagctggagcagccccagagcatcctcatcgagcacaaggggaccatcatcggcaagcagaactccacgtgcaccgcccgggcgagctgctggctggagtccgtcaagagcttcttctacgggctgaagaacatgctctccggcatcttcggcaacgtgttcatggggatcttcctgttcctggccccgttcatcctcctgatcctgttcttcatgttcggctggcgcatcctcttctgcttcaagtgctgccggcgcacccgggggctgttcaagtaccgccacctgaaggacgacgaggagaccggctaccggcgcatcatcgagcggctcaacaacaagaaggggaagaacaagctgctggacggcgagcgcctcgccgaccgccggatcgccgagctgttcagcaccaagacccacatcggc

SEQ ID NO: 12242 - RNA, 2916 nt, synthetic construct
  misc_feature 1..2916: note = derived and/or modified CDS sequence (opt1) from CCHFV(NIVA 118595, Artificial)__JN572083.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacccaggaggggcggggccacgtgaagctgtcccgcgggagcgaggtggtcctcgacgcgtgcgactccagctgcgaggtgatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtcatcacgtgcatcctgtgcaaggtgatcttctacctcctgatcatcttcgggaccctgggcaagcgcttcaagcagtaccgggagctcaagccccagacctgcaccatctgcgagaccacccccgtgaacgccatcgacgccgagatgcacgacctgaactgcagctacaacatctgcccctactgcgcgtcccgcctgaccagcgacgggctcgcccggcacgtcacgcagtgcccgaagcgcaaggagaaggtggaggagaccgagctgtacctgaacctcgagcggatcccctgggtggtccgcaagctgctccaggtgtccgagagcaccggcatcgccctgaagcggagctcctggctgatcgtgctgctcgtcctgttcaccgtgagcatcacgcccgtgcagtccgcccccatcgggcgccggccgctgttcctcgacagcatcgtcaagggcatgaagaacctgctgaactccaccagcctcgagacctccctgagcatcgaggcgccctggggcgccatcaacgtgcagtccacctacaagcccacggtgagcgccgccaacatcgccctgtcctggagctccgtcgagcaccgcgggaacaagatcctcgtgagcggccggtccgagagcatcatgaagctggaggagcgcaccgggatctcctgggacctgggcgtcgaggacgcgagcgagtccaagctcctgaccgtgagcgtgatggacctgagccagatgtactcccccgtcttcgagtacctcagcggggaccgccaggtggaggagtggccgaaggcgacctgcacgggcgactgccccgagcggtgcggctgcacctccagcacgtgcctgcacaaggagtggccccactcccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctgggcagcgtgaccatcaccctctccgagccgcgcaacatccagcagaagctgccgcccgagatcatcaccctgcacccccggatcgaggagggcttcttcgacctcatgcacgtccagaaggtgctgagcgcctccacggtgtgcaagctgcagagctgcacccacggggtccccggcgacctccaggtgtaccacatcgggaacctgctgaagggcgaccgcgtgaacggccacctcatccacaagatcgagcagcacctgaacacctcctggatgagctgggacgggtgcgacctggactactactgcaacatgggcgactggccctcctgcacctacacgggggtcacccagcacaaccacgccagcttcgtgaacctcctgaacatcgagaccgactacaccaagacgttccacttccactccaagcgggtgaccgcccacggcgacacgccccagctggacctcaaggcccgccccacctacggggccggcgagatcaccgtcctggtggaggtggccgacatggagctgcacaccaagaagatcgagatcagcggcctcaagttcgcgagcctgtcctgcaccgggtgctacgcctgcagctccggcatcagctgcaaggtccggatccacgtggacgagccggacgagctgaccgtgcacgtcaagtccgacgaccccgacgtggtggccgccagctccagcctcatggcccgcaagctggagtccgggacggacagcaccttcaaggcgttctccgccatgcccaagaccagcctgtgcttctacatcgtcgagcgggagtactgcaagggctgctccaaggaggacacccagaagtgcgtgaacacgaagctcgagcagccgcagagcatcctgatcgagcacaaggggaccatcatcggcaagcagaacaacacgtgcaccgccaaggcctcctgctggctggagagcgtgaagtccttcttctacggcctcaagaacatgctgagcgggatcttcggcaacgtcttcctggggatcttctccttcctcgcgcccttcgtgctgctgatcctcttcttcatgttcggctggcgcatcctgttctgcttcaagtgctgccggcgcacccgggggctgttcaagtaccgccacctcaaggacgacgaggagaccggctaccggaagatcatcgagcgcctgaacaacaagaagggcaagaacaagctgctcgacggggagcggctggccgaccgcaagatcgccgagctgttcagcaccaagacccacatcggc

SEQ ID NO: 12243 - RNA, 2916 nt, synthetic construct
  misc_feature 1..2916: note = derived and/or modified CDS sequence (opt1) from CCHFV(NIV 112143, Artificial)__JN572085.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacccaggaggggcggggccacgtgaagctgtcccgcgggagcgaggtggtcctcgacgcgtgcgactccagctgcgaggtgatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtcatcacgtgcatcctgtgcaaggtgatcttctacctcctgatcatcttcgggaccctgggcaagcgcttcaagcagtaccgggagctcaagccccagacctgcaccatctgcgagaccacccccgtgaacgccatcgacgccgagatgcacgacctgaactgcagctacaacatctgcccctactgcgcgtcccgcctgaccagcgacgggctcgcccggcacgtcacgcagtgcccgaagcgcaaggagaaggtggaggagaccgagctgtacctgaacctcgagcggatcccctgggtggtccgcaagctgctccaggtgtccgagagcaccggcatcgccctgaagcggagctcctggctgatcgtgctgctcgtcctgttcaccgtgagcatcacgcccgtgcagtccgcccccatcgggcgccggccgctgttcctcgacagcatcgtcaagggcatgaagaacctgctgaactccaccagcctcgagacctccctgagcatcgaggcgccctggggcgccatcaacgtgcagtccacctacaagcccacggtgagcgccgccaacatcgccctgtcctggagctccgtcgagcaccgcgggaacaagatcctcgtgagcggccggtccgagagcatcatgaagctggaggagcgcaccgggatctcctgggacctgggcgtcgaggacgcgagcgagtccaagctcctgaccgtgagcgtgatggacctgagccagatgtactcccccgtcttcgagtacctcagcggggaccgccaggtggaggagtggccgaaggcgacctgcacgggcgactgccccgagcggtgcggctgcacctccagcacgtgcctgcacaaggagtggccccactcccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctgggcagcgtgaccatcaccctctccgagccgcgcaacatccagcagaagctgccgcccgagatcatcaccctgcacccccggatcgaggagggcttcttcgacctcatgcacgtccagaaggtgctgagcgcctccacggtgtgcaagctgcagagctgcacccacggggtccccggcgacctccaggtgtaccacatcgggaacctgctgaagggcgaccgcgtgaacggccacctcatccacaagatcgagcagcacctgaacacctcctggatgagctgggacgggtgcgacctggactactactgcaacatgggcgactggccctcctgcacctacacgggggtcacccagcacaaccacgccagcttcgtgaacctcctgaacatcgagaccgactacaccaagacgttccacttccactccaagcgggtgaccgcccacggcgacacgccccagctggacctcaaggcccgccccacctacggggccggcgagatcaccgtcctggtggaggtggccgacatggagctgcacaccaagaagatcgagatcagcggcctcaagttcgcgagcctgtcctgcaccgggtgctacgcctgcagctccggcatcagctgcaaggtccggatccacgtggacgagccggacgagctgaccgtgcacgtcaagtccgacgaccccgacgtggtggccgccagctccagcctcatggcccgcaagctggagttcgggacggactccaccttcaaggcgttcagcgccatgcccaagacctccctgtgcttctacatcgtcgagcgggagtactgcaagggctgcagcaaggaggacacccagaagtgcgtgaacacgaagctcgagcagccgcagtccatcctgatcgagcacaaggggaccatcatcggcaagcagaacaacacgtgcaccgccaaggccagctgctggctggagtccgtcaagagcttcttctacggcctcaagaacatgctgtccgggatcttcggcaacgtgttcctggggatcttcagcttcctcgcgcccttcgtgctgctgatcctcttcttcatgttcggctggcgcatcctgttctgcttcaagtgctgccggcgcacccgggggctgttcaagtaccgccacctcaaggacgacgaggagaccggctaccggaagatcatcgagcgcctgaacaacaagaagggcaagaacaagctgctcgacggggagcggctggccgaccgcaagatcgccgagctgttctccaccaagacccacatcggc

SEQ ID NO: 12244 - RNA, 2916 nt, synthetic construct
  misc_feature 1..2916: note = derived and/or modified CDS sequence (opt1) from CCHFV(SCT ex Afghanistan, Artificial)__KC344856.1__Gn-4aa-Gc
  source 1..2916: mol_type = other RNA
agcgaggagtccggcgacgactgcatcagccgcacccagctcctccggaccgagacggccgaggtgcacaacgacaactacgggggccccggggacaagatcaccatctgcaacggctccaccatcgtcgaccagcgcctggggagcgagctgggctgctacaccatcaaccgggtgaagtccttcaagctctgcgagaacagcgccacgggcaagtcctgcaagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtgatcacgtgcatcttctgcaaggtgatcttctacctgctcatcgtcgtgggcaccctggggaagaagttcaagcagtaccgcgagctgaagccccagacctgcaccatctgcgagaccacccccacgaacgccatcgacgccgagatgcacgacctcaactgcagctacaacatctgcccctactgcgcgtcccggctgaccagcgacggcctggcccgccacgtgacccagtgcccgaagcggaaggagaaggtcgaggagaccgagctctacctgaacctggagcgcatcccctggatcgtgcggaagctcctccaggtgtccgagagcacgggggtcgccctgaagcgcagctcctggctcatcgtgctgctggtgctcctgaccgtcagcctgtcccccgtgcagagcgcccccatcggccggaagcccctcttcctgaactccatcgtgaaggggatgaagaacctgctcaacagcaccaacctggagacctccctgagcatcgaggcgccctggggcgccatcaacgtccagtccacgttcaagcccaccgtgagcaccgccaacatcgccctctcctggagctccgtggagcaccgcggcaacaagatcctggtcagcgggcggtccgagagcatcatgaagctggaggagcgcaccggcatctcctgggacctcggggtggaggacgccagcgagtccaagagcctgacggtcagcgtgatggacctgtcccagatgtacagccccgtgttcgagtacctctccggcgaccggcaggtcgaggagtggccgaaggcgacctgcaccggggactgccccgagcgctgcggctgcaccagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcgccagtgcagcctgatcgaggccggcacccggttcaacctggggccggtgaccatcacgctctccgagccccgcaacatccagcagaagctgccgcccgagatcatcaccctgcacccgcggatcgaggagggcttcttcgacctcatgcacgtgcagaaggtcctgagcgcctccaccgtgtgcaagctgcagagctgcacccacggcgtgcccggggacctccaggtctaccacatcggcaacctgctgaagggggacaagctcaacggccacatgatccacaagatcgagccccacttcaacacgtcctggatgagctgggacggctgcgacctggactactactgcaacatgggggactggccctcctgcacctacaccggcgtgacccagcacaaccacgccgcgttcgtgaacctgctcaacatcgagacggactacaccaagaacttccacttccacagcaagcgcgtcaccgcccacggggacaccccgcagctggacctgaaggcccggcccacgtacggcgccggggagatcaccgtgctcgtggaggtcgccgacatggagctgcacaccaagaagatcgacatctccggcctgaagttcgcgagcctgacctgcgccggctgctacgcctgcagctccgggatcagctgcaaggtgcgcatccacgtggacgagcccgacgagctgacggtccacgtgaagtccgaggacccggacatcgtggccgccagcacctccctgatcgcgcggaagctcgagctgggcaccgacagcaccttcaaggccttctccgccatgcccaagacgagcctgtgcttctacatcgtcgagcgcgagtactgcaagtcctgcagcaaggaggacacccagaagtgcgtgaacaccaagctcgagcacccccaggggatcctgatcgagcacaagggcaccatcatcgggaagcagaacgacacgtgcaccgccaaggcgggctgctggctggagtccgtcaagagcttcttctacggcctcaagaacatgctgtccgggatcttcggcaacgtgttcatcgggatcttcctgttcctcgcccccttcgtgctgctgatcctcttcttcatgttcggctggcggctgctgttctgcttcaagtgctgccgccggacccgcggcctcttcaagtaccggcacctgaaggaggacgaggagagcgggtaccgccggatcatcgagcgcctgaacaacaagaagggcaagaacaagctcctggacggggagcggctggccgaccgccggatcgccgagctgttctccaccaagacgcacatcggc

SEQ ID NO: 12245 - RNA, 2916 nt, synthetic construct
  misc_feature 1..2916: note = derived and/or modified CDS sequence (opt1) from CCHFV(Zahedan 2007, Artificial)__KC867273.1__Gn-4aa-Gc
  source 1..2916: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggcttctgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctcaagcgcagctcctggctgatcgtgctgctcgtgctgttcacggtcagcctgtcccccgtgcagagcgcccccatcgggcggcgccccctcttcctggactccatcgtgaaggacatgaagaacctgctcaacagcacctccctggagaccagcctgtccatcgaggccccctggggcgcgatcaacgtccagagcacctacaagcccacggtgtccaccgccaacatcgccctcagctggtccagcgtcgagcaccggggcaacaaggtgctggtgtccgggcgcagcgagtccatcatgaagctggaggagcggaccggcatcagctgggacctcggggtcgaggacgcctccgagagcaagctgctgaccgtgagcgtgatggacctctcccagatgtacagccccgtcttcgagtacctgtccggcgaccgccaggtggaggagtggccgaaggccacgtgcaccggggactgccccgagcgctgcggctgcaccagctccacgtgcctgcacaaggagtggccccacagccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggcgatcgtctgcgtggagctgacctcccaggagcggcagtgcagcctgatcgaggccggcacccgcttcaacctcgggtccgtgaccatcaccctgagcgagccgcggaacatccagcagaagctgccgcccgagatcatcacgctccaccccaagatcgaggagggcttcttcgacctgatgcacgtccagaaggtgctgtccgccagcaccgtgtgcaagctccagtcctgcacccacggcgtcccgggggacctccaggtgtaccacatcggcaacctgctcaagggggaccgcgtgaacggccacctgatccacaagatcgagcagcacttcaacaccagctggatgtcctgggacggctgcgacctggactactactgcaacatgggggactggcccagctgcacgtacaccggcgtcacccagcacaaccacgcctccttcgtgaacctcctgaacatcgagaccgactacacgaagaccttccacttccacagcaagcgggtgaccgcccacggggacacgccccagctggacctcaaggcgcgccccacctacggcgccggggagatcaccgtcctggtggaggtggccgacatggagctgcacaccaagaagatcgagatcagcggcctcaagttcgccggcctgacctgcacggggtgctacgcctgctccagcggcatctcctgcaaggtccggatccacgtggacgagccggacgagctgaccgtgcacgtcaagagcgacgaccccgacgtggtggcggcctccagctccctcatggcccgcaagctggagttcgggaccgacagcaccttcaaggccttctccgccatgcccaagacgagcctgtgcttctacatcgtcgagcgggagtactgcaagtcctgcagcaaggaggacacccagaagtgcgtgaacaccaagctcgagcagccgcagtccatcctgatcgagcacaagggcaccatcatcgggaagcagaacaacacgtgcaccgcgaaggccagctgctggctggagtccgtcaagagcttcttctacggcctcaagaacatgctgggcgggatcttcggcaacgtgttcatcgggatcttcaccttcctgacccccttcatcctcctgatcttcttcttcatgttcggctggcgcatcctgttctgcttcaagtgctgccggcgcacgcgggggctgttcaagtaccgccacctgaaggacgacgaggagaccggctaccggaagatcatcgagcgcctgaacaacaagaagggcaagaaccggctcctggacggggagcgcctggccgaccgcaagatcgccgagctgttctccaccaagacccacatcggc

SEQ ID NO: 12246 - RNA, 2916 nt, synthetic construct
  misc_feature 1..2916: note = derived and/or modified CDS sequence (opt1) from CCHFV(SPU 44/08, Artificial)__KJ682805.1__Gn-4aa-Gc
  source 1..2916: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggccatcttctacctgctgatcgtggtcggcaccctcggcaagaagttcaagcagtaccgggagctgaagccccagacctgcaccatctgcgagaccaaccccgtgaacgccatcgacgcggagatgcacgacctgaactgctcctacaacatctgcccctactgcgccagccgcctcacctccgacgggctggcccggcacgtgatgcagtgcccgaagcgcaaggagaagatcgaggagaccgagctgtacctcaacctggagcggatcccctgggtcgtgcgcaagctgctccaggtgagcgagagcacgggcgtcgccctgaagcggtccagctggctggtgatcctcctggtgctgctcaccgtctccctgagccccgtgcagtccgcgcccatcagccgcaagccgctgttcctcgactccatcgtgaaggggatgaagaacctgctgaacagcacctccctcgagaccagcctgtccatcgaggccccctggggcgccatcaacgtccagagcacgttcaagcccaccgtgtccgccgccaacatcgcgctgagctggtccagcgtggagcaccgggggaacaagatcctcgtctccggccgcagcgagtccatcatgaagctggaggagcggaccggcatcagctgggacctgggggtggaggacgccagcgagtccaagctcctgaccgtcagcgtgatggacctgtcccagatgtacagccccgtgttcgagtacctctccggcgaccgccaggtcgaggagtggccgaaggccacgtgcaccggggactgccccgagcggtgcggctgcaccagctccacgtgcctgcacaaggagtggccccacagccgcaactggcgctgcaaccccacctggtgctggggcgtggggaccggctgcacgtgctgcgggctggacgtgaaggacctgttcaccgactacatgttcgtcaagtggaaggtggactacatcaagaccgaggccatcgtgtgcgtcgagctcacctcccaggagcggcagtgcagcctgatcgaggccggcacccgcttcaacctggggccggtgaccatcacgctctccgagccccggaacatccagcagaagctgccgcccgagatcgtgaccctgcacccccgcatcgaggagggcttcttcgacctcatgcacatccagaaggtcctgagcgcgtccaccgtgtgcaagctgcagagctgcacccacggggtgcccggcgacctccagatctaccacatcggcaacctgctgaagggggacaaggtcaacggccacctcatccacaagatcgagccccacttcaacacctcctggatgagctgggacgggtgcgacctggactactactgcaacatgggcgactggccctcctgcagctacacgggcgtgacccagcacaaccacgccgccttcgtgaacatgctgaacatcgagaccgactacaccaagaacttccacttccacagcaagcgggtcacggcccacggggacaccccgcagctcgacctgaaggcccgccccacctacggcgcgggggagatcaccgtgctggtggaggtcgccgacatggagctccacacgaagaagatcgagatctccggcctgaagttcgccagcctgacctgcaccgggtgctacgcctgctccagcggcatctcctgcaaggtgcggatccacgtggacgagcccgacgagctcaccgtccacgtcaagagcgaggacccggacatcgtggccgcgtccagctccctgatggcccgcaagctggagttcggcacggacagcaccttcaaggccttctccgccatgcccaagaccagcctctgcttctacatcgtggagcgggagtactgcaagtcctgcagcaaggaggacacccagaagtgcgtgaacacgaagctggagcagccccagtccatcctgatcgagcacaaggggaccatcatcggcaagcagaacgacacgtgcaccgcgaaggccagctgctggctcgagtccatcaagagcttcttctacgggctgaagaacatgctgtccggcatcttcgggaacgtgttcatcggcatcttcctcttcctggcccccttcatcatgctgatcctcttcttcatgttcggctggcgcatcctgttctgcttcaagtgctgccggcgcacccgggggctgttcaagtaccgccacctcaaggacgacgaggagatcggctaccggaagatcatcgagcgcctgaacaacaagaaggggaagaacaagctgctcgacggcgagcggctggccgaccgcaagatcgccgagctgttcagcaccaagacccacatcggg

SEQ ID NO: 12247 - RNA, 2916 nt, synthetic construct
  misc_feature 1..2916: note = derived and/or modified CDS sequence (opt1) from CCHFV(SPU 383/87, Artificial)__KJ682806.1__Gn-4aa-Gc
  source 1..2916: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggtgatcttctacctgctggtcgtggtgggcaccctcggcaagaagttcaagcagtaccgggagctgaagccccagacctgcaccatctgcgagaccaaccccgtcaacgccatcgacgccgagatgcacgacctgaactgctcctacaacatctgcccctactgcgcgagccgcctcacctccgacgggctggcccggcacgtgatccagtgcccgaagcgcaaggagaagatcgaggagaccgagctgtacctcaacctggagcggatcccctgggtggtccgcaagctgctccaggtgagcgagagcacgggcgtggccctgaagcggtccagctggctggtcatcctcctggtgctgctcaccgtgtccctgagccccgtccagtccgcccccatcagccgcaagccgctgttcctcgactccatcgtgaaggggatgaagaacctgctgaacagcacctccctcgagaccagcctgtccatcgaggcgccctggggcgccatcaacgtgcagagcacgttcaagcccaccgtctccgccgccaacatcgccctgagctggtccagcgtggagcaccgggggaacaagatcctcgtctccggccgcagcgagtccatcatgaagctggaggagcggaccggcatcagctgggacctgggggtggaggacgcgagcgagtccaagctcctgaccgtgagcgtcatggacctgtcccagatgtacagccccgtgttcgagtacctctccggcgaccgccaggtggaggagtggccgaaggccacgtgcaccggggactgccccgagcggtgcggctgcaccagctccacgtgcctgcacaaggagtggccccacagccgcaactggcgctgcaaccccacctggtgctggggcgtcgggaccggctgcacgtgctgcgggctggacgtgaaggacctgttcaccgactacatgttcgtgaagtggaaggtcgactacatcaagaccgaggccatcgtgtgcgtggagctcacctcccaggagcggcagtgcagcctgatcgaggccggcacccgcttcaacctggggccggtcaccatcacgctctccgagccccggaacatccagcagaagctgccgcccgagatcgtgaccctgcacccccgcatcgaggagggcttcttcgacctcatgcacatccagaaggtgctgagcgcctccaccgtctgcaagctgcagagctgcacccacggggtgcccggcgacctccagatctaccacatcggcaacctgctgaagggggacaaggtgaacggccacctcatccacaagatcgagccccacttcaacacctcctggatgagctgggacgggtgcgacctggactactactgcaacatgggcgactggccctcctgcagctacacgggcgtcacccagcacaaccacgcggccttcgtgaacatgctgaacatcgagaccgactacaccaagaacttccacttccacagcaagcgggtgacggcccacggggacaccccgcagctcgacctgaaggcccgccccacctacggcgccggggagatcaccgtcctggtggaggtggcggacatggagctccacacgaagaagatcgagatctccggcctgaagttcgccagcctgacctgcaccgggtgctacgcctgctccagcggcatctcctgcaaggtccggatccacgtggacgagcccgacgagctcaccgtgcacgtcaagagcgaggacccggacatcgtggccgcctccagctccctgatggcgcgcaagctggagttcggcacggacagcaccttcaaggccttctccgccatgcccaagaccagcctctgcttctacatcgtggagcgggagtactgcaagtcctgcagcaaggaggacacccagaagtgcgtcaacacgaagctggagcagccccagtccatcctgatcgagcacaaggggaccatcttcggcaagcagaacgacacgtgcaccgccaaggcgagctgctggctcgagtccgtcaagagcttcttctacgggctgaagaacatgctgtccggcatcttcgggaacgtgttcatcggcgtgttcctcttcctggcccccttcatcatgctgatcctcttcttcatgttcggctggcgcatcctgttctgcttcaagtgctgccggcgcacccgggggctgttcaagtaccgccacctcaaggacgacgaggagatcggctaccggaagatcatcgagcgcctgaacaacaagaaggggaagaacaagctgctcgacggcgagcggctggccgaccgcaagatcgccgagctgttcagcaccaagacccacatcggg

SEQ ID NO: 12248 - RNA, 2916 nt, synthetic construct
  misc_feature 1..2916: note = derived and/or modified CDS sequence (opt1) from CCHFV(SPU 130/89, Artificial)__KJ682807.1__Gn-4aa-Gc
  source 1..2916: mol_type = other RNA
agcgaggagcccaactacgactgcctctcccgcacccagctcctgcggaccgagaacgccgagatccacagcgacaactacggcgggccgggcgacaagatcacgatctgcaacgggtccaccatcgtggaccagcgcctgggcagcgagctcgggtgctacaccatcaaccgggtcaagtccttcaagctgtgcgagaacagcgccaccggcaagtcctgcgagatcgacagcacgcccgtgcgctgccggcagggcttctgcctgaagatcacccaggaggggcgcggccacgtgaagctctcccgggggagcgaggtcgtgctggacgcgtgcgactccagctgcgagatcatgatccccaagggcaccggggacatcctggtggactgctccggcggccagcagcacttcctcaaggacaacctggtcgacctggggtgccccaacatcccgctcctgggcaagatggccatctacatctgccgcatgagcaaccaccccaagaccacgatggccttcctgttctggttctccttcgggtacgtgatcacgtgcatcctctgcaaggtgatcttctacctgctgatcgtcgtgggcaccctcggcaagaagttcaagcagtaccgggagctgaagccccagacctgcaccatctgcgagaccaaccccgtgaacgccatcgacgccgagatgcacgacctgaactgcagctacaacatctgcccgtactgcgcgtcccgcctcaccagcgacgggctggcccggcacgtcatgcagtgccccaagcgcaaggagaagatcgaggagaccgagctgtacctcaacctggagcggatcccctgggtggtgcgcaagctgctccaggtctccgagagcacgggcgtggccctgaagcggagctcctggctggtggtcctcctggtgctgctcaccgtgagcctgtcccccgtccagagcgccccgatctcccgcaagcccctgagcctcgactccatcgtgaaggggatgaagaacctgctgaacagcacctccctcgagaccagcctgtccatcgaggcgccctggggcgccatcaacgtgcagagcacgttcaagcccaccgtctccgccgccaacatcgccctgagctggtccagcgtggagcaccgggggaacaagatcctcgtctccggccgcagcgagtccatcatgaagctggaggagcggaccggcatcagctgggacctgggggtggaggacgcgagcgagtccaagctcctgaccgtgagcgtcatggacctgtcccagatgtacagcccggtgttcgagtacctctccggcgaccgccaggtggaggagtggcccaaggccacgtgcaccggggactgccccgagcggtgcggctgcaccagctccacgtgcctgcacaaggagtggccccacagccgcaactggcgctgcaacccgacctggtgctggggcgtcgggaccggctgcacgtgctgcgggctggacgtgaaggacctgttcaccgactacatgttcgtgaagtggaaggtcgactacatcaagaccgaggccatcgtgtgcgtggagctcacctcccaggagcggcagtgcagcctgatcgaggccggcacccgcttcaacctggggcccgtcaccatcacgctctccgagccccggaacatccagcagaagctgcccccggagatcgtgaccctgcacccccgcatcgaggagggcttcttcgacctcatgcacatccagaaggtgctgagcgcctccaccgtctgcaagctgcagagctgcacccacggggtgcccggcgacctccagatctaccacatcggcaacctgctgaagggggacaaggtgaacggccacctcatccacaagatcgagccccacttcaacacctcctggatgagctgggacgggtgcgacctggactactactgcaacatgggcgactggccgtcctgcagctacacgggcgtcacccagcacaaccacgcggccttcgtgaacatgctgaacatcgagaccgactacaccaagaacttccacttccacagcaagcgggtgacggcccacggggacacgccccagctcgacctgaaggcccgccccacctacggcgccggggagatcaccgtcctggtggaggtggcggacatggagctccacaccaagaaggtcgagatctccggcctgaagttcgccagcctgacctgcaccgggtgctacgcctgctccagcggcatctcctgcaaggtgcggatccacgtggacgagccggacgagctcaccgtccacgtcaagagcgaggaccccgacatcgtggccgcctccagctccctgatggcgcgcaagctggagttcggcacggacagcaccttcaaggccttctccgccatgcccaagaccagcctctgcttctacatcgtggagcgggagcactgcaagtcctgcagcaaggaggacacccagcgctgcgtgaacacgaagctggagcagccccagtccatcctgatcgagcacaaggggaccatcatcggcaagcagaacgacacgtgcaccgccaaggcgagctgctggctcgagtccatcaagagcttcttctacgggctgaagaacatgctgtccggcatcttcgggaacgtgttcatcggcgtcttcctcttcctggccccgttcatcatcctgatcctcttcttcatgttcggctggcggatcctgttctgcttcaagtgctgccgccggacccgcgggctgctcaagtaccggcacctgaaggacgacgaggagatcggctaccgcaagatcatcgagcggctgaacaacaagaaggggaagaacaagctcctggacggcgagcgcctggccgaccggaagatcgccgagctgttcagcaccaagacccacatcggg

SEQ ID NO: 12249 - RNA, 2916 nt, synthetic construct
  misc_feature 1..2916: note = derived and/or modified CDS sequence (opt1) from CCHFV(SPU 497/88, Artificial)__KJ682808.1__Gn-4aa-Gc
  source 1..2916: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggaagggccacgtgaagctcagccgcgggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccggatgtccaaccacccgaagaccacgatggtgttcctgttctggttcagcttcgggtacgtgatcacgtgcatcctctgcaaggtcatcttctacctgctgatcgtggtgggcaccctcggcaagaagttcaagcagtaccgcgagctgaagccccagacctgcaccatctgcgagaccaaccccgtcaacgccatcgacgccgagatgcacgacctgaactgctcctacaacatctgcccctactgcgccagccggctcacctccgacgggctggcgcgccacgtgatgcagtgcccgaagcggaaggagaagatcgaggagaccgagctgtacctcaacctggagcgcatcccctgggtggtccggaagctgctccaggtgagcgagagcacgggcgtggccctgaagcgctccagctggctggtcatcctcctggtgctgctcaccgtgtccctgagccccgtccagtccgcccccatcagccggaagccgctgttcctcgactccatcgtgaaggggatgcgcaacctgctgaacagcacctccctcgagaccagcctgtccatcgaggccccctggggcgcgatcaacgtgcagagcacgttcaagcccaccgtctccgccgccaacatcgccctgagctggtccagcgtggagcaccgggggaacaagatcctcgtctccggccgcagcgagtccatcatgaagctggaggagcggaccggcatcagctgggacctgggggtggaggacgccagcgagtccaagctcctgaccgtgagcgtcatggacctgtcccagatgtacagccccgtgttcgagtacctctccggcgaccgccaggtggaggagtggccgaaggcgacgtgcaccggggactgccccgagcggtgcggctgcaccagctccacgtgcctgcacaaggagtggccccacagccgcaactggcgctgcaaccccacctggtgctggggcgtcgggaccggctgcacgtgctgcgggctggacgtgaaggacctgttcaccgactacatgttcgtgaagtggaaggtcgactacatcaagaccgaggccatcgtgtgcgtggagctcacctcccaggagcggcagtgcagcctgatcgaggccggcacccgcttcaacctggggccggtcaccatcacgctctccgagccccggaacatccagcagaagctgccgcccgagatcgtgaccctgcacccccgcatcgaggagggcttcttcgacctcatgcacatccagaaggtgctgagcgcctccaccgtctgcaagctgcagagctgcacccacggggtgcccggcgacctccagatctaccacatcggcaacctgctgaagggggacaaggtgaacggccacctcatccacaagatcgagccccacttcaacacctcctggatgagctgggacgggtgcgacctggactactactgcaacatgggcgactggccctcctgcagctacacgggcgtcacccagcacaaccacgccgcgttcgtgaacatgctgaacatcgagaccgactacaccaagaacttccacttccacagcaagcgggtgacggcccacggggacaccccgcagctcgacctgaaggcccgccccacctacggcgccggggagatcaccgtcctggtggaggtggccgacatggagctccacacgaagaagatcgagatctccggcctgaagttcgcgagcctgacctgcaccgggtgctacgcctgctccagcggcatctcctgcaaggtccggatccacgtggacgagcccgacgagctcaccgtgcacgtcaagagcgaggacccggacatcgtggccgcctccagctccctgatggcccgcaagctggagttcggcacggacagcaccttcaaggcgttctccgccatgcccaagaccagcctctgcttctacatcgtggagcgggagtactgcaagtcctgcagcaaggaggacacccagaagtgcgtcaacacgaagctggagcagccccagtccatcctgatcgagcacaaggggaccatcatcggcaagcagaacgacacgtgcaccgcccgcgccagctgctggctcgagtccatcaagagcttcttctacgggctgaagaacatgctgtccggcatcttcgggaacgtgttcatcggcatcttcctcttcttcgcgcccttcatcatgctgatcctgttcttcatgttcggctggcggatcctcttctgcttcaagtgctgccgccggacccgcgggctgttcaagtaccggcacctgaaggacgacgaggaggtgggctaccgcaagatcatcgagcggctcaacaacaagaaggggaagaacaagctgctggacggcgagcgcctcgccgaccggaagatcgccgagctgttcagcaccaagacccacatcggg

SEQ ID NO: 12250 - RNA, 2916 nt, synthetic construct
  misc_feature 1..2916: note = derived and/or modified CDS sequence (opt1) from CCHFV(SPU 18/88, Artificial)__KJ682810.1__Gn-4aa-Gc
  source 1..2916: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggggttcctgttctggttcagcttcggctacgtgatcacgtgcatcctctgcaaggtgatcttctacctgctgatcgtcgtgggcaccctcgggaagaagttcaagcagtaccgggagctgaagccccagacctgcaccatctgcgagaccaaccccgtgaacgccatcgacgccgagatgcacgacctgaactgctcctacaacatctgcccctactgcgccagccgcctcacctccgacggcctggcgcggcacgtcatgcagtgcccgaagcgcaaggagaagatcgaggagaccgagctgtacctcaacctggagcggatcccctgggtggtgcgcaagctgctccaggtcagcgagagcacgggggtggccctgaagcggtccagctggctggtgatcctcctggtcctgctcaccgtgtccctgagccccgtgcagtccgcccccatcagccgcaagccgctgttcctcgactccatcgtcaagggcaagaagaacctgctgaacagcacctccctcgagaccagcctgtccatcgaggccccctggggcgcgatcaacgtgcagagcacgttcaagcccaccgtgtccgccgccaacatcgccctgagctggtccagcgtcgagcaccgggggaacaagatcctcgtgtccggccgcagcgagtccatcatgaagctggaggagcggaccgggatcagctgggacctgggcgtcgaggacgccagcgagtccaagctcctgaccgtgagcgtgatggacctgtcccagatgtacagccccgtcttcgagtacctctccggggaccgccaggtggaggagtggccgaaggcgacgtgcaccggcgactgccccgagcggtgcgggtgcaccagctccacgtgcctgcacaaggagtggccccacagccgcaactggcgctgcaaccccacctggtgctggggcgtgggcaccgggtgcacgtgctgcggcctggacgtcaaggacctgttcaccgactacatgttcgtgaagtggaaggtggactacatcaagaccgaggccatcgtctgcgtggagctcacctcccaggagcggcagtgcagcctgatcgaggccgggacccgcttcaacctgggcccggtgaccatcacgctctccgagccccggaacatccagcagaagctgccgcccgagatcgtcaccctgcacccccgcatcgaggaggggttcttcgacctcatgcacatccagaaggtgctgagcgcctccaccgtgtgcaagctgcagagctgcacccacggcgtccccggcgacctccagatctaccacatcgggaacctgctgaagggcgacaaggtgaacgggcacctcatccacaagatcgagccccacttcaacacctcctggatgagctgggacggctgcgacctggactactactgcaacatgggcgactggccctcctgcagctacacgggggtgacccagcacaaccacgccgcgttcgtcaacatgctgaacatcgagaccgactacaccaagaacttccacttccacagcaagcgggtgacggcccacggcgacaccccgcagctcgacctgaaggcccgccccacctacggggccggcgagatcaccgtgctggtcgaggtggccgacatggagctccacacgaagaagatcgagatctccgggctgaagttcgcgagcctgacctgcaccggctgctacgcctgctccagcggcatctcctgcaaggtgcggatccacgtcgacgagcccgacgagctcaccgtgcacgtcaagagcgaggacccggacatcgtggccgcctccagctccctgatggcccgcaagctggagttcgggacggacagcaccttcaaggcgttctccgccatgcccaagaccagcctctgcttctacatcgtggagcgggagtactgcaagtcctgcagcaaggaggacacccagaagtgcgtgaacacgaagctggagcagccccagtccatcctgatcgagcacaagggcaccatcatcgggaagcagaacgacacgtgcaccggcaaggccgggtgctggctcgagagcatcaagtccttcttctacggcctgaagaacatgctgagcggcatcttcgggaacgtcttcatcggcatcttcctcttcctggcccccttcatcatgctgatcctcttcttcatgttcgggtggcgcatcctgttctgcttcaagtgctgccggcgcacccggggcctgttcaagtaccgccacctcaaggacgacgaggagatcgggtaccggaagatcatcgagcgcctgaagaacaagaagggcaagaacaagctgctcgacggcgagcggctggcggaccgcaagatcgccgagctgttctccaccaagacccacatcggg

SEQ ID NO: 12251 - RNA, 2916 nt, synthetic construct
  misc_feature 1..2916: note = derived and/or modified CDS sequence (opt1) from CCHFV(SPU 431/85, Artificial)__KJ682812.1__Gn-4aa-Gc
  source 1..2916: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtggaccagcgcctggggtccgagctgggctgctacacgatcaaccgggtcaagagcttcaagctctgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgacagcaactgcgagatcatgatccccaaggggacgggcgacatcctggtggactgctccggcgggcagcagcacttcctgaaggacaacctcatcgacctgggctgccccaacatccccctgctcgggaagatggcgatctacatctgccggatgagcaaccacccgaagaccaccatggccttcctgttctggttctccttcggctacgtgatcacctgcatcctgtgcaaggtcatcttctacctcctgatcgtggccggcacggtggggaagaagttcaagcagtaccgcgagctgcggccccagacctgcaccatctgcgagaccatccccgtcaacgccatcgacgccgagatgcacgacctcaactgcagctacaacatctgcccctactgcgcgtcccgcctgacgagcgacggcctggcccggcacgtgatgcagtgcccgaagcgcaaggagaaggtggaggagaccgagctctacctgaacctggagcggatcccctgggtcgtgcgcaagctcctgcaggtgtccgagagcaccggggtcgccctgaagcggagctcctggctcaccgtgctgctggtgctcctgatcgtcagcctgtcccccgtgcagagcgcccccatcggccgcaagccgctcttcctggactccatcgtgaaggggcggaagaacctgctcaacagcacgtccctggagaccagcctgtccatcgaggcgccctggggcgccatcaacgtccagagcaccttcaagcccaccgtgtccgccgccaacatcgccctcagctggtccagcgtggagcaccgcggcaacaagatcctggtctccgggcggagcgagtccatcatgaagctggaggagcgcacgggcatcagctgggacctcggggtggaggacgcgtccgagagcaagctgctgaccgtcagcgtgatggacctctcccagatgtacagccccgtgttcgagtacctgtccggcgaccggcaggtcgaggagtggccgaaggccacctgcaccggggactgccccgagcgctgcggctgcacgagctccacctgcctgcacaaggagtggccccacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctgatcgaggccggcacgcggttcaacctcgggccggtgaccatcaccctgtccgagccccgcaacatccagcagaagctgccccccgagatcatcaccctccacccgcggatcgaggagggcttcttcgacctgatgcacgtgcagcgcgtcctgagcgcctccaccgtgtgcaagctccagagctgcacgcacggcgtgcccggggacctgcaggtctaccacatcggcaacctgctcaagggggacaaggtgaacggccacctgatccacaagatcgagccccacttcaacacctcctggatgagctgggacggctgcgacctggactactactgcaacatgggggactggccctcctgcacctacaccggcgtgacgcagcacaaccacgcggccttcgtcaacctcctgaacatcgagaccgactacaccaagaacttccacttccacagcaagcgggtgaccgcccacggggacacgccgcagctggacctcaaggcccgccccacctacggcgccggggaggtgaccgtcctggtggaggtggcggacatggagctgcacaccaagaagatcgagatctccggcctcaagttcgccagcctgacgtgcaccggctgctacgcctgcagctccgggatcagctgcaaggtcaagatccacgtggacgagcccgacgagctgaccgtgcacgtcaagtccgaggacccggacatcgtggccgccggcagctccctcatggcgcggaagctggagttcggggccgacagcaccttcaaggccttctccgccatgcccaagacgagcctgtgcttctacatcgtggagcgcgagtactgcaagtcctgcagccgggaggacacccgcaagtgcgtcaacaccaagctcgaccggccccagtccatcctgatcgagcacaagggcaccatcatcgggaagcagaacaacacgtgcaccgcgaaggccagctgctggctggagtccgtgaagagcttcttctacggcctcaagaacatgctgtccggcatcttcgggaacgtgttcatcggcatcttcctgttcatcgcccccttcgtcctcctgatcctgttcttcatgttcgggtggcgcatcctcttctgcttcaagtgctgccggcgcacccggggcctgttcaagtaccgccacctgaaggacgacgaggagaccgggtaccggaagatcatcgagcgcctcaacaacaagaagggcaagaacaagctgctggacggcgagcgcctcgccgaccggaagatcgccgagctgttcagcacgaagtcccacatcggg

SEQ ID NO: 12252 - RNA, 2916 nt, synthetic construct
  misc_feature 1..2916: note = derived and/or modified CDS sequence (opt1) from CCHFV(SPU 48/90, Artificial)__KJ682813.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcatcgacctgggctgccccaagatcccgctgctcgggaagatggccatctacatctgccgcatgtccaaccaccccacgaccaccatggccttcctgttctggttcagcttcggctacgtgatcacgtgcatcctgtgcaaggccatcttctacctcctgatcatcatcggcaccctggggaagcggttccgccagtaccgggagctcaagccccagacctgcaccatctgcgagaccacgcccgtcaacgccatcgacgcggagatgcacgacctgaactgctcctacaacatctgcccgtactgcgccagccgcctgacctccgacggcctcgcccggcacgtgacccagtgccccaagcgcaaggagaaggtggaggagaccgagctgtacctgaacctcgagcggatcccctgggtcgtgcgcaagctgctccaggtgagcgagtccacgggggtcgccctcaagcggagcagctggctgatcgtgctgctcgtgctgttcaccgtctccctgagccccgtgcagtccgcgccgatcggccgcaagcccctcttccgggacagcatcgtgaaggggatgaagaacctgctgaactccaccagcctcgagacctccctgagcatcgaggccccctggggcgccatcaacgtccagtccacgtacaagcccaccgtgagcaccgccaacatcgccctgtcctggagctccgtggagcaccgcggcaacaagatcctcgtcagcgggcggtccgagagcatcatgaagctggaggagcgcaccggcatctcctgggacctgggggtggaggacgcgagcgagtccaagctcctgacggtcagcgtgatggacctgagccagatgtactccccggtgttcgagtacctcagcggcgaccgccaggtcgaggagtggcccaaggcgacctgcaccggggactgccccgagcggtgcggctgcacctccagcacgtgcctgcacaaggagtggccccactcccgcaactggcggtgcaacccgacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcgccagtgctccctgatcgaggccggcacccggttcaacctggggcccgtgaccatcacgctcagcgagccccgcaacatccagcagaagctgcccccggagatcatcaccctgcacccccggatcgaggagggcttcttcgacctcatgcacgtgcagaaggtcctgtccgccagcaccgtgtgcaagctgcagtcctgcacccacggcgtgcccggggacctccaggtctaccacatcggcaacctgctgaagggggacaaggtgaacggccacctcatccacaagatcgagccccacttcaacacgagctggatgtcctgggacggctgcgacctggactactactgcaacatgggggactggccgagctgcacctacaccggcgtgacccagcacaaccgcgcctccttcgtcaacctgctcaacatcgagacggactacaccaagaacttccacttccacagcaagcgggtgaccgcccacggggacacgccccagctggacctgaaggcccgccccacctacggcgccggggagatcaccgtgctcgtcgaggtggccgacatggagctgcacaccaagaagatcgagatctccggcctgaagttcgcgagcctgacctgcacgggctgctacgcctgcagctccgggatcagctgcaaggtgcggatccacgtcgacgagccggacgagctgaccgtgcacgtgaagtccgacgaccccgacgtcgtggccgccagctccagcctgatggcccgcaagctcgagttcggcaccgactccaccttcaaggcgttcagcgccatgcccaagacgtccctgtgcttctacatcgtggagaaggagtactgcaagagctgctccgaggaggacaccaagaagtgcgtcaacaccaagctggagcagccccagagcatcctcatcgagcacaaggggaccatcatcggcaagcagaactccacgtgcaccgccaaggtgagctgctggctggagtccgccaagagcttcttctacgggctgaaggacatgctctccggcatcttcggcaacgtgttcatcgggatcttcctgttcctggcgccgttcatcctcctgatcctgttcttcatgttcggctggcggatcctcctgtgcttcaagtgctgccgccggacccgcgggctgttcaagtaccggcacctcaaggacgacgaggagaccggctaccgccggatcatcgagcgcctgaacaacaagaaggggaagaacaagctgctcgacggcgagcgcctggccgaccggcgcatcgccgagctgttcagcacgaagacccacatcggc

SEQ ID NO: 12253 - RNA, 2916 nt, synthetic construct
  misc_feature 1..2916: note = derived and/or modified CDS sequence (opt1) from CCHFV(SPU 187/90, Artificial)__KJ682814.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgacagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctgaagcgcagcagctggctgatcgtcctgctcgtgctgttcacggtgtccctgagccccgtccagtccgcgccgatcggccggcgccccctcttcctggacagcatcgtgaaggggatgaagaacctgctcaactccaccagcctggagacctccctgagcatcgaggccccctggggcgccatcaacgtgcagtccacctacaagcccacggtcagcaccgccaacatcgccctctcctggagctccgtggagcaccggggcaacaagatcctggtgagcgggcgctccgagagcatcatgaagctggaggagcggaccggcatctcctgggacctcggggtcgaggacgcgagcgagtccaagctgctgaccgtgagcgtcatggacctcagccagatgtactccccggtgttcgagtacctgagcggcgaccgccaggtggaggagtggcccaaggccacgtgcaccggggactgccccgagcgctgcggctgcacctccagcacgtgcctgcacaaggagtggccccactcccggaactggcgctgcaacccgacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcggcagtgctccctgatcgaggccggcacccgcttcaacctcgggcccgtcaccatcaccctgagcgagccccggaacatccagcagaagctgcccccggagatcatcacgctccacccccgcatcgaggagggcttcttcgacctgatgcacgtgcagaaggtgctgtccgccagcaccgtctgcaagctccagtcctgcacccacggcgtgcccggggacctccaggtgtaccacatcggcaacctgctgaagggggacaaggtcaacggccacctgatccacaagatcgagccccacttcaacaccagctggatgtcctgggacggctgcgacctggactactactgcaacatgggggactggccgagctgcacgtacaccggcgtgacccagcacaaccacgcgtccttcgtgaacctcctgaacatcgagaccgactacacgaagaacttccacttccacagcaagcgggtcaccgcccacggggacacgccccagctggacctcaaggcccgccccacctacggcgccggggagatcaccgtgctggtggaggtcgccgacatggagctgcacaccaagaagatcgagatctccggcctcaagttcgcgagcctgacctgcaccggctgctacgcctgcagctccgggatcagctgcaaggtgcggatccacgtggacgagccggacgagctgacggtccacgtgaagtccgacgaccccgacgtggtcgccgccagctccagcctcatggcccgcaagctggagttcggcaccgactccatcttcaaggcgttcagcgccatgcccaagacctccctgtgcttctacatcgtggagcgggagcactgcaagagctgctccgaggaggacaccaagaagtgcgtgaacacgaagctcgagcagccccagagcatcctgatcgagcacaaggggaccatcatcggcaagcagaactccacgtgcaccgccaagaccagctgctggctggagtccgtcaagagcttcttctacgggctcaagaacatgctgtccggcatcttcggcaacgtgttcatcgggatcttcctgttcctcgccccgttcatcctgctgatcctcttcttcatgttcggctggcgcatcctgttctgcttcaagtgctgccggcgcacccgggggctgttcaagtaccgccacctcaaggacgacgaggagaccggctaccggcgcatcatcgagcggctgaacaacaagaaggggaagaacaagctgctcgacggcgagcgcctggcggaccgccggatcgccgagctgttcagcaccaagacgcacatcggc

SEQ ID NO: 12254 - RNA, 2916 nt, synthetic construct
  misc_feature 1..2916: note = derived and/or modified CDS sequence (opt1) from CCHFV(Haskovo-V46/13, Artificial)__KR092379.1__Gn-4aa-Gc
  source 1..2916: mol_type = other RNA
agcgaggagctgggcgacgactgcatctcccgcacccagctcctgcggaccgagacggccgagatccacgacgacaactacgggggccccggggacaagatcaccatctgcaacggcagcaccatcgtggaccagcgcctggggtccgagctcggctgctacaccatcaaccggggcaagagcttcaagctgtgcgagaactccgccacggggaagacctgcgagatcgacagcaccccggtcaagtgccgccagggcttctgcctgaagatcacccaggaggggcggggccacgtgaagctctcccgcgggagcgaggtggtcctggacgcgtgcgactccagctgcgaggtgatgatccccaagggcacgggcgacatcctggtggactgctccgggggccagcagcacttcctcaaggacaacctgatcgacctggggtgcccccacatccccctcctgggcaagatggccatctacatctgccggatgagcaaccacccgcgcaccaccatggccttcctgttctggttctccttcggctacgtcatcacgtgcatcttctgcaaggccctcttctacagcctgatcatcatcgggaccctgggcaagaagatcaagcagtaccgggagctcaagccccagacctgcaccatctgcgagaccacgcccgtgaacgccatcgacgcggagatgcacgacctgaactgctcctacaacatctgcccctactgcgccagccgcctgacctccgacgggctcgcccggcacgtgacccagtgcccgaagcgcaaggagaaggtcgaggagaccgagctgtacctgaacctcgagcggatcccctggatcgtgcgcaagctgctccaggtgagcgagtccacgggcgtcgccctgaagcggagcagctggctgatcgtgctgctcgtgctgctgcccgtctccctcagccccgtgcagtccgcgccggtggggcgcaagcccctgttcctggacagcatcgtcaagggcatgaagaacctcctgaactccaccagcctggagacctccctcagcatcgaggccccctggggcgccatcaacgtgcagtccaccttcaagcccacggtgagcaccgccaacatcgccctgtcctggagctccgtcgagcaccgggggaacaagatcctggtgaccggccgcagcgagtccatcatgaagctcgaggagcggaccggggtgagctgggacctgggcgtcgaggacgcgtccgagagcaagctgctcacggtgtccatcatggacctgagccagatgtacagcccggtcttcgagtacctgtccggggaccgccaggtggaggagtggcccaaggcgacctgcaccggcgactgccccgagcggtgcggctgcaccagctccacgtgcctccacaaggagtggccccacagccgcaactggcgctgcaacccgacctggtgctggggcgtggggaccgggtgcacgtgctgcggcgtcgacgtgaaggacctgttcaccgaccacatgttcgtgaagtggaaggtcgagtacatcaagaccgaggccatcgtgtgcgtggagctgacctcccaggagcggcagtgcagcctgatcgaggccgggacccgcttcaacctcggccccgtcaccatcacgctgtccgagccccggaacatccagcagaagctgcccccggagatcatcaccctccaccccaagatcgaggagggcttcttcgacctgatgcacgtgcagaaggtgctgagcgcctccaccgtctgcaagctccagagctgcacccacgggatccccggcgacctccaggtgtaccacatcgggaacctgctgaagggcgaccgcgtgaacggccacctgatccacaagatcgagccccacttcaacacgtcctggatgagctgggacgggtgcgacctggactactactgcaacatgggcgactggccgtcctgcacctacaccggggtcacccagcacaaccacgccgccttcgtgaacctcctgaacatcgagacggactacaccaagaccttccacttccacagcaagcgggtgaccgcccacggcgacacgccccagctggacctcaaggcccgccccacctacggggccggcgagatcaccgtcctggtggaggtggcggacatggagctgcacaccaagaaggtcgagatctccggcctcaagttcgccagcctgacgtgcaccgggtgctacgcctgctccagcggcatcagctgcaaggtgcggatccacgtggacgagccggacgagctgaccgtccacgtgaagtccagcgaccccgacgtggtcgccgccgggacctccctcatggcgcgcaagctggagttcggcacggacagcaccttcaaggccttctccgccatgcccaagaccagcctgtgcttctacatcgtggagcgggagtactgcaagtcctgcagcgaggacgacacccagaagtgcgtggacacgaagctcgagcagccccagtccatcctgatcgagcacaaggggaccatcatcggcaagcagaacgacacgtgcaccgcccgcgcgagctgctggctggagtccgtcaagagcttcttctacggcctcaagaacatgctggggtccgtgttcggcaacttcctgatcgggatcctcctgttcctggccccgttcgtgctcctggtcctgttcttcatgttcggctggaagatcctcttctgcttcaagtgctgccggcgcacccgggggctgttcaagtaccgccacctgaaggacgacgaggagaccggctaccggcgcatcatcgagcggctcaacagcaagaagggcaagaaccgcctgctggacggggagcggctcgccgaccgcaagatcgccgagctgttctccaccaagacccacatcggc

SEQ ID NO: 12255 - RNA, 2916 nt, synthetic construct
  misc_feature 1..2916: note = derived and/or modified CDS sequence (opt1) from CCHFV(24-R-2012, Artificial)__KR814856.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtgaacgcgatcgacgccgagatgcacgacctcaactgcagctacaacatctgcccgtactgcgcctcccgcctgaccagcgacggcctggcccggcacgtcccccagtgccccaagcgcaaggagaaggtggaggagaccgagctctacctgaacctggagcggatcccctggatcgtgcgcaagctcctgcaggtctccgagagcaccggggtggcgctgaagcggtccagctggctcatcgtgctgctggtcctcctgacggtgagcctgtccccggtgcagagcgcccccgtcggccgcaagcccctcttcctggactccatcgtgaaggggatgaagaacctgctcaacagcacctccctggagaccagcctgtccatcgaggccccctggggcgccatcaacgtgcagagcaccttcaagccgacggtctccaccgccaacatcgcgctcagctggtccagcgtggagcaccggggcaacaagatcctggtgaccgggcgctccgagagcatcatgaagctggaggagcggaccggcgtctcctgggacctcggggtggaggacgccagcgagtccaagctgctgacggtcagcatcatggacctctcccagatgtacagccccgtgttcgagtacctgagcggcgaccgccaggtggaggagtggcccaaggcgacctgcaccggggactgccccgagcggtgcggctgcacctccagcacgtgcctgcacaaggagtggccgcactcccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgaccagccaggagcggcagtgctccctgatcgaggccggcacccgcttcaacctggggcccgtgaccatcacgctcagcgagccccggaacatccagcagaagctgccgcccgagatcatcaccctgcaccccaaggtggaggagggcttcttcgacctcatgcacgtccagaaggtgctgtccgccagcaccgtgtgcaagctgcagtcctgcacccacggcatccccggggacctccaggtctaccacatcggcaacctgctgaagggggaccgcgtgaacggccacctcatccacaagatcgagccgcacttcaacacgagctggatgtcctgggacggctgcgacctggactactactgcaacatgggggactggcccagctgcacctacaccggcgtgacccagcacaaccacgccgccttcgtcaacctgctcaacatcgagacggactacaccaagaccttccacttccactccaagcgggtgaccgcccacggggacacgccccagctggacctgaaggcccgcccgacctacggcgcgggggagatcaccgtgctcgtcgaggtggccgacatggagctgcacaccaagaaggtggagatcagcggcctgaagttcgcctccctcgcctgcacgggctgctacgcctgcagctccgggatcagctgcaaggtccggatccacgtggacgagcccgacgagctgaccgtgcacgtcaagagcaacgaccccgacgtggtggcggcctccaccagcctgatggcccgcaagctcgagttcggcaccgactccacgttcaaggccttcagcgcgatgcccaagacctccctgtgcttctacatcgtcgagcgggagtactgcaagagctgctccgaggaggacacccagaagtgcgtggacaccaagctggagcagccgcagagcatcctcatcgagcacaaggggacgatcatcggcaagcagaacgacacgtgcaccgccaaggcctcctgctggctggagagcgtgaagtccttcttctacgggctgaagaacatgctcggcagcgtcttcggcaacttcttcatcgggatcctgctgttcctcgcccccttcgtgctgctggtgctgttcttcatgttcggctggaagatcctcttctgcttcaagtgctgccgccggacccgcgggctgctcaagtaccggctgctgaaggacgacgaggagaccggctaccgccggatcatcgagcgcctcaacaacaagaaggggaagaaccggctgctggacggcgagcgcctcgccgaccggaagatcgcggagctgttctccaccaagacccacatcggc

SEQ ID NO: 12256 - RNA, 2916 nt, synthetic construct
  misc_feature 1..2916: note = derived and/or modified CDS sequence (opt1) from CCHFV(36-ST-2014, Artificial)__KR814857.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccggaagcccctcttcctggacagcatcgtcaaggggatgaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcggcaacaagatcctggtgaccgggcggagcgagtccatcatgaagctggaggagcgcaccggcgtgagctgggacctcggggtcgaggacgcctccgagagcaagctgctgacggtgtccatcatggacctcagccagatgtacagcccggtcttcgagtacctgtccggcgaccgccaggtggaggagtggcccaaggcgacctgcaccggggactgccccgagcggtgcggctgcaccagctccacgtgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggccggcacccggttcaacctggggcccgtgaccatcacgctctccgagccccgcaacatccagcagaagctgcccccggagatcatcaccctgcaccccaagatcgaggagggcttcttcgacctcatgcacgtccagaaggtgctgagcgcctccaccgtgtgcaagctgcagagctgcacccacggcatccccggggacctccagatctaccacatcggcaacctgctgaagggggaccggctcaacggccacctgatccacaagatcgagccccacttcaacacgtcctggatgagctgggacggctgcgacctggactactactgcaacatgggggactggccgtcctgcacctacaccggcgtcacccagcacaaccacgccgccttcgtgaacctcctgaacatcgagacggactacaccaagaccttccacttccacagcaagcgcgtgaccgcccacggggacacgccccagctggacctcaaggcccggcccacctacggcgcgggggagatcaccgtcctggtggaggtggccgacatggagctgcacaccaagaaggtcgagatctccggcctcaagttcgccagcctggcctgcacgggctgctacgcctgctccagcgggatcagctgcaaggtgcgcatccacgtggacgagccggacgagctgaccgtccacgtgaagtccagcgaccccgacgtggtcgcggcctccaccagcctcatggcccggaagctggagttcggcaccgactccacgttcaaggccttcagcgcgatgcccaagacctccctgtgcttctacatcgtggagcgcgagtactgcaagagctgctccgaggacgacaccaagaagtgcgtggacaccaagctcgaccagccccagagcatcctgatcgagcacaaggggacgatcatcggcaagcagaacgacacgtgcaccgccaaggcctcctgctggctggagagcgtcaagtccttcttctacgggctcaagaacatgctgggcagcgtgttcggcaacttcttcgtggggatcctcctcttcctggccccgttcgtcctgctcgtgctgttcttcatgtgcggctggaagttcctgttctgcttcaagtgctgccggcgcacccgggggctgttcaagtaccgccacctgaaggacgacgaggagaccggctaccggcgcatcatcgagcggctgaactccaagaaggggaagaaccgcctcctggacggcgagcggctggccgaccgcaagatcgcggagctgttcagcaccaagtcccacatcggc

SEQ ID NO: 12257 - RNA, 2916 nt, synthetic construct
  misc_feature 1..2916: note = derived and/or modified CDS sequence (opt1) from CCHFV(37-R-2013, Artificial)__KR814858.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtgaacgcgatcgacgccgagatgcacgacctcaactgcagctacaacatctgcccgtactgcgcctcccgcctgaccagcgacggcctggcccggcacgtcccccagtgccccaagcgcaaggagaaggtggaggagaccgagctctacctgaacctggagcggatcccctggatcgtgcgcaagctcctgcaggtctccgagagcaccggggtggcgctgaagcggtccagctggctcatcgtgctgctggtcctcctgacggtgagcctgtccccggtgcagagcgcccccgtcggccgcaagcccctcttcctggactccatcgtgaaggggatgaagaacctgctcaacagcacctccctggagaccagcctgtccatcgaggccccctggggcgccatcaacgtgcagagcaccttcaagccgacggtctccaccgccaacatcgcgctcagctggtccagcgtggagcaccggggcaacaagatcctggtgaccgggcgctccgagagcatcatgaagctggaggagcggaccggcgtctcctgggacctcggggtggacgacgccagcgagtccaagctgctgacggtcagcatcatggacctctcccagatgtacagccccgtgttcgagtacctgagcggcgaccgccaggtggaggagtggcccaaggcgacctgcaccggggactgccccgagcggtgcggctgcacctccagcacgtgcctgcacaaggagtggccgcactcccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgaccagccaggagcggcagtgctccctgatcgaggccggcacccgcttcaacctggggcccgtgaccatcacgctcagcgagccccggaacatccagcagaagctgccgcccgagatcatcaccctgcaccccaaggtggaggagggcttcttcgacctcatgcacgtccagaaggtgctgtccgccagcaccgtgtgcaagctgcagtcctgcacccacggcatccccggggacctccaggtctaccacatcggcaacctgctgaagggggaccgcgtgaacggccacctcatccacaagatcgagccgcacttcaacacgagctggatgtcctgggacggctgcgacctggactactactgcaacatgggggactggcccagctgcacctacaccggcgtgacccagcacaaccacgccgccttcgtcaacctgctcaacatcgagacggactacaccaagaccttccacttccactccaagcgggtgaccgcccacggggacacgccccagctggacctgaaggcccgcccgacctacggcgcgggggagatcaccgtgctcgtcgaggtggccgacatggagctgcacaccaagaaggtggagatcagcggcctgaagttcgcctccctcgcctgcacgggctgctacgcctgcagctccgggatcagctgcaaggtccggatccacgtggacgagcccgacgagctgaccgtgcacgtcaagagcaacgaccccgacgtggtggcggcctccaccagcctgatggcccgcaagctcgagttcggcaccgactccacgttcaaggccttcagcgcgatgcccaagacctccctgtgcttctacatcgtcgagcgggagtactgcaagagctgctccgaggaggacacccagaagtgcgtggacaccaagctggagcagccgcagagcatcctcatcgagcacaaggggacgatcatcggcaagcagaacgtgacctgcaccgccaaggcctcctgctggctggagagcgtcaagtccttcttctacgggctgaagaacatgctcggcagcgtgttcggcaacttcttcatcgggatcctgctgttcctcgcccccttcgtgctgctggtcctcttcttcatgttcggctggaagatcctgttctgcttcaagtgctgccgccggacccgcgggctgctcaagtaccggctgctgaaggacgacgaggagacgggctaccgccggatcatcgagcgcctcaacaacaagaaggggaagaaccggctgctggacggcgagcgcctcgccgaccggaagatcgcggagctgttctccaccaagacccacatcggc

SEQ ID NO: 12258 - RNA, 2916 nt, synthetic construct
  misc_feature 1..2916: note = derived and/or modified CDS sequence (opt1) from CCHFV(44-ST-2010, Artificial)__KR814859.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgctgtggttctccttcggctacgtcatcacgtgcatcttctgcaaggccctcttctacagcctgatcatcatcggcaccctggggaagaagatcaagcagtaccgcgagctcaagccccagacctgcaccatctgcgagaccgcccccgtgaacgcgatcgacgccgagatgcacgacctgaactgctcctacaacatctgcccgtactgcgccagccggctgacgtccgacggcctcgcccgccacgtgacccagtgccccaagcggaaggagaaggtcgaggagaccgagctgtacctgaacctcgagcgcatcccctggatcgtgcggaagctgctccaggtgagcgagtccaccggggtcgcgctgaagcgcagcagctggctgatcgtgctgctcgtgctgctgacggtctccctcagccccgtgcagtccgccccggtgggccggaagcccctgttcctggacagcatcgtcaaggggatgaagaacctcctgaactccaccagcctggagacctccctcagcatcgaggccccctggggcgccatcaacgtgcagtccaccttcaagcccacggtgagcaccgccaacatcgcgctgtcctggagctccgtcgagcaccgcggcaacaagatcctggtgaccgggcggagcgagtccatcatgaagctcgaggagcgcaccggcgtgagctgggacctgggggtcgaggacgcctccgagagcaagctgctcacggtgtccatcatggacctgagccagatgtacagcccggtcttcgagtacctgtccggcgaccgccaggtggaggagtggcccaaggcgacctgcaccggggactgccccgagcggtgcggctgcaccagctccacgtgcctccacaaggagtggccccacagccggaactggcgctgcaacccgacctggtgctggggcgtggggaccggctgcacgtgctgcggggtcgacgtgaaggacctgttcaccgaccacatgttcatcaagtggaaggtggagtacatcaagaccgaggccatcgtctgcgtggagctgacctcccaggagcgccagtgcagcctgatcgaggccggcacccggttcaacctcgggcccgtgaccatcacgctgtccgagccccgcaacatccagcagaagctgcccccggagatcatcaccctccaccccaagatcgaggagggcttcttcgacctgatgcacgtccagaaggtgctgagcgcctccaccgtgtgcaagctccagagctgcacccacggcatccccggggacctgcagatctaccacatcggcaacctgctcaagggggaccggctgaacggccacctgatccacaagatcgagccccacttcaacacgtcctggatgagctgggacggctgcgacctcgactactactgcaacatgggggactggccgtcctgcacctacaccggcgtcacccagcacaaccacgccgccttcgtgaacctgctgaacatcgagacggactacaccaagaccttccacttccacagcaagcgcgtgaccgcccacggggacacgccccagctcgacctgaaggcccggcccacctacggcgcgggggagatcaccgtcctggtggaggtggccgacatggagctccacaccaagaaggtcgagatctccggcctgaagttcgccagcctggcctgcacgggctgctacgcctgctccagcgggatcagctgcaaggtgcgcatccacgtggacgagccggacgagctcaccgtccacgtgaagtccagcgaccccgacgtggtcgcggcctccaccagcctgatggcccggaagctggagttcggcaccgactccacgttcaaggccttcagcgcgatgcccaagacctccctctgcttctacatcgtggagcgcgagtactgcaagagctgctccgaggacgacaccaagaagtgcgtggacaccaagctggaccagccccagagcatcctgatcgagcacaaggggacgatcatcggcaagcagaacgacacgtgcaccgccaaggcctcctgctggctcgagagcgtcaagtccttcttctacgggctgaagaacatgctgggcagcgtgttcggcaacttcttcgtggggatcctcctgttcctggccccgttcgtcctcctggtgctgttcttcatgtgcggctggaagatcctcttctgcttcaagtgctgccggcgcacccgggggctgttcaagtaccgccacctgaaggacgacgaggagaccggctaccggcgcatcatcgagcggctcaactccaagaaggggaagaaccgcctgctggacggcgagcggctcgccgaccgcaagatcgcggagctgttcagcaccaagtcccacatcggc

SEQ ID NO: 12259 - RNA, 2916 nt, synthetic construct
  misc_feature 1..2916: note = derived and/or modified CDS sequence (opt1) from CCHFV(46-ST-2012, Artificial)__KR814860.1__Gn-4aa-Gc
  source 1..2916: mol_type = other RNA
agcgaggagcccggcgacgactgcatctcccgcacccagctcctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggatgaagaacctgctcaactccacgagcctggagacctccctgagcatcgaggccccctggggcgccatcaacgtgcagtccaccttcaagccgaccgtcagcacggccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgaccgtctccatcatggacctcagccagatgtacagccccgtgttcgagtacctgtccggcgaccgccaggtggaggagtggcccaaggccacgtgcaccggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcaccctctccgagccccggaacatccagcagaagctgccgcccgagatcatcacgctgcaccccaaggtggaggagggcttcttcgacctcatgcacgtccagaaggtgctgagcgcgtccaccgtgtgcaagctgcagagctgcacccacggcatccccggggacctccaggtctaccacatcggcaacctgctgaagggggaccgcatcaacggccacctcatccacaagatcgagccgcacttcaacacctcctggatgagctgggacggctgcgacctggactactactgcaacatgggggactggccctcctgcacgtacaccggcgtgacccagcacaaccacgccgccttcgtgaacctgctcaacatcgagaccgactacacgaagaccttccacttccacagcaagcgggtcaccgcccacggggacacgccccagctggacctgaaggcccgcccgacctacggcgcgggggagatcaccgtgctcgtggaggtcgccgacatggagctgcacaccaagaaggtggagatctccggcctgaagttcgccagcctcgcctgcaccggctgctacgcctgctccagcgggatcagctgcaaggtgcggatccacgtcgacgagcccgacgagctgacggtgcacgtgaagtccagcgaccccgacgtcgtggcggcctccaccagcctgatggcccgcaagctcgagttcggcaccgactccaccttcaaggccttcagcgcgatgcccaagacgtccctgtgcttctacatcgtggagcgggagtactgcaagagctgctccgaggaggacacccagaagtgcgtcgacacccgcctggagcagccgcagagcatcctcatcgagcacaaggggaccatcatcggcaagcagaacgacacgtgcaccgccaaggcctcctgctggctggagagcgtgaagtccttcttctacgggctgaagaacatgctcggcagcgtgttcggcaacttcttcatcgggatcctgctgttcctcgcccccttcgtcctgctggtgctgttcttcatgttcggctggaagatcctcttctgcttcaagtgctgccggcgcacccgggggctgctcaagtaccgccacctgaaggacgacgaggagaccggctaccggcgcatcatcgagcggctgaacaacaagaaggggaagaaccgcctcctggacggcgagcggctggccgaccgcaagatcgcggagctgttctccacgaagacccacatcggc

SEQ ID NO: 12260 - RNA, 2916 nt, synthetic construct
  misc_feature 1..2916: note = derived and/or modified CDS sequence (opt1) from CCHFV(47-ST-2013, Artificial)__KR814861.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctgatcgtgctgctggtgctcctgacggtctccctgagccccgtgcagtccgccccggtgggccggaagcccctcttcctggacagcatcgtcaaggggatgaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcggcaacaagatcctggtgaccgggcggagcgagtccatcatgaagctggaggagcgcaccggcgtgagctgggacctcggggtcgaggacgcctccgagagcaagctgctgacggtgtccatcatggacctcagccagatgtacagcccggtcttcgagtacctgtccggcgaccgccaggtggaggagtggcccaaggcgacctgcaccggggagtgccccgagcggtgcggctgcaccagctccacgtgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggccggcacccggttcaacctggggcccgtgaccatcacgctctccgagccccgcaacatccagcagaagctgcccccggagatcatcaccctgcaccccaagatcgaggagggcttcttcgacctcatgcacgtccagaaggtgctgagcgcctccaccgtgtgcaagctgcagagctgcacccacggcatccccggggacctccagatctaccacatcggcaacctgctgaagggggaccgggtcaacggccacctcatccacaagatcgagccccacttcaacacgtcctggatgagctgggacggctgcgacctggactactactgcaacatgggggactggccgtcctgcacctacaccggcgtgacccagcacaaccacgccgccttcgtgaacctgctcaacatcgagacggactacaccaagaccttccacttccacagcaagcgcgtcaccgcccacggggacacgccccagctggacctgaaggcccggcccacctacggcgcgggggagatcaccgtgctcgtggaggtcgccgacatggagctgcacaccaagaaggtggaggtgtccggcctgaagttcgccagcctcgcctgcacgggctgctacgcctgctccagcgggatcagctgcaaggtccgcatccacgtggacgagccggacgagctgaccgtgcacgtcaagtccagcgaccccgacgtggtggcggcctccaccagcctgatggcccggaagctcgagttcggcaccgactccacgttcaaggccttcagcgcgatgcccaagacctccctgtgcttctacatcgtcgagcgcgagtactgcaagagctgctccgaggacgacaccaagaagtgcgtggacaccaagctggagcagccccagagcatcctcatcgagcacaaggggacgatcatcggcaagcagaacgacacgtgcaccgccaaggcctcctgctggctggagagcgtgaagtccttcttctacgggctgaagaacatgctcggcagcgtcttcggcaacttcttcgtggggatcctgctgttcctcgccccgttcgtgctgctggtcctcttcttcatgttcggctggaagatcctgttctgcttcaagtgctgccggcgcacccgggggctgttcaagtaccgccacctcaaggacgacgaggagaccggctaccggcgcatcatcgagcggctgaactccaagaaggggaagaaccgcctgctcgacggcgagcggctggccgaccgcaagatcgcggagctgttcagcaccaagacccacatcggc

SEQ ID NO: 12261 - RNA, 2916 nt, synthetic construct
  misc_feature 1..2916: note = derived and/or modified CDS sequence (opt1) from CCHFV(52-R-2014, Artificial)__KR814862.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacgtgccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtcaacgcgatcgacgccgagatgcacgacctcaactgcagctacaacatctgcccgtactgcgcctcccgcctgaccagcgacggcctggcccggcacgtgccccagtgccccaagcgcaaggagaaggtggaggagaccgagctctacctgaacctggagcggatcccctggatcgtccgcaagctcctccaggtgtccgagagcaccggggtggcgctgaagcggtccagctggctgatcgtcctgctggtgctcctgacggtgagcctgtccccggtccagagcgcccccgtgggccgcaagcccctcttcctggactccatcgtgaaggggatgaagaacctgctcaacagcacctccctggagaccagcctgtccatcgaggccccctggggcgccatcaacgtccagagcaccttcaagccgacggtgtccaccgccaacatcgcgctcagctggtccagcgtggagcaccggggcaacaagatcctggtcaccgggcgctccgagagcatcatgaagctggaggagcggaccggcgtgtcctgggacctcggggtcgacgacgccagcgagtccaagctgctgacggtgagcatcatggacctctcccagatgtacagccccgtgttcgagtacctgagcggcgaccgccaggtcgaggagtggcccaaggcgacctgcaccggggactgccccgagcggtgcggctgcacctccagcacgtgcctgcacaaggagtggccgcactcccgcaactggcgctgcaaccccacctggtgctggggcgtggggaccggctgcacgtgctgcggggtggacgtcaaggacctcttcaccgaccacatgttcgtgaagtggaaggtggagtacatcaagaccgaggccatcgtctgcgtggagctgaccagccaggagcggcagtgctccctgatcgaggccggcacccgcttcaacctggggcccgtgaccatcacgctcagcgagccccggaacatccagcagaagctgccgcccgagatcatcaccctgcaccccaaggtcgaggagggcttcttcgacctcatgcacgtgcagaaggtgctgtccgccagcaccgtctgcaagctgcagtcctgcacccacggcatccccggggacctccaggtgtaccacatcggcaacctgctgaagggggaccgcgtgaacggccacctcatccacaagatcgagccgcacttcaacacgagctggatgtcctgggacggctgcgacctggactactactgcaacatgggggactggcccagctgcacctacaccggcgtcacccagcacaaccacgccgccttcgtgaacctgctcaacatcgagacggactacaccaagaccttccacttccactccaagcgggtgaccgcccacggggacacgccccagctggacctgaaggcccgcccgacctacggcgcgggggagatcaccgtcctcgtggaggtggccgacatggagctgcacaccaagaaggtcgagatcagcggcctgaagttcgcctccctcgcctgcacgggctgctacgcctgcagctccgggatcagctgcaaggtgcggatccacgtggacgagcccgacgagctgaccgtccacgtcaagagcaacgaccccgacgtggtggcggcctccaccagcctgatggcccgcaagctcgagttcggcaccgactccacgttcaaggccttcagcgcgatgcccaagacctccctgtgcttctacatcgtggagcgggagtactgcaagagctgctccgaggaggacacccagaagtgcgtggacaccaagctggagcagccgcagagcatcctcatcgagcacaaggggacgatcatcggcaagcagaacgacacgtgcaccgccaaggccgggtgctggctggagtccgtcaagagcttcttctacggcctgaagaacatgctcggctccgtgttcgggaacttcttcatcggcatcctgctgttcctcgcccccttcgtgctgctggtcctcttcttcatgttcgggtggaagatcctgttctgcttcaagtgctgccgccggacccgcggcctgctcaagtaccggctgctgaaggacgacgaggagaccgggtaccgccggatcatcgagcgcctcaacaacaagaagggcaagaaccggctgctggacggcgagcgcctcgccgaccggaagatcgcggagctgttcagcaccaagacccacatcggg

SEQ ID NO: 12262 - RNA, 2916 nt, synthetic construct
  misc_feature 1..2916: note = derived and/or modified CDS sequence (opt1) from CCHFV(75-R-2012, Artificial)__KR814863.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcgcgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccccacatcccgctgctcgggaagatggccatctacatctgccggatgagcaaccacccccgcacgaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcgcccgtgaacgccatcgacgccgagatgcacgacctcaactgctcctacaacatctgcccgtactgcgccagccgcctgacctccgacggcctggcgcggcacgtcccccagtgccccaagcgcaaggagaaggtggaggagacggagctctacctgaacctggagcggatcccctggatcgtgcgcaagctcctgcaggtcagcgagtccaccggggtggccctgaagcggagcagctggctcatcgtgctgctggtcctcctgaccgtgtccctgagcccggtgcagtccgcccccgtcggccgcaagcccctcttcctggacagcatcgtgaaggggatgaagaacctgctcaactccaccagcctggagacgtccctgagcatcgaggccccctggggcgccatcaacgtgcagtccaccttcaagccgaccgtcagcaccgcgaacatcgccctctcctggagctccgtggagcaccggggcaacaagatcctggtgacggggcgcagcgagtccatcatgaagctggaggagcggaccggcgtcagctgggacctcggggtggaggacgcctccgagagcaagctgctgaccgtctccatcatggacctcagccagatgtacagccccgtgttcgagtacctgtccggcgaccgccaggtggaggagtggcccaaggcgacctgcacgggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcaccctctccgagccccggaacatccagcagaagctgccgcccgagatcatcaccctgcaccccaaggtggaggagggcttcttcgacctcatgcacgtccagaaggtgctgagcgcctccacggtgtgcaagctgcagagctgcacccacggcatccccggggacctccaggtctaccacatcggcaacctgctgaagggggaccgcgtgaacggccacctcatccacaagatcgagccgcacttcaacacctcctggatgagctgggacggctgcgacctggactactactgcaacatgggggactggccctcctgcacctacacgggcgtgacccagcacaaccacgccgccttcgtcaacctgctcaacatcgagaccgactacaccaagacgttccacttccacagcaagcgggtgaccgcccacggggacacgccccagctggacctgaaggcgcgcccgacctacggcgccggggagatcaccgtgctcgtcgaggtggccgacatggagctgcacaccaagaaggtggagatctccggcctgaagttcgccagcctcgcctgcaccggctgctacgcgtgctccagcgggatcagctgcaaggtccggatccacgtggacgagcccgacgagctgaccgtgcacgtcaagtccagcgaccccgacgtggtggccgcctccacgagcctgatggcccgcaagctcgagttcggcaccgactccaccttcaaggcgttcagcgccatgcccaagacctccctgtgcttctacatcgtcgagcgggagtactgcaagagctgctccgaggaggacacgcagaagtgcgtggacaccaagctggagcagccgcagagcatcctcatcgagcacaaggggaccatcatcggcaagcagaacgacacgtgcaccgccaaggcctcctgctggctggagagcgtgaagtccttcctgtacgggctcaagaacatgctgggcagcgtcttcggcaacttcttcatcgggatcctcctgttcctggcccccttcgtgctgctcgtgctgttcttcatgttcggctggaagatcctgttctgcttcaagtgctgccgccggacccgcgggctcctgaagtaccggctgctcaaggacgacgaggagaccggctaccgccggatcatcgagcgcctgaacaacaagaaggggaagaaccggctgctcgacggcgagcgcctggcggaccggaagatcgccgagctgttctccaccaagacgcacatcggc

SEQ ID NO: 12263 - RNA, 2916 nt, synthetic construct
  misc_feature 1..2916: note = derived and/or modified CDS sequence (opt1) from CCHFV(75-ST-2010, Artificial)__KR814864.1__Gn-4aa-Gc
  source 1..2916: mol_type = other RNA
agcgaggagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacctgcgagatcgactccaccccggtgaagtgccgccaggggttctgcctgaagatcacccaggagggccgggggcacgtgaagctgagccgcggctccgaggtcgtgctcgacgcgtgcgacagctcctgcgaggtgatgatccccaaggggacgggcgacatcctggtcgactgcagcggcgggcagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcctgttctgcaaggccctcttctactccctgatcatcatcggcaccctggggaagaagatcaagcagtaccgggagctccgcccccagacctgcaccatctgcgagaccgcccccgtgaacgcgatcgacgccgagatgcacgacctgaactgcagctacaacatctgcccctactgcgcctcccggctgacgagcgacggcctcgcccgccacgtcccgcagtgccccaagcggaaggagaaggtggaggagaccgagctgtacctgaacctcgagcgcatcccctggatcgtgcggaagctgctgcaggtctccgagagcaccggggtggcgctcaagcgcagctcctggctgatcgtgctgctcgtcctgctgaccgtgagcctctcccccgtgcagagcgccccggtcggccggaagcccctgttcctggactccatcgtgaaggggatgaagaacctcctgaacagcacgtccctggagaccagcctctccatcgaggccccctggggcgccatcaacgtgcagagcaccttcaagcccaccgtctccacggccaacatcgcgctgagctggtccagcgtggagcaccgcggcaacaagatcctggtgaccgggcggtccgagagcatcatgaagctcgaggagcgcaccggcgtctcctgggacctgggggtggaggacgccagcgagtccaagctgctcaccgtcagcatcatggacctgagccagatgtactccccggtgttcgagtacctgagcggcgaccgccaggtggaggagtggcccaaggccacgtgcaccggggactgccccgagcggtgcggctgcacctccagcacgtgcctccacaaggagtggccccactcccgcaactggcggtgcaacccgacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgaccagccaggagcgccagtgctccctgatcgaggccggcacccggttcaacctcgggcccgtgaccatcaccctgagcgagccccgcaacatccagcagaagctgcccccggagatcatcacgctccaccccaaggtggaggagggcttcttcgacctgatgcacgtccagaaggtgctgtccgcgagcaccgtgtgcaagctccagtcctgcacccacggcatccccggggacctgcaggtctaccacatcggcaacctgctcaagggggaccgggtgaacggccacctgatccacaagatcgagccccacttcaacaccagctggatgtcctgggacggctgcgacctggactactactgcaacatgggggactggccgagctgcacgtacaccggcgtgacccagcacaaccacgccgccttcgtcaacctcctgaacatcgagaccgactacacgaagaccttccacttccactccaagcgcgtgaccgcccacggggacacgccccagctggacctcaaggcccggcccacctacggcgcgggggagatcaccgtgctggtcgaggtggccgacatggagctgcacaccaagaaggtggagatcagcggcctcaagttcgcctccctggcctgcaccggctgctacgcctgcagcagcgggatctcctgcaaggtccgcatccacgtggacgagccggacgagctgacggtgcacgtcaagagctccgaccccgacgtggtggcggccagcacctccctcatggcccggaagctggagttcggcaccgacagcaccttcaaggccttctccgcgatgcccaagacgagcctgtgcttctacatcgtcgagcgcgagtactgcaagtcctgcagcgaggaggacacccagaagtgcgtggacaccaagctcgagcagccccagtccatcctgatcgagcacaaggggaccatcatcggcaagcagaacgacacgtgcaccgccaaggccagctgctggctggagtccgtcaagagcttcttctacgggctcaagaacatgctgggctccgtgttcggcaacttcttcatcgggatcctcctgttcctggccccgttcgtgctgctcgtgctgttcttcatgttcggctggaagatcctgttctgcttcaagtgctgccggcgcgcccgggggctcctgaagtaccgccacctgaaggacgacgaggagaccggctaccggaagatcatcgagcgcctcaacaacaagaaggggaagaaccggctgctggacggcgagcgcctcgcggaccggaagatcgccgagctgttcagcaccaagacgcacatcggc

SEQ ID NO: 12264 - RNA, 2916 nt, synthetic construct
  misc_feature 1..2916: note = derived and/or modified CDS sequence (opt1) from CCHFV(3756-ST-2007, Artificial)__KR814866.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccggaagcccctcttcctggacagcatcgtcaaggggatgaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcggcaacaagatcctggtgaccgggcggagcgagtccatcatgaagctggaggagcgcaccggcgtgagctgggacctcggggtcgaggacgcctccgagagcaagctgctgacggtgtccatcatggacctcagccagatgtacagcccggtcttcgagtacctgtccggcgaccgccaggtggaggagtggcccaaggcgacctgcaccggggactgccccgagcggtgcggctgcaccagctccacgtgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggccggcacccggttcaacctggggcccgtgaccatcacgctctccgagccccgcaacatccagcagaagctgcccccggagatcatcaccctgcaccccaagatcgaggagggcttcttcgacctcatgcacgtccagaaggtgctgagcgcctccaccgtgtgcaagctgcagagctgcacccacggcatccccggggacctccagatctaccacatcggcaacctgctgaagggggaccgggtcaacggccacctcatccacaagatcgagccccacttcaacacgtcctggatgagctgggacggctgcgacctggactactactgcaacatgggggactggccgtcctgcacctacaccggcgtgacccagcacaaccacgccgccttcgtgaacctgctcaacatcgagacggactacaccaagaccttccacttccacagcaagcgcgtcaccgcccacggggacacgccccagctggacctgaaggcccggcccacctacggcgcgggggagatcaccgtgctcgtggaggtcgccgacatggagctgcacaccaagaaggtggagatctccggcctgaagttcgccagcctcacgtgcaccggctgctacgcctgctccagcgggatcagctgcaaggtgcgcatccacgtcgacgagccggacgagctgaccgtgcacgtgaagtccagcgaccccgacgtcgtggccgcgtccaccagcctgatggcccggaagctcgagttcggcacggactccaccttcaaggccttcagcgccatgcccaagacctccctgtgcttctacatcgtggagcgcgagtactgcaagagctgctccgaggacgacaccaagaagtgcgtcgacacgaagctggagcagccccagagcatcctcatcgagcacaaggggaccatcatcggcaagcagaacgacacgtgcaccgcgaaggcctcctgctggctggagagcgtgaagtccttcttctacgggctgaagaacatgctcggcagcgtgttcggctccttcttcgtcgggatcctgctgttcctcaccccgttcgtgctgctggtgctgttcttcatgttcggctggaagatcctgttctgcttcaagtgctgccggcgcacccgggggctgttcaagtaccgccacctcaaggacgacgaggagaccggctaccggcgcatcatcgagcggctgaacagcaagaaggggaagaaccgcctgctcgacggcgagcggctggccgaccgcaagatcgccgagctgttctccaccaagacgcacatcggc

SEQ ID NO: 12265 - RNA, 2916 nt, synthetic construct
  misc_feature 1..2916: note = derived and/or modified CDS sequence (opt1) from CCHFV(3809-ST-2007, Artificial)__KR814867.1__Gn-4aa-Gc
  source 1..2916: mol_type = other RNA
agcgaggagcccggcgacgactgcatctcccgcacccagctcctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggatgaagaacctgctcaactccacgagcctggagacctccctgagcatcgaggccccctggggcgccatcaacgtgcagtccaccttcaagccgaccgtcagcacggccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgaccgtctccatcatggacctcagccagatgtacagccccgtgttcgagtacctgtccggcgaccgccaggtggaggagtggcccaaggccacgtgcaccggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcaccctctccgagccccggaacatccagcagaagctgccgcccgagatcatcacgctgcaccccaaggtggaggagggcttcttcgacctcatgcacgtccagaaggtgctgagcgcgtccaccgtgtgcaagctgcagagctgcacccacggcatccccggggacctccaggtctaccacatcggcaacctgctgaagggggaccgcgtgaacggccacctcatccacaagatcgagccgcacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaccttccacttccacagcaagcgggtgaccgcccacggggacacgccccagctggacctgaaggcccgcccgacctacggcgcgggggagatcaccgtgctcgtcgaggtggccgacatggagctgcacaccaagaaggtggagatctccggcctgaagttcgccagcctcgcctgcaccggctgctacgcctgctccagcgggatcagctgcaaggtccggatccacgtggacgagcccgacgagctgacggtgcacgtcaagtccagcgaccccgacgtggtggcggcctccaccagcctgatggcccgcaagctcgagttcggcaccgactccaccttcaaggccttcagcgcgatgcccaagacgtccctgtgcttctacatcgtcgagaaggagtactgccggagctgctccgaggaggacacccagaagtgcgtggacaccaagctggagcagccgcagagcatcctcatcgagcacaaggggaccatcatcggcaagcagaacgacacgtgcaccgccaaggcctcctgctggctggagagcgtgaagtccttcttctacgggctgaagaacatgctcggcagcgtcttcggcaacttcttcatcgggatcctgctgttcctcacccccttcgtgctgctggtgctgttcttcatgttcggctggaagatcctcttctgcttcaagtgctgccgccggacccgcgggctgctcaagtaccggcacctgaaggacgacgaggagacgggctaccgccggatcatcgagcgcctgaacaacaagaaggggaagaaccggctcctggacggcgagcgcctggccgaccggaagatcgccgagctgttctccaccaagacccacatcggc

SEQ ID NO: 12266 - RNA, 2916 nt, synthetic construct
  misc_feature 1..2916: note = derived and/or modified CDS sequence (opt1) from CCHFV(3820-ST-2007, Artificial)__KR814868.1__Gn-4aa-Gc
  source 1..2916: mol_type = other RNA
agcgaggagcccggcgacgactgcatctcccgcacccagctgctcaagaccgagacggccgagatccacgacgacaactacgggagcccgggcgacaagatcaccatctgcaacgggtccaccatcgtggaccagcggctgggcagcgagctggggtgctacaccatcaaccgcgtgaagtccttcaagctctgcgagaacagcgccacgggcaagacctgcgagatcgactccacccccgtgaagtgccggcagggcttctgcctgaagatcacccaggaggggcgcggccacgtgaagctgagccgggggtccgaggtcgtgctcgacgcgtgcgacagctcctgcgagatcatgatccccaagggcacgggggacatcctggtggactgcagcggcggccagcagcacttcctgaaggacaacctcatcgacctggggtgcccccacatcccgctgctcggcaagatggccatctacatctgccgcatgtccaaccacccccggaccaccatggccttcctgttctggttcagcttcgggtacgtcatcacgtgcatcttctgcaaggccctgttctactccctcatcatcatcggcaccctgggcaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacgggctggcccgccacgtgacccagtgccccaagcggaaggagaaggtcgaggagaccgagctctacctgaacctggagcgcatcccctggatcgtgcggaagctcctccaggtgtccgagagcaccggcgtcgcgctgaagcgcagctcctggctcatcgtgctgctggtgctcctggccgtcagcctgtcccccgtgcagagcgccccggtggggcggaagcccctcttcctggactccatcgtcaagggcatgaagaacctgctcaacagcacgtccctggagaccagcctgtccatcgaggccccctggggcgccatcaacgtgcagagcaccttcaagcccaccgtgtccacggcgaacatcgccctcagctggtccagcgtcgagcaccgcgggaacaagatcctggtgaccggccggtccgagagcatcatgaagctggaggagcgcaccggggtgtcctgggacctcggcgtcgaggacgccagcgagtccaagctgctgaccgtgagcatcatggacctcagccagatgtactccccggtcttcgagtacctgagcggggaccgccaggtggaggagtggcccaaggccacgtgcaccggcgactgccccgagcggtgcgggtgcacctccagcacgtgcctgcacaaggagtggccccactcccggaactggcgctgcaacccgacctggtgctggggcgtgggcaccgggtgcacgtgctgcggcgtcgacgtgaaggacctcttcaccgaccacatgttcatcaagtggaaggtggagtacatcaagaccgaggccatcgtctgcgtggagctgaccagccaggagcgccagtgctccctgatcgaggcggggacccggttcaacctgggccccgtgaccatcaccctcagcgagccccgcaacatccagcagaagctgcccccggagatcatcacgctgcaccccaagatcgaggaggggttcttcgacctcatgcacgtccagaaggtgctgtccgccagcaccgtgtgcaagctgcagtcctgcacccacggcatccccggcgacctccagatctaccacatcgggaacctgctgaagggcgaccgggtcaacgggcacctcatccacaagatcgagccccacttcaacaccagctggatgtcctgggacggctgcgacctggactactactgcaacatgggcgactggccgagctgcacgtacaccggggtgacccagcacaaccacgccgccttcgtgaacctgctcaacatcgagaccgactacacgaagaccttccacttccactccaagcgcgtcaccgcccacggcgacacgccccagctggacctgaaggcgcggcccacctacggggccggcgagatcaccgtgctcgtggaggtcgccgacatggagctgcacaccaagaaggtggagatcagcgggctgaagttcgcctccctgacctgcacgggctgctacgcctgcagcagcggcatctcctgcaaggtgcgcatccacgtcgacgagccggacgagctgaccgtgcacgtcaagagctccgaccccgacgtggtggcggccagcacctccctgatggcccggaagctcgagttcgggaccgacagcacgttcaaggccttctccgcgatgcccaagaccagcctgtgcttctacatcgtggagcgcgagtactgcaagtcctgcagcgaggacgacaccaagaagtgcgtcgacaccaagctggagcagccccagtccatcctcatcgagcacaagggcacgatcatcgggaagcagaacgacacgtgcaccgccaaggccagctgctggctggagtccgtcaagagcttcttctacggcctgaagaacatgctcgggtccgtgttcggcagcttcttcgtgggcatcctgctgttcctcgccccgttcgtgctgctggtcctcttcttcatgttcgggtggaagatcctgttctgcttcaagtgctgccggcgcacccggggcctgttcaagtaccgccacctcaaggacgacgaggagaccgggtaccggcgcatcatcgagcggctgaactccaagaagggcaagaaccgcctgctcgacggggagcggctggccgaccgcaagatcgcggagctgttcagcaccaagacccacatcggc

SEQ ID NO: 12267 - RNA, 2916 nt, synthetic construct
  misc_feature 1..2916: note = derived and/or modified CDS sequence (opt1) from CCHFV(4495-ST-2008, Artificial)__KR814869.1__Gn-4aa-Gc
  source 1..2916: mol_type = other RNA
agcgaggagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacctgcgagatcgactccaccccggtgaagtgccgccaggggttctgcctgaagatcacccaggagggccgggggcacgtgaagctgagccgcggctccgaggtcgtgctcgacgcgtgcgacagctcctgcgaggtgatgatccccaaggggacgggcgacatcctggtcgactgcagcggcgggcagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcctgttctgcaaggccctcttctactccctgatcatcatcggcaccctggggaagaagatcaagcagtaccgggagctccgcccccagacctgcaccatctgcgagaccgcccccgtgaacgcgatcgacgccgagatgcacgacctgaactgcagctacaacatctgcccctactgcgcctcccggctgacgagcgacggcctcgcccgccacgtcccgcagtgccccaagcggaaggagaaggtggaggagaccgagctgtacctgaacctcgagcgcatcccctggatcgtgcggaagctgctgcaggtctccgagagcaccggggtggcgctcaagcgcagctcctggctgatcgtgctgctcgtcctgctgaccgtgagcctctcccccgtgcagagcgccccggtcggccggaagcccctgttcctggactccatcgtgaaggggatgaagaacctcctgaacagcacgtccctggagaccagcctctccatcgaggccccctggggcgccatcaacgtgcagagcaccttcaagcccaccgtctccacggccaacatcgcgctgagctggtccagcgtggagcaccgcggcaacaagatcctggtgaccgggcggtccgagagcatcatgaagctcgaggagcgcaccggcatctcctgggacctgggggtcgaggacgccagcgagtccaagctgctcaccgtgagcatcatggacctgagccagatgtactccccggtcttcgagtacctgagcggcgaccgccaggtggaggagtggcccaaggccacgtgcaccggggactgccccgagcggtgcggctgcacctccagcacgtgcctccacaaggagtggccccactcccgcaactggcggtgcaacccgacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgaccagccaggagcgccagtgctccctgatcgaggccggcacccggttcaacctcgggcccgtcaccatcaccctgagcgagccccgcaacatccagcagaagctgcccccggagatcatcacgctccaccccaaggtggaggagggcttcttcgacctgatgcacgtgcagaaggtcctgtccgcgagcaccgtgtgcaagctccagtcctgcacccacggcatccccggggacctccaggtgtaccacatcggcaacctgctcaagggggaccgggtcaacggccacctgatccacaagatcgagccccacttcaacaccagctggatgtcctgggacggctgcgacctggactactactgcaacatgggggactggccgagctgcacgtacaccggcgtgacccagcacaaccacgccgccttcgtgaacctcctgaacatcgagaccgactacacgaagaccttccacttccactccaagcgcgtcaccgcccacggggacacgccccagctggacctcaaggcccggcccacctacggcgcgggggagatcaccgtgctggtggaggtcgccgacatggagctgcacaccaagaaggtggagatcagcggcctcaagttcgcctccctggcctgcaccggctgctacgcctgcagcagcgggatctcctgcaaggtgcgcatccacgtcgacgagccggacgagctgacggtgcacgtcaagagctccgaccccgacgtggtggcggccagcacctccctcatggcccggaagctggagttcggcaccgacagcaccttcaaggccttctccgcgatgcccaagacgagcctgtgcttctacatcgtggagcgcgagtactgcaagtcctgcagcgaggaggacacccagcggtgcgtcgacaccaagctcgagcagccccagtccatcctgatcgagcacaaggggaccatcatcggcaagcagaacgacacgtgcaccgccaaggccagctgctggctggagtccgtcaagagcttcttctacgggctcaagaacatgctgggctccgtgttcggcaacttcttcatcgggatcctgctgttcctggccccgttcgtgctgctcgtgctgttcttcatgttcggctggaagatcctgttctgcttcaagtgctgccgccgggcccgcgggctcctgaagtaccggcacctgaaggacgacgaggagaccggctaccgcaagatcatcgagcggctcaacaacaagaaggggaagaaccgcctgctggacggcgagcggctcgcggaccgcaagatcgccgagctgttcagcaccaagacgcacatcggc

SEQ ID NO: 12268 - RNA, 2916 nt, synthetic construct
  misc_feature 1..2916: note = derived and/or modified CDS sequence (opt1) from CCHFV(4691-ST-2009, Artificial)__KR814871.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccggaagcccctcttcctggacagcatcgtcaaggggatgaagaacctgctcaactccaccagcctggagacctccctgagcatcgaggccccctggggcgccatcaacgtgcagtccaccttcaagcccgccgtgagcacggcgaacatcgccctctcctggagctccgtcgagcaccgcggcaacaagatcctggtgaccgggcggagcgagtccatcatgaagctggaggagcgcaccggcgtgagctgggacctcggggtcgaggacgcctccgagagcaagctgctgaccgtgtccatcatggacctcagccagatgtacagcccggtcttcgagtacctgtccggcgaccgccaggtggaggagtggcccaaggccacgtgcaccggggactgccccgagcggtgcggctgcaccagctccacgtgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggcgggcacccggttcaacctggggcccgtgaccatcaccctctccgagccccgcaacatccagcagaagctgcccccggagatcatcacgctgcaccccaagatcgaggagggcttcttcgacctcatgcacgtccagaaggtgctgagcgcctccaccgtgtgcaagctgcagagctgcacccacggcatccccggggacctccagatctaccacatcggcaacctgctgaagggggaccgggtcaacggccacctcatccacaagatcgagccccacttcaacacctcctggatgagctgggacggctgcgacctggactactactgcaacatgggggactggccgtcctgcacgtacaccggcgtgacccagcacaaccacgccgccttcgtgaacctgctcaacatcgagaccgactacacgaagaccttccacttccacagcaagcgcgtcaccgcccacggggacacgccccagctggacctgaaggcgcggcccacctacggcgccggggagatcaccgtgctcgtggaggtcgccgacatggagctgcacaccaagaaggtggagatctccggcctgaagttcgccagcctcgcctgcaccggctgctacgcgtgctccagcgggatcagctgcaaggtgcgcatccacgtcgacgagccggacgagctgacggtgcacgtgaagtccagcgaccccgacgtcgtggccgcctccaccagcctgatggcccggaagctcgagttcggcaccgactccaccttcaaggcgttcagcgccatgcccaagacgtccctgtgcttctacatcgtggagcgcgagtactgcaagagctgctccgaggacgacaccaagaagtgcgtcgacaccaagctggagcagccccagagcatcctcatcgagcacaaggggaccatcatcggcaagcagaacgacacgtgcaccgccaaggcctcctgctggctggagagcgtgaagtccttcttctacgggctgaagaacatgctcggcagcgtgttcggcaacttcttcgtcgggatcctgctgttcctcgccccgttcgtgctgctggtgctgttcttcatgttcggctggaagatcctgttctgcttcaagtgctgccggcgcacccgggggctgttcaagtaccgccacctcaaggacgacgaggagaccggctaccggcgcatcatcgagcggctgaactccaagaaggggaagaaccgcctgctcgacggcgagcggctggcggaccgcaagatcgccgagctgttcagcacgaagacccacatcggc

SEQ ID NO: 12269 - RNA, 2916 nt, synthetic construct
  misc_feature 1..2916: note = derived and/or modified CDS sequence (opt1) from CCHFV(4701-ST-2009, Artificial)__KR814872.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgcgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccggaagcccctcttcctggacagcatcgtgaaggggatgaagaacctgctcaactccaccagcctggagacctccctgagcatcgaggccccctggggcgccatcaacgtgcagtccaccttcaagcccacggtcagcaccgccaacatcgcgctctcctggagctccgtggagcaccgcggcaacaagatcctggtgaccgggcggagcgagtccatcatgaagctggaggagcgcaccggcgtcagctgggacctcggggtggaggacgcctccgagagcaagctgctgacggtctccatcatggacctcagccagatgtacagcccggtgttcgagtacctgtccggcgaccgccaggtggaggagtggcccaaggcgacctgcaccggggactgccccgagcggtgcggctgcaccagctccacgtgcctgcacaaggagtggccccacagccggaactggcgctgcaacccgacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgacctcccaggagcgccagtgcagcctgatcgaggccggcacccggttcaacctggggcccgtcaccatcacgctctccgagccccgcaacatccagcagaagctgcccccggagatcatcaccctgcaccccaagatcgaggagggcttcttcgacctcatgcacgtgcagaaggtgctgagcgcctccaccgtctgcaagctgcagagctgcacccacggcatccccggggacctccagatctaccacatcggcaacctgctgaagggggaccgggtgaacggccacctcatccacaagatcgagccccacttcaacacgtcctggatgagctgggacggctgcgacctggactactactgcaacatgggggactggccgtcctgcacctacaccggcgtgacccagcacaaccacgccgccttcgtcaacctgctcaacatcgagacggactacaccaagaccttccacttccacagcaagcgcgtgaccgcccacggggacacgccccagctggacctgaaggcccggcccacctacggcgcgggggagatcaccgtgctcgtcgaggtggccgacatggagctgcacaccaagaaggtggagatctccggcctgaagttcgccagcctcacgtgcaccggctgctacgcctgctccagcgggatcagctgcaaggtccgcatccacgtggacgagccggacgagctgaccgtgcacgtcaagtccagcgaccccgacgtggtggccgcgtccaccagcctgatggcccggaagctcgagttcggcacggactccaccttcaaggccttcagcgccatgcccaagacctccctgtgcttctacatcgtcgagcgcgagtactgcaagagctgctccgaggacgacaccaagaagtgcgtggacacgaagctggagcagccccagagcatcctcatcgagcacaaggggaccatcatcggcaagcagaacgacacgtgcaccgcgaaggcctcctgctggctggagagcgtgaagtccttcttctacgggctgaagaacatgctcggcagcgtcttcggcgggttcttcgtgggcatcctgctgttcctcgccccgttcgtgctgctggtcctcttcttcatgttcgggtggaagatcctgttctgcttcaagtgctgccggcgcacccggggcctgttcaagtaccgccacctcaaggacgacgaggagaccgggtaccggcgcatcatcgagcggctgaactccaagaagggcaagaaccgcctgctcgacggcgagcggctggccgaccgcaagatcgccgagctgttcagcaccaagacccacatcggg

SEQ ID NO: 12270 - RNA, 2916 nt, synthetic construct
  misc_feature 1..2916: note = derived and/or modified CDS sequence (opt1) from CCHFV(5170-R-2011, Artificial)__KR814873.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgtgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgagggcctggcccgccacgtcacccagtgccccaagcggaaggagaaggtggaggagaccgagctctacctgaacctggagcgcatcccctggatcgtgcggaagctcctgcaggtcagcgagtccaccggggtggccctgaagcgcagcagctggctcatcgtgctgctggtcctcctgacggtgtccctgagccccgtgcagtccgcgccggtcggccggaagcccctcttcctggacagcatcgtgaaggggatgaagaacctgctcaactccaccagcctggagacctccctgagcatcgaggccccctggggcgccatcaacgtgcagtccaccttcaagcccacggtcagcaccgccaacatcgccctctcctggagctccgtggagcaccgcggcaacaagatcctggtgaccgggcggagcgagtccatcatgaagctggaggagcgcaccggcgtcagctgggacctcggggtggaggacgcgtccgagagcaagctgctgacggtctccatcatggacctcagccagatgtacagcccggtgttcgagtacctgtccggcgaccgccaggtggaggagtggcccaaggcgacctgcaccggggactgccccgagcggtgcggctgcaccagctccacgtgcctgcacaaggagtggccccacagccggaactggcgctgcaacccgacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgacctcccaggagcgccagtgcagcctgatcgaggccggcacccggttcaacctggggcccgtcaccatcacgctctccgagccccgcaacatccagcagaagctgcccccggagatcatcaccctgcaccccaagatcgaggagggcttcttcgacctcatgcacgtgcagaaggtgctgagcgcctccaccgtctgcaagctgcagagctgcacccacggcatccccggggacctccagatctaccacatcggcaacctgctgaagggggaccgggtgaacggccacctcatccacaagatcgagccccacttcaacacgtcctggatgagctgggacggctgcgacctggactactactgcaacatgggggactggccgtcctgcacctacaccggcgtgacccagcacaaccacgccgccttcgtcaacctgctcaacatcgagacggactacaccaagaccttccacttccacagcaagcgcgtgaccgcccacggggacacgccccagctggacctgaaggcccggcccacctacggcgccggggagatcaccgtgctcgtcgaggtggcggacatggagctgcacaccaagaaggtggagatctccggcctgaagttcgccagcctcacgtgcaccggctgctacgcctgctccagcgggatcagctgcaaggtccgcatccacgtggacgagccggacgagctgaccgtgcacgtcaagtccagcgaccccgacgtggtggccgcctccaccagcctgatggcgcggaagctcgagttcggcacggactccaccttcaaggccttcagcgccatgcccaagacctccctgtgcttctacatcgtcgagcgcgagtactgcaagagctgctccgaggacgacaccaagaagtgcgtggacacgaagctggagcagccccagagcatcctcatcgagcacaaggggaccatcatcggcaagcagaacgacacgtgcaccgccaaggcgtcctgctggctggagagcgtgaagtccttcttctacgggctgaagaacatgctcggcagcgtcttcggctccttcttcgtggggatcctgctgttcctcgccccgttcgtgctgctggtcctcttcttcatgttcggctggaagatcctgttctgcttcaagtgctgccggcgcacccgggggctgttcaagtaccgccacctcaaggacgacgaggagaccggctaccggcgcatcatcgagcggctgaacagcaagaaggggaagaaccgcctgctcgacggcgagcggctggccgaccgcaagatcgccgagctgttctccaccaagacccacatcggc

SEQ ID NO: 12271 - RNA, 2916 nt, synthetic construct
  misc_feature 1..2916: note = derived and/or modified CDS sequence (opt1) from CCHFV(Oman-199809166, Artificial)__KR864901.1__Gn-4aa-Gc
  source 1..2916: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtgaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctcaagcggagcagctggctgatcgtgctgctcgtgctgctgaccgtctccctcagccccgtgcagtccgcccccatcggccgcaagccgctgttcctggacagcatcgcgaaggggatgaagaacctcctgaactccacgagcctggagacctccctcagcatcgaggccccctggggcgccatcaacgtgcagtccaccttcaagcccaccgtcagcacggccaacatcgccctgtcctggagctccgtggagcaccggggcaacaagatcctggtgagcgggcgctccgagagcatcatgaagctcgaggagcggaccggcatctcctgggacctgggggtcgaggacgcgagcgagtccaagctgctcaccgtgagcgtcatggacctgagccagatgtactcccccgtgttcgagtacctgagcggcgaccgccaggtggaggagtggccgaaggcgacctgcacgggggactgccccgagcggtgcggctgcacctccagcacgtgcctccacaaggagtggccccactcccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctgaccagccaggagcgccagtgctccctcatcgaggccggcacccgcttcaacctggggccggtcaccatcaccctgagcgagccccggaacatccagcagaagctcccgcccgagatcgtgaccctgcacccccgcatcgaggagggcttcttcgacctgatgcacgtgcagaaggtcctctccgccagcacggtgtgcaagctgcagtcctgcacccacggcgtgcccggggacctgcaggtctaccacatcggcaacctcctgaagggggacaaggtgaacggccacctgatccacaaggtggagccccacttcaacaccagctggatgtcctgggacggctgcgacctcgactactactgcaacatgggggactggcccagctgcacctacacgggcgtcacccagcacaaccacgccgccttcgtgaacctgctgaacatcgagaccgactacaccaagaacttccacttccactccaagcgggtgacggcccacggggacaccccgcagctcgacctgaaggcccgccccaactacggcgccggggagatcaccgtcctggtggaggtggcggacatggagctccacaccaagaagatcgagatcagcggcctgaagttcgcctccctgacgtgcaccggctgctacgcctgcagcagcgggatctcctgcaaggtccggatccacgtggacgagcccgacgagctcaccgtgcacgtcaagagcgaggacccggacatcgtggccgcctccagctccctgatggcgcgcaagctggagttcggcaccgacagcacgttcaaggccttctccgccatgcccaagaccagcctctgcttctacatcgtggagcgggagtactgcaagtcctgcagcaaggaggacacccagaagtgcgtcaacgccaagctggagcgcccccagtccatcctgatcgagcacaaggggaccatcatcggcaagcagaacgacacgtgcaccgcgaaggccagctgctggctcgagtccgtcaagagcttcttctacgggctgaagaacatgctgtccggcatcttcggcaacgtgttcatcgggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgcaagatcatcgagcggctgaacaacaagaaggggaagaacaagctcctggacggcgagcgcctggccgaccggaagatcgccgagctgttcagcacgaagacccacatcggc

SEQ ID NO: 12272 - RNA, 2916 nt, synthetic construct
  misc_feature 1..2916: note = derived and/or modified CDS sequence (opt1) from CCHFV(200406546-Turkey, Artificial)__KR864902.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgtgtgcgactccagctgcgaggtcatgatccccaaggggacgggcgacatcctggtggactgctccggcgggcagcagcacttcctgaaggacaacctcatcgacctgggctgcccccacgtgccgctgctcgggcggatggcgatctacatctgccgcatgagcaaccacccccggaccaccatggccttcctgttctggttctccttcggctacgtcatcacgtgcatcttctgcaaggccctgttctacagcctcatcatcatcggcaccctggggaagaagttcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgacggcctggcccgccacgtgccccagtgccccaagcggaaggagaaggtcgaggagaccgagctctacctgaacctggagcgcatcccctggatcgtgcggaagctcctccaggtgagcgagtccaccggggtcgccctgaagcgcagcagctggctgatcgtgctgctggtgctcctgaccgtctccctgagcccggtgcagtccgcgcccgtgggccggaagcccctcttcctggacagcatcgtcaaggggatgaagaacctgctcaactccacgagcctggagacctccctgagcatcgaggccccctggggcgccatcaacgtgcagtccaccttcaagccgaccgtgagcacggccaacatcgccctctcctggagctccatcgagcaccgcggcaacaagatcctggtcaccgggcggagcgagtccatcatgaagctggaggagcgcaccggcgtgagctgggacctcggggtcgaggacgcgtccgagagcaagctgctgaccgtgtccatcatggacctcagccagatgtacagccccgtgttcgagtacctgtccggcgaccggcaggtcgaggagtggcccaaggccacgtgcaccggggactgccccgagcgctgcggctgcaccagctccacgtgcctgcacaaggagtggccgcacagccgcaactggcggtgcaaccccacctggtgctggggcgtggggaccggctgcacgtgctgcggggtggacgtcaaggacctcttcaccgaccacatgttcgtgaagtggaaggtggagtacatcaagaccgaggccatcgtctgcgtggagctgacctcccaggagcgccagtgcagcctgatcgaggccggcacccggttcaacctggggcccgtgaccatcaccctctccgagccccgcaacatccagcagaagctgccgcccgagatcatcacgctgcaccccaaggtcgaggagggcttcttcgacctcatgcacgtgcagaaggtgctgagcgcctccaccgtctgcaagctgcagagctgcacccacggcatccccggggacctccaggtgtaccacatcggcaacctgctgaagggggaccgggtgaacggccacctcatccacaagatcgagccgcacttcaacacctcctggatgagctgggacggctgcgacctggactactactgcaacatgggggactggccctcctgcacgtacaccggcgtcacccagcacaaccacgcggccttcgtgaacctgctcaacatcgagaccgactacacgaagaccttccacttccacagcaagcgcgtgaccgcccacggggacacgccccagctggacctgaaggcccggccgacctacggcgccggggagatcaccgtcctcgtggaggtggcggacatggagctgcacaccaagaaggtcgagatctccggcctgaagttcgccagcctcgcctgcaccggctgctacgcctgctccagcgggatcagctgcaaggtgcgcatccacgtggacgagcccgacgagctgacggtccacgtgaagtccagcgaccccgacgtggtcgccgcgtccaccagcctgaccgcccggaagctcgagttcggcaccgactccacgttcaaggccttcagcgccatgcccaagacctccctgtgcttctacatcgtggagaaggagtactgcaagagctgcaacgaggacgacacccagaagtgcgtggacaccaagctggagcagccgcagtccatcctcatcgagcacaaggggacgatcatcggcaagcagaacgacacgtgcaccgcgaaggccagctgctggctggagtccgtcaagagcttcttctacgggctgaagaacatgctcggctccgtgttcggcaacttcttcatcgggatcctgctgttcctcgcccccttcgtgctgctggtcctcttcttcatgttcggctggaagatcctgttctgcttcaagtgctgccgccggacccgcgggctgttcaagtaccggcacctcaaggacgacgaggagaccggctacaagcgcatcatcgagcggctgaacaacaagaaggggaagaaccgcctgctcgacggcgagcggctggccgaccgcaagatcgccgagctgttcagcaccaagacccacatcggc

SEQ ID NO: 12273 - RNA, 2916 nt, synthetic construct
  misc_feature 1..2916: note = derived and/or modified CDS sequence (opt1) from CCHFV(1-CR/HU-2015, Artificial)__KU161584.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcacccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgacggtgtccctgagccccgtgcagtccgccccggtcggccgcaagcccctcttcctggacagcatcgtgaaggggatgaagaacctgctcaactccaccagcctggagacctccctgagcatcgaggccccctggggcgccatcaacgtgcagtccaccttcaagcccacggtcagcaccgccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgacggtctccatcatggacctcagccagatgtacagcccggtgttcgagtacctgtccggcgaccgccaggtggaggagtggcccaaggcgacctgcaccggggactgccccgagcggtgcggctgcaccagctccacgtgcctgcacaaggagtggccccacagccgcaactggcgctgcaacccgacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcacgctctccgagccccggaacatccagcagaagctgcccccggagatcatcaccctgcaccccaagatcgaggagggcttcttcgacctcatgcacgtgcagaaggtcctgagcgcctccaccgtgtgcaagctgcagagctgcacccacggcatccccggggacctccaggtgtaccacatcggcaacctgctgaagggggaccgcgtcaacggccacctcatccacaagatcgagccccacttcaacacgtcctggatgagctgggacggctgcgacctggactactactgcaacatgggggactggccgtcctgcacctacaccggcgtgacccagcacaaccacgccgccttcgtgaacctgctcaacatcgagacggactacaccaagaccttccacttccacagcaagcgggtcaccgcccacggggacacgccccagctggacctgaaggcccgccccacctacggcgcgggggagatcaccgtgctcgtggaggtcgccgacatggagctgcacaccaagaaggtggagatctccggcctgaagttcgccagcctcgcctgcacgggctgctacgcctgctccagcgggatcagctgcaaggtgcggatccacgtcgacgagccggacgagctgaccgtgcacgtgaagtccagcgaccccgacgtcgtggcggcctccaccagcctgatggcccgcaagctcgagttcggcaccgactccacgttcaaggccttcagcgcgatgcccaagacctccctgtgcttctacatcgtggagcgggagtactgcaagagctgctccgaggacgacaccaagaagtgcgtcgacaccaagctggagcagccccagagcatcctcatcgagcacaaggggacgatcatcggcaagcagaacgacacgtgcaccgccaaggcctcctgctggctggagagcgtgaagtccttcttctacgggctgaagaacatgctcggcagcgtgttcggcaacttcttcatcgggatcctgctgttcctcgccccgttcgtcctgctggtgctgttcttcatgttcggctggaagatcctcttctgcttcaagtgctgccgccggacccgcgggctgttcaagtaccggcacctcaaggacgacgaggagaccggctaccgccggatcatcgagcgcctgaacaacaagaaggggaagaaccggctgctcgacggcgagcgcctggccgaccggaagatcgcggagctgttctccaccaagacccacatcggc

SEQ ID NO: 12274 - RNA, 2916 nt, synthetic construct
  misc_feature 1..2916: note = derived and/or modified CDS sequence (opt1) from CCHFV(Gaib, Artificial)__KX013445.1__Gn-4aa-Gc
  source 1..2916: mol_type = other RNA
agcgaggagtccagcgacgactgcatctcccgcacccagctgctccggaccgagacggccgagatccacaacgacaactacggcgggcccggcgacaagatcaccatctgcaacgggagcaccatcgtggaccagcgcctgggctccgagctggggtgctacaccatcaaccgggtcaagagcttcaagctctgcgagaactccgccacgggcaagagctgcgagatcgactccatcccggtgaagtgccgccagggcttctgcctgaagatcacccaggaggggcggggccacgtgaagctgagccgcgggtccgaggtcgtgctcgacgcgtgcgacagctcctgcgagatcatgatccccaagggcaccggggacatcctggtggactgcagcggcggccagcagcacttcctgaaggacaacctcatcgacctggggtgccccaacatccccctgctcggcaagatggccatctacatctgccggatgtccaaccacccgaagaccacgatggccttcctgttctggttcagcttcgggtacgtcatcacctgcatcttctgcaaggccatcttctacctgctcatcatcgtgggcaccctgggcaagaagttcaagcagtaccgcgagctgaagccccagacctgcacgatctgcgagaccacccccgtgaacgccatcgacgcggagatgcacgacctcaactgctcctacaacatctgcccctactgcgccagccggctgacctccgacgggctggcccgccacgtcgtgcactgcccgaagcggaaggagaagatcgaggagacggagctctacctgaacctggagcgcgtgccctgggtcgtgcggaagctcctgcaggtgagcgagagcaccggcgtcgccctgaagcgctccagctggctcatcgtgctgctggtgctcctgaccgtctccctgagccccgtgcagtccgcgcccatcgggcggaagccgctcttcagcgactccatcgtgaagggcatgaagaacctgctgaacagcacctccctcgagacgagcctgtccatcgaggccccctggggggccatcaacgtccagagcaccttcaagcccaccgtgtccaccgccaacatcgccctgagctggtccagcatcgagcaccgcggcaacaagatcctcgtgtccggccggagcgagtccatcatgaagctggaggagcgcacggggatcagctgggacctgggcgtcgaggacgcgagcgagtcccggctcctgaccgtgagcgtcatggacctgtcccagatgtacagccccgtgttcgagtacctctccggggaccgccaggtggaggagtggccgaaggccacctgcaccggcgactgccccgagcggtgcgggtgcacgagctccacctgcctgcacaaggagtggccccacagccgcaactggcgctgcaaccccacctggtgctggggcgtcggcaccgggtgcacgtgctgcggcctggacgtgaaggacctcttcaccgactacatgttcgtgaagtggaaggtcgagtacatcaagaccgaggccatcgtgtgcgtggagctgacctcccaggagcggcagtgcagcctgatcgaggccgggacgcgcttcaacctgggcccggtcaccatcaccctctccgagccccggaacatccagcagaagctgccccccgagatcatcaccctgcacccgcgcatcgaggaggggttcttcgacctcatgcacgtgcagaaggtgctgagcgcctccaccgtctgcaagctgcagagctgcacgcacggcgtgcccggcgacctccaggtgtaccacatcgggaacctgctgaagggcgacaaggtcaacgggcacctcatccacaagatcgagccccacttcaacacctcctggatgagctgggacggctgcgacctggactactactgcaacatgggcgactggccctcctgcacctacaccggggtgacgcagcacaaccacgcggccttcgtgaacctgctcaacatcgagaccgactacaccaagaacttccacttccacagcaagcgggtcaccgcccacggcgacacgccgcagctggacctgaaggcccgccccacctacggggccggcgagatcaccgtgctcgtggaggtcgcggacatggagctgcacaccaagaagatcgagatcagcgggctgaagttcgcctccctcacgtgcaccggctgctacgcctgcagctccggcatcagctgcaaggtgcggatccacgtggacgagcccgacgagctgaccgtccacgtgaagtccgaggacccggacatcgtggccgccagctccagcctgatggcgcgcaagctcgagttcgggaccgactccacgttcaaggccttcagcgccatgcccaagacctccctgtgcttctacatcgtcgagcgggagtactgcaagagctgctcccgcgaggacacccagaagtgcgtgagcaccaagctggagcagccccagtccatcctcatcgagcacaagggcacgatcatcgggaagcagaacaacacctgcaccaccaagacgacctgctggctggagagcgtgaagtccttcttctacggcctgaagaacatgctcagctccatcttcgggaacgtcttcgtgggcatcttcagcttcctggcccccttcatcctgctcatcctgttcttcatgttcggctggcggatcctgttctgcttcaagtgctgccgccggacccgcgggctcttcaagtaccggcacctgaaggacgacgaggagaccggctaccgccggatcatcgagcgcctgaacaacaagaaggggaagagcaagctcctggacggcgagcggctggcggaccgcaagatcgccgagctcttctccacgaagacccacatcggg

SEQ ID NO: 12275 - RNA, 2916 nt, synthetic construct
  misc_feature 1..2916: note = derived and/or modified CDS sequence (opt1) from CCHFV(Hodzha, Artificial)__KX013448.1__Gn-4aa-Gc
  source 1..2916: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccggagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcgggcggcgccccctcttcctggactccatcgtcaagggcaagaagaacctgctcaacagcacgtccctggagaccagcctgtccatcgaggccccctggggcgccatcaacgtgcagagcacctacaagcccaccgtgtccacggcgaacatcgccctcagctggtccagcgtcgagcaccgggggaacaagatcctggtgtccggccgcagcgagtccatcatgaagctggaggagcggaccgggatcagctgggacctcggcgtggaggacgcctccgagagcaagctgctgaccgtcagcgtgatggacctctcccagatgtacagccccgtcttcgagtacctgtccggggaccgccaggtggaggagtggccgaaggcgacctgcacgggcgactgcagcgagcgctgcggctgcacctccagcacgtgcctgcacaaggagtggccccactcccggaactggcgctgcaaccccacctggtgctggggcgtggggaccgggtgcacgtgctgcggcctcgacgtcaaggacctgttcaccgactacatgttcgtgaagtggaaggtggactacatcaagaccgaggccatcgtctgcgtggagctgaccagccaggagcggcagtgctccctggtggaggccgggacccgcttcaacctcggccccgtcaccatcaccctgagcgagccgcggaacatccagcagaagctgccgcccgagatcatcaccctccacccccgcatcgaggagggcttcttcgacctgatgcacgtgcagaaggtgctgtccgccagcacggtctgcaagctccagtcctgcacccacggggtgccgggcgacctccaggtgtaccacatcgggaacctgctgaagggcgacaaggtcaacggccacctgatccacaagatcgagccccacttcaacaccagctggatgtcctgggacgggtgcgacctggactactactgcaacatgggcgactggcccagctgcacctacacgggggtgacccagcacaaccacgcctccttcgtgaacctcctgaacatcgagaccgactacaccaagagcttccacttccacagcaagcgggtcacggcccacggcgacacgccccagctggacctcaaggcccgcccgacctacggggcgggcgagatcaccgtgctggtggaggtcgccgacatggagctgcacaccaagaagatcgagatcaccggcctcaagttcgcctccctgacctgcaccgggtgctacgcctgcagctccggcatcagctgcaaggtgcggatccacgtggacgagcccgacgagctgacggtccacgtgaagtccgacgaccccgacgtggtcgccgcgagctccagcctcatggcccgcaagctggagttcgggaccgactccaccttcaaggccttcagcgccatgccgaagacctccctgtgcttctacatcgtggagcgggagtactgcaagagctgctccaaggaggacacgcagaagtgcgtgaacaccaagctcgagcagccccagagcatcctgatcgagcagaagggcaccatcatcgggaagcagaacaacacgtgcaccgcgaaggcctcctgctggctggagagcgtcaagtccttcttctacggcctcaagaacatgctgagcggcatcttcgggaacgtgttcgtgggcatcttcctgttcctcgcccccttcatcctgctgatcctcttcttcatgttcgggtggcgcatcctgttctgcttcaagtgctgccggcgcacccggggcctgttcaagtacaagcacctcaaggacgacgaggagaccgggtaccgccggatcatcgagcgcctgaacaacaagaagggcaagaacaagctgctcgacggcgagcggctggccgaccgccgcatcgccgagctgttctccaccaagacgcacatcggg

SEQ ID NO: 12276 - RNA, 2916 nt, synthetic construct
  misc_feature 1..2916: note = derived and/or modified CDS sequence (opt1) from CCHFV(IbAn7620, Artificial)__KX013451.1__Gn-4aa-Gc
  source 1..2916: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgagatcgtgctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacgtcatcacgtgcatcctgtgcaaggccatcttctacctcctgatcatcatcggcaccctggggaagcggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggccggaagcccctgttcctggactccatcgccaaggggatgaagaaccccctcaacagcacgtccctggagaccagcctgtccatcgaggccccctggggcgccatcgacgtccagagcacctacaagccgaccgtgtccacggccaacatcgcgctcagctggtccagcgtggagcaccgcggcaacaagatcctggtctccgggcggagcgagtccatcatgaagctggaggagcgcaccggcatcagctgggacctcggggtggaggacgcctccgagagcaagctgctgaccgtgtccgtcatggacctcagccagatgtacagccccgtgttcgagtacctgtccggcgaccggcaggtcgaggagtggcccaaggcgacctgcacgggggactgccccgagcgctgcggctgcaccagctccacgtgcctgcacaaggagtggccgcacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctgatcgaggccggcacccggttcaacctcgggcccgtgaccatcaccctgtccgagccccgcaacatccagcagaagctgccgcccgagatcatcaccctccacccccggatcgaggagggcttcttcgacctgatgcacgtgcagaaggtcctgagcgcctccacggtgtgcaagctccagagctgcacccacggcgtgcccggggacctgcaggtctaccacatcggcaacctgctcaagggggacaaggtgaacggccacctgatccacaagatcgagccgcacttcaacacctcctggatgagctgggacggctgcgacctggactactactgcaacatgggggactggccctcctgcacctacacgggcgtgacccagcacaaccacgccagcttcgtcaacctcctgaacatcgagaccgactacaccaagaacttccacttccactccaagcgcgtgacggcccacggggacacgccccagctggacctcaaggcccggccgacctacggcgccggggagatcaccgtgctggtcgaggtggcgaacatggagctgcacaccaagaagatcgagatcagcggcctcaagttcgcctccctgacctgcaccggctgctacgcctgcagcagcgggatctcctgcaaggtgcgcatccacgtcgacgagcccgacgagctgaccgtgcacgtcaagagcgacgaccccgacgtggtggccgcctccagctccctcatggcgcggaagctggagttcggcacggacagcaccttcaaggccttctccgccatgcccaagaccagcctgtgcttctacatcgtggagcgcgagcactgcaagtcctgcagcgaggaggacaccaagaagtgcgtcaacacgaagctcgagcagccgcagtccatcctgatcgagcacaaggggaccatcatcggcaagcagaacagcacgtgcaccgccaaggcgtcctgctggctggagagcgtgaagtccttcttctacgggctcaagaacatgctgagcggcatcttcggcaacgtgttcatggggatcttcctgttcctcgcccccttcatcctgctgatcctcttcttcatgttcggctggcggatcctgttctgcttcaagtgctgccgccggacccgcgggctgttcaagtaccggcacctcaaggacgacgaggagaccggctaccgccggatcatcgagcgcctgaacaacaagaaggggaagaacaagctgctcgacggcgagcggctggccgaccgccgcatcgccgagctgttctccaccaagacccacatcggc

SEQ ID NO: 12277 - RNA, 2916 nt, synthetic construct
  misc_feature 1..2916: note = derived and/or modified CDS sequence (opt1) from CCHFV(K128_76, Artificial)__KX013454.1__Gn-4aa-Gc
  source 1..2916: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcatcccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacgtgcatcgtgtgcaaggccatcttctacctgctcatcatcgtcgggaccctgggcaagcgcttcaagcagtaccgggagctgaagccccagacctgcaccatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtggaggagaccgagctctacctgaacctggagcggatcccctgggtcgtgcgcaagctcctccaggtgtccgagagcaccggcgtcgccctgaagcggagctcctggctcatcgtgctgctggtcctcttcgcggtgagcctgtcccccgtgcagagcgcccccatctcccgccggccgctgttccaggacagcatcgtgaaggggatgaagaacctcctgaactccacgagcctggagacctccctcagcatcgaggccccctggggcgccatcaacgtccagtccacctacaagcccgccgtgagcgcggccaacatcgccctgtcctggagctccgtggagcaccgcggcagcaagatcctggtctccgggcggagcgagtccatcatgaagctcgaggagcgcaccggcatcagctgggacctgggggtggaggacgccagcgagtccaagctgctcacggtcagcgtgatggacctgtcccagatgtacagccccgtgttcgagtacctgtccggcgaccggcaggtcgaggagtggccgaaggcgacctgcaccggggactgccccgagcgctgcggctgcaccagctccacgtgcctccacaaggagtggccccacagccgcaactggcggtgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccaggagcgccagtgcagcctgatcgaggccggcacccggttcaacctggggccggtgacgatcaccctgtccgagccccgcaacatccagcagaagctcccgcccgagatcatcaccctgcacccccggatcgaggagggcttcttcgacctgatgcacgtgcagaaggtcctcagcgcctccaccgtgtgcaagctgcagagctgcacccacggcgtgcccggggacctgcaggtctaccacatcggcaacctcctgaagggggaccgcgtgaacggccacctgatccacaagatcgagccccacttcaacacgtcctggatgagctgggacggctgcgacctcgactactactgcaacatgggggactggccctcctgcacctacaccggcgtgacccagcacaaccacgccagcttcgtcaacctgctgaacatcgagacggactacaccaagagcttccacttccactccaagcgggtgaccgcccacggggacaccccgcagctcgacctgaaggcgcgccccaactacggcgccggggagatcacggtgctggtcgaggtggccgacatggagctccacaccaagaagatcgagatcagcggcctgaagttcgcctccctgacctgcaccggctgctacgcctgcagctccgggatcagctgcaaggtgcggatccacgtcgacgagcccgacgagctcacggtgcacgtgaagtccgacgacccggacgtcgtggcggccagctccagcctgatggcccgcaagctggagttcggcaccgactccaccttcaaggccttcagcgcgatgcccaagacctccctctgcttctacatcgtggagcgggagtactgcaagagctgctccaaggaggacacgcagaagtgcgtcaacaccaagctggagcagccccagagcatcctgatcgagcacaaggggaccatcatcggcaagcagaacaacacgtgcaccgccaagacctcctgctggctcgagagcgtgaagtccttcttctacgggctgaagaacatgctgagcggcatcttcggcaacgtgttcgtcgggatcttcctcttcctggcccccttcatcctgctcatcctgttcttcatgttcggctggcgcatcctgttctgcttcaagtgctgccggcgcacccggggcctcttccgctacaagcacctggagaacgacgaggagaccgggtaccggcgcatcatcgagcggctgaacaacaagaaggggaagaacaagctcctggacggcgagcgcctggccgaccgccggatcgccgagctgttcagcacgaagacccacatcggc

SEQ ID NO: 12278 - RNA, 2916 nt, synthetic construct
  misc_feature 1..2916: note = derived and/or modified CDS sequence (opt1) from CCHFV(K168_40, Artificial)__KX013457.1__Gn-4aa-Gc
  source 1..2916: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacctgcatcgtctgcaaggccatcttctacctgctcatcatcgtggggaccctgggcaagcgcttcaagcagtaccgggagctgaagccccagacctgcacgatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtcgaggagaccgagctctacctgaacctggagcggatcccctgggtggtgcgcaagctcctgcaggtctccgagagcaccggcgtggccctgaagcggagctcctggctcatcgtgctgctggtcctcttcgcggtgagcctgtcccccgtgcagagcgcccccatcgggcgccggccgctgttcctcgacggcatcgtcaagggcatgaagaacctgctgaactccacgagcctcgagacctccctgagcatcgaggccccctggggggccatcaacgtgcagtccacctacaagcccaccgtgagcgccgcgaacatcgccctgtcctggagctccgtcgagcaccgcggcaacaagatcctcgtgagcgggcggtccgagagcatcatgaagctggaggagcgcacgggcatctcctgggacctgggggtcgaggacgccagcgagtccaagctcctgaccgtgagcgtgatggacctgagccagatgtactcccccgtcttcgagtacctcagcggcgaccggcaggtggaggagtggccgaaggccacctgcaccggcgactgccccgagcgctgcgggtgcacgtccagcacctgcctgcacaaggagtggccccactcccgcaactggcggtgcaaccccacctggtgctggggcgtggggaccggctgcacgtgctgcgggctggacgtcaaggacctcttcaccgactacatgttcgtgaagtggaaggtggagtacatcaagaccgaggccatcgtctgcgtggagctgaccagccaggagcgccagtgctccctgatcgaggcgggcacgcggttcaacctgggcccggtgaccatcaccctcagcgagccccgcaacatccagcagaagctgccccccgagatcatcaccctgcacccgcggatcgaggaggggttcttcgacctcatgcacgtccagaaggtgctgtccgccagcaccgtgtgcaagctgcagtcctgcacgcacggcgtccccggggacctccaggtgtaccacatcggcaacctgctgaagggcgacaaggtgaacgggcacctcatccacaagatcgagccccacttcaacaccagctggatgtcctgggacggctgcgacctggactactactgcaacatgggggactggcccagctgcacctacaccggcgtcacgcagcacaaccacgcctccttcatcaacctgctcaacatcgagaccgactacaccaagagcttccacttccactccaagcgcgtgaccgcccacggggacacgccgcagctggacctgaaggcccggcccaactacggcgcgggcgagatcaccgtgctcgtcgaggtggccgacatggagctgcacaccaagaagatcgagatcagcgggctgaagttcgccagcctcacctgcacgggctgctacgcctgctccagcgggatctcctgcaaggtgcgcatccacgtcgacgagcccgacgagctgaccgtgcacgtgaagagcgacgacccggacgtcgtggccgcgtccagctccctgatggcccggaagctcgagttcggcaccgacagcaccttcaaggccttctccgccatgcccaagacgagcctgtgcttctacatcgtggagcgcgagtactgcaagtcctgcagcaaggaggacacccagaagtgcgtcaacaccaagctggagcacccccagtccatcctcatcgagcacaaggggaccatcatcggcaagcagaacaacacgtgcaccgcgaagaccagctgctggctggagtccgtgaagagcttcttctacggcctgaagaacatgctctccgggatcttcggcaacgtgttcgtcgggatcttcctgttcctggcccccttcatcctcctgatcctgttcttcatgttcggctggcggatcctcttctgcttcaagtgctgccgccggacccgcgggctgttccggtacaagcacctggaggacgacgaggagacgggctaccgccggatcatcgagcgcctcaacaacaagaagggcaagaacaagctgctggacggggagcggctcgccgaccgccgcatcgccgagctgttcagcaccaagacccacatcggc

SEQ ID NO: 12279 - RNA, 2916 nt, synthetic construct
  misc_feature 1..2916: note = derived and/or modified CDS sequence (opt1) from CCHFV(K168_125, Artificial)__KX013460.1__Gn-4aa-Gc
  source 1..2916: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaaggtgcccctgctcggcaagatggccatctacatctgccggatgagcaaccacccgaagaccacgatggccttcctgttctggttctccttcggctacgtcatcacctgcatcgtgtgcaaggccatcttctacctgctcatcatcgtggggaccctgggcaagcgcttcaagcagtaccgggagctgaagccccagacctgcacgatctgcgagaccacccccaccaacgccatcgacgcggagatgcacgacctcaactgcagctacaacatctgcccctactgcgcctcccgcctgacgagcgacgggctggcccggcacgtcacccactgcccgaagcgcaaggagaaggtggaggagaccgagctctacctgaacctggagcggatcccctgggtggtccgcaagctcctgcaggtgtccgagagcaccggcgtggccctgaagcggagctcctggctcatcgtcctgctggtgctcttcgcggtgagcctgtcccccgtccagagcgcccccatcgggcgccggccgctgttcctcgactccatcgtgaagggcaagaagaacctgctgaacagcacgtccctcgagaccagcctgtccatcgaggccccctggggcgccatcaacgtgcagagcacctacaagcccaccgtctccgccgcgaacatcgccctgagctggtccagcgtggagcaccgcgggaacaagatcctcgtctccggccggagcgagtccatcatgaagctggaggagcgcacggggatcagctgggacctgggcgtggaggacgcctccgagagcaagctcctgaccgtgagcgtcatggacctgtcccagatgtacagccccgtgttcgagtacctctccggggaccggcaggtggaggagtggccgaaggccacctgcaccggcgactgccccgagcgctgcggctgcacgagctccacctgcctgcacaaggagtggccccacagccgcaactggcggtgcaaccccacctggtgctggggggtcggcaccgggtgcacgtgctgcggcctggacgtgaaggacctcttcaccgactacatgttcgtgaagtggaaggtcgagtacatcaagaccgaggccatcgtgtgcgtggagctgacctcccaggagcgccagtgcagcctgatcgaggcggggacgcggttcaacctgggcccggtcaccatcaccctctccgagccccgcaacatccagcagaagctgccccccgagatcatcaccctgcacccgcggatcgaggagggcttcttcgacctcatgcacgtgcagaaggtgctgagcgcctccaccgtctgcaagctgcagagctgcacgcacggggtgcccggcgacctccaggtgtaccacatcgggaacctgctgaagggcgacaaggtcaacggccacctcatccacaagatcgagccccacttcaacacctcctggatgagctgggacgggtgcgacctggactactactgcaacatgggcgactggccctcctgcacctacaccggggtgacgcagcacaaccacgccagcttcatcaacctgctcaacatcgagaccgactacaccaagtccttccacttccacagcaagcgcgtgaccgcccacggcgacacgccgcagctggacctgaaggcccggcccaactacggggcgggcgagatcaccgtcctcgtggaggtggccgacatggagctgcacaccaagaagatcgagatcagcggcctgaagttcgcctccctcacctgcacggggtgctacgcctgcagctccggcatcagctgcaaggtccgcatccacgtggacgagcccgacgagctgaccgtgcacgtcaagtccgacgacccggacgtggtggccgcgagctccagcctgatggcccggaagctcgagttcgggaccgactccaccttcaaggccttcagcgccatgcccaagacgtccctgtgcttctacatcgtcgagcgcgagtactgcaagagctgctccaaggaggacacccagaagtgcgtgaacaccaagctggagcacccccagagcatcctcatcgagcacaagggcaccatcatcgggaagcagaacaacacgtgcaccgcgaagacctcctgctggctggagagcgtgaagtccttcttctacggcctgaagaacatgctcagcggcatcttcgggaacgtcttcgtgggcatcttcctgttcctggcccccttcatcctcctgatcctgttcttcatgttcgggtggcggatcctcttctgcttcaagtgctgccgccggacccgcggcctgttccggtacaagcacctggaggacgacgaggagacggggtaccgccggatcatcgagcgcctcaacaacaagaagggcaagaacaagctgctggacggcgagcggctcgccgaccgccgcatcgccgagctgttctccaccaagacccacatcggg

SEQ ID NO: 12280 - RNA, 2916 nt, synthetic construct
  misc_feature 1..2916: note = derived and/or modified CDS sequence (opt1) from CCHFV(K229_194, Artificial)__KX013463.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaagggcaacctcatcgacctggggtgcccccacatcccgctgctcggcaagatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacgggctggcccgccacgtgacccagtgccccaagcggaaggagaaggtcgaggagaccgagctctacctgaacctggagcgcatcccctggatcgtgcggaagctcctccaggtgagcgagtccaccggcgtcgcgctgaagcgcagcagctggctcatcgtgctgctggtgctcctgacggtctccctgagccccgtgcagtccgccccggtggggcggaagcccctcttcctggacagcatcgtcaagggcaagaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcgggaacaagatcctggtgaccggccggagcgagtccatcatgaagctggaggagcgcaccggggtgagctgggacctcggcgtcgaggacgcctccgagagcaagctgctgacggtgtccatcatggacctcagccagatgtacagcccggtcttcgagtacctgtccggggaccgccaggtggaggagtggcccaaggcgacctgcaccggcgactgccccgagcggtgcggctgcaccagctccacgtgcctgcacaaggagtggccccacagccggaactggcgctgcaacccgacctggtgctggggcgtggggaccgggtgcacgtgctgcggcgtcgacgtgaaggacctcttcaccgaccacatgttcatcaagtggaaggtggagtacatcaagaccgaggccatcgtctgcgtggagctgacctcccaggagcgccagtgcagcctgatcgaggccgggacccggttcaacctgggccccgtgaccatcacgctctccgagccccgcaacatccagcagaagctgcccccggagatcatcaccctgcaccccaagatcgaggagggcttcttcgacctcatgcacgtccagaaggtgctgagcgcctccaccgtgtgcaagctgcagagctgcacccacgggatccccggcgacctccagatctaccacatcgggaacctgctgaagggcgaccggctcaacggccacctgatccacaagatcgagccccacttcaacacgtcctggatgagctgggacgggtgcgacctggactactactgcaacatgggcgactggccgtcctgcacctacaccggggtcacccagcacaaccacgccgccttcgtgaacctcctgaacatcgagacggactacaccaagaccttccacttccacagcaagcgcgtgaccgcccacggcgacacgccccagctggacctcaaggcccggcccacctacggggcgggcgagatcaccgtcctggtggaggtggccgacatggagctgcacaccaagaaggtcgagatctccggcctcaagttcgccagcctggcctgcacggggtgctactcctgcagcagcggcatctcctgcaaggtgcgcatccacgtggacgagccggacgagctgaccgtccacgtcaagagctccgaccccgacgtggtggccgcgagcacctccctcatggcccggaagctggagttcgggaccgacagcacgttcaaggccttctccgccatgcccaagaccagcctgtgcttctacatcgtggagcgcgagtactgcaagtcctgcagcgaggacgacaccaagaagtgcgtggacaccaagctcgagcagccccagtccatcctgatcgagcacaagggcacgatcatcgggaagcagaacgacacgtgcaccgcgaaggccagctgctggctggagtccgtcaagagcttcttctacggcctcaagaacatgctgggctccgtgttcgggaacttcttcgtgggcatcctcctgttcctggccccgttcgtcctgctcgtgctgttcttcatgttcgggtggaagatcctgttctgcttcaagtgctgccggcgcacccggggcctcttcaagtaccgccacctgaaggacgacgaggagaccgggtaccggaagatcatcgagcgcctgaacagcaagaagggcaagaaccggctcctggacggcgagcgcctggccgaccggaagatcgccgagctgttctccaccaagacccacatcggg

SEQ ID NO: 12281 - RNA, 2916 nt, synthetic construct
  misc_feature 1..2916: note = derived and/or modified CDS sequence (opt1) from CCHFV(K229_243, Artificial)__KX013466.1__Gn-4aa-Gc
  source 1..2916: mol_type = other RNA
agcgaggagcccggcgacgactgcatctcccgcacccagctcctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggatgaagaacctgctcaactccacgagcctggagacctccctgagcatcgaggccccctggggcgccatcaacgtgcagtccaccttcaagccgaccgtcagcacggccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgaccgtctccatcatggacctcagccagatgtacagccccgtgttcgagtacctgtccggcgaccgccaggtggaggagtggcccaaggccacgtgcaccggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcaccctctccgagccccggaacatccagcagaagctgccgcccgagatcatcacgctgcaccccaaggtggaggagggcttcttcgacctcatgcacgtccagaaggtgctgagcgcgtccaccgtgtgcaagctgcagagctgcacccacggcatccccggggacctccaggtctaccacatcggcaacctgctgaagggggaccgcgtgaacggccacctcatccacaagatcgagccgcacttcaacacctcctggatgagctgggacggctgcgacctggactactactgcaacatgggggactggccctcctgcacgtacaccggcgtgacccagcacaaccacgccgccttcgtcaacctgctcaacatcgagaccgactacacgaagaccttccacttccacagcaagcgggtgaccgcccacggggacacgccccagctggacctgaaggcccgcccgacctacggcgcgggggagatcaccgtgctcgtcgaggtggccgacatggagctgcacaccaagaaggtggagatctccggcctgaagttcgccagcctcgcctgcaccggctgctacgcctgctccagcgggatcagctgcaaggtccggatccacgtggacgagcccgacgagctgacggtgcacgtcaagtccagcgaccccgacgtggtggcggcctccaccagcctgatggcccgcaagctcgagttcggcaccgactccaccttcaaggccttcagcgcgatgcccaagacgtccctgtgcttctacatcgtcgagaaggagtactgcaagagctgctccgaggaggacacccagaagtgcgtggacaccaagctggagcagccgcagagcatcctcatcgagcacaaggggaccatcatcggcaagcagaacgacacgtgcaccgccaaggcctcctgctggctggagagcgtgaagtccttcttctacgggctgaagaacatgctcggcagcgtcttcggcaacttcttcatcgggatcctgctgttcctcacccccttcgtgctgctggtgctgttcttcatgttcggctggaagatcctcttctgcttcaagtgctgccggcgcacccgggggctgctcaagtaccgccacctgaaggacgacgaggagacgggctaccggcgcatcatcgagcggctgaacaacaagaaggggaagaaccgcctcctggacggcgagcggctggccgaccgcaagatcgccgagctgttctccaccaagacccacatcggc

SEQ ID NO: 12282 - RNA, 2916 nt, synthetic construct
  misc_feature 1..2916: note = derived and/or modified CDS sequence (opt1) from CCHFV(K315_14, Artificial)__KX013469.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgtctgcgactccagctgcgagatcatgatccccaaggggacgggcgacatcctggtggactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtcaacgccatcgacgcggagatgcacgacctcaactgctcctacaacatctgcccgtactgcgccagccggctgacgtccgagggcctggcccgccacgtgacccagtgccccaagcggaaggagaaggtggaggagaccgagctctacctgaacctggagcgcatcccctggatcgtccggaagctcctccaggtgagcgagtccaccggggtggccctgaagcgcagcagctggctcatcgtcctgctggtgctcctgacggtgtccctgagccccgtccagtccgcgccggtgggccggaagcccctcttcctggacagcatcgtgaaggggatgaagaagctgctcaactccaccagcctggagacctccctgagcatcgaggccccctggggcgccatcaacgtccagtccaccttcaagcccacggtgagcaccgccaacatcgccctctcctggagctccgtggagcaccgcggcaacaagatcctggtcaccgggcggagcgagtccatcatgaagctggaggagcgcaccggcgtgagctgggacctcggggtcgaggacgcgtccgagagcaagctgctgacggtgtccatcatggacctcagccagatgtacagcccggtgttcgagtacctgtccggcgaccggcaggtcgaggagtggcccaaggcgacctgcaccggggactgccccgagcgctgcggctgcaccagctccacgtgcctgcacaaggagtggccccacagccggaactggcgctgcaacccgacctggtgctggggcgtggggaccggctgcacgtgctgcggggtggacgtcaaggacctcttcaccgaccacatgttcatcaagtggaaggtggagtacatcaagaccgaggccatcgtgtgcgtcgagctgacctcccaggagcgccagtgcagcctgatcgaggccggcacccggttcaacctggggcccgtgaccatcacgctctccgagccccgcaacatccagcagaagctgcccccggagatcatcaccctgcaccccaagatcgaggagggcttcttcgacctcatgcacgtgcagaaggtcctgagcgcctccaccgtgtgcaagctgcagagctgcacccacggcatccccggggacctccagatctaccacatcggcaacctgctgaagggggaccgggtgaacggccacctcatccacaagatcgagccccacttcaacacgtcctggatgagctgggacggctgcgacctggactactactgcaacatgggggactggccgtcctgcacctacaccggcgtcacccagcacaaccacgccgccttcgtgaacctgctcaacatcgagacggactacaccaagaccttccacttccacagcaagcgcgtgaccgcccacggggacacgccccagctggacctgaaggcccggcccacctacggcgccggggagatcaccgtcctcgtggaggtggcggacatggagctgcacaccaagaaggtcgagatctccggcctgaagttcgccagcctcacgtgcaccggctgctacgcctgctccagcgggatcagctgcaaggtgcgcatccacgtggacgagccggacgagctgaccgtccacgtgaagtccagcgaccccgacgtggtcgccgcctccaccagcctgatggcgcggaagctcgagttcggcacggactccaccttcaaggccttcagcgccatgcccaagacctccctgtgcttctacatcgtggagcgcgagtactgcaagagctgctccgaggacgacaccaagaagtgcgtggacacgaagctggagcagccccagagcatcctcatcgagcacaaggggaccatcatcggcaagcagaacgacacgtgcaccgccaaggcgtcctgctggctggagagcgtcaagtccttcttctacgggctgaagaacatgctcggcagcgtgttcggctccttcttcgtggggatcctgctgttcctcgccccgttcgtcctgctggtgctgttcttcatgttcggctggaagatcctgttctgcttcaagtgctgccggcgcacccgggggctgttcaagtaccgccacctcaaggacgacgaggagaccggctaccggcgcatcatcgagcggctgaacagcaagaaggggaagaaccgcctgctcgacggcgagcggctggccgaccgcaagatcgccgagctgttctccaccaagacccacatcggc

SEQ ID NO: 12283 - RNA, 2916 nt, synthetic construct
  misc_feature 1..2916: note = derived and/or modified CDS sequence (opt1) from CCHFV(K323_27, Artificial)__KX013472.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacctgcatcttctgcaaggccctgttctacctcctgatcatcatcggcacgctggggaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacggcctcgcccgccacgtgacccagtgccccaagcggaaggagaaggtcgaggagaccgagctgtacctgaacctcgagcgcatcccctggatcgtgcggaagctgctgcaggtgtccgagagcaccggggtcgcgctcaagcgctccagctggctgacggtgctgctcgtgctgctgaccgtcagcctctcccccgtgcagagcgccccggtgggccggaagcccctgttcctggactccatcgccaaggggatgaagaacctcctgaacagcacctccctggagaccagcctctccatcgaggccccctggggcgccatcaacgtccagagcacgttcaagcccaccgtgtccaccgcgaacatcgccctgagctggtccagcgtggagcaccgcggcaacaagatcctggtcaccgggcggtccgagagcatcatgaagctcgaggagcgcacgggcgtgtcctgggacctgggggtggaggacgccagcgagtccaagctgctcaccgtcagcatcatggacctgtcccagatgtacagcccggtgttcgagtacctgagcggcgaccggcaggtcgaggagtggcccaaggccacctgcaccggggactgccccgagcgctgcggctgcacgtccagcacctgcctccacaaggagtggccccactcccggaactggcgctgcaacccgacctggtgctggggcgtggggaccggctgcacgtgctgcggggtggacgtcaaggacctgttcaccgaccacatgttcatcaagtggaaggtggagtacatcaagaccgaggccatcgtgtgcgtcgagctgaccggccaggagcgccagtgcagcctgatcgaggcggggacccggttcaacctcggccccgtgacgatcaccctgtccgagccccgcaacatccagcagaagctgcccccggagatcatcaccctccaccccaagatcgaggagggcttcttcgacctgatgcacgtgcagaaggtcctgagcgcctccaccgtgtgcaagctccagagctgcacgcacgggatccccggcgacctgcagatctaccacatcgggaacctgctcaagggcgaccgggtgaacggccacctgatccacaagatcgagccccacttcaacacctcctggatgagctgggacgggtgcgacctggactactactgcaacatgggcgactggccgtcctgcacctacaccggggtcacgcagcacaaccacgccgccttcgtgaacctcctgaacatcgagaccgactacaccaagaccttccacttccacagcaagcgcgtgacggcccacggcgacaccccccagctggacctcaaggcgcggcccacctacggggccggcgagatcaccgtcctggtggaggtggccgacatggagctgcacacgaagaaggtcgagatctccggcctcaagttcgccagcctgacctgcaccgggtgctacgcctgctccagcggcatctcctgcaaggtgcgcatccacgtggacgagccggacgagctgaccgtccacgtgaagagcagcgaccccgacgtggtcgcggcctccacgagcctcatggcccggaagctggagttcgggaccgactccaccttcaaggccttcagcgcgatgcccaagacctccctgtgcttctacatcgtggagcgcgagtactgcaagagctgctccgaggacgacacgaagaagtgcgtggacaccaagctcgagcagccccagagcatcctgatcgagcacaagggcaccatcatcgggaagcagaacgacacctgcacggccaaggcctcctgctggctggagagcgtcaagtccttcttctacggcctcaagaacatgctgggcagcgtgttcgggtccttcttcgtgggcatcctgctcttcctggccccgttcgtcctgctcgtgctgttcttcatgttcgggtggaagatcctgttctgcttcaagtgctgccggcgcacccggggcctcttcaagtaccgccacctgaacgacgacgaggagaccgggtaccggcgcatcatcgagcggctgaacagcaagaagggcaagaaccgcctcctggacggcgagcggctggccgaccgcaagatcgcggagctcttctccaccaagacgcacatcggg

SEQ ID NO: 12284 - RNA, 2916 nt, synthetic construct
  misc_feature 1..2916: note = derived and/or modified CDS sequence (opt1) from CCHFV(K340_6, Artificial)__KX013475.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccacgaccggcaagacctgcgagatcgacagcacccccgtgaagtgccggcaggggttctgcctgaagatcacgcaggagggccgcgggcacgtgaagctgtcccggggcagcgaggtcgtgctcgacgcctgcgactccagctgcgagatcatgatccccaaggggaccggcgacatcctggtggactgctccggcgggcagcagcacttcctgaaggacaacctcatcgacctgggctgcccccacatcccgcccctggggaagatggcgatctacatctgccgcatgagcaaccacccccggaccaccatggccttcctcttctggttctccttcggctacgtcatcacgtgcatcttctgcaaggccctgttctacagcctgatcatcatcggcaccctcgggaagaagatcaagcagtaccgcgagctgaagccccagacctgcaccatctgcgagacggccccggtgaacgccatcgacgcggagatgcacgacctgaactgctcctacaacatctgcccctactgcgccagccggctcacctccgacggcctggcccgccacgtgacccagtgccccaagcggaaggagaaggtcgaggagaccgagctgtacctcaacctggagcgcatcccctggatcgtgcggaagctgctccaggtgagcgagtccacgggggtcgccctgaagcgcagcagctggctgatcgtgctcctggtgctgctcaccgtctccctgagcccggtgcagtccgcgcccgtgggccggaagcccctgagcctcgactccatcgtcaaggggatgaagaacctgctgaacagcacctccctcgagaccagcctgtccatcgaggccccctggggcgccatcaacgtgcagagcacgttcaagccgaccgtgtccaccgccaacatcgccctgagctggtccagcgtcgagcaccgcggcaacaagatcctcgtgaccgggcggtccgagagcatcatgaagctggaggagcgcacgggcgtgtcctgggacctgggggtcgaggacgcgagcgagtccaagctcctgaccgtgagcatcatggacctgagccagatgtactcccccgtcttcgagtacctcagcggcgaccggcaggtggaggagtggcccaaggccacctgcaccggggactgccccgagcgctgcggctgcacgtccagcacctgcctgcacaaggagtggccgcactcccggaactggcgctgcaaccccacctggtgctggggcgtggggaccggctgcacgtgctgcggggtcgacgtgaaggacctgttcaccgaccacatgttcatcaagtggaaggtggagtacatcaagaccgaggccatcgtctgcgtggagctcaccagccaggagcgccagtgctccctgatcgaggccggcacccggttcaacctggggcccgtgacgatcaccctgagcgagccccgcaacatccagcagaagctcccgcccgagatcatcaccctgcaccccaagatcgaggagggcttcttcgacctgatgcacgtccagaaggtgctctccgccagcaccgtgtgcaagctgcagtcctgcacgcacggcatccccggggacctgcagatctaccacatcggcaacctcctgaagggggaccgggtcaacggccacctgatccacaagatcgagccgcacttcaacaccagctggatgtcctgggacggctgcgacctcgactactactgcaacatgggggactggcccagctgcacctacaccggcgtgacgcagcacaaccacgcggccttcgtgaacctgctgaacatcgagaccgactacaccaagaccttccacttccactccaagcgcgtcacggcccacggggacaccccccagctcgacctgaaggcccggccgacctacggcgccggggagatcaccgtgctggtggaggtcacggacatggagctccacaccaagaaggtggagatcagcggcctgaagttcgcgtccctgacctgcaccggctgctacgcctgcagcagcgggatctcctgcaaggtgcgcatccacgtcgacgagcccgacgagctcacggtgcacgtgaagagctccgaccccgacgtcgtggccgccagcacctccctgatggcccggaagctggagttcggcaccgacagcaccttcaaggcgttctccgccatgcccaagacgagcctctgcttctacatcgtggagcgcgagtactgcaagtcctgcagcgaggacgacaccaagaagtgcgtcgacaccaagctggagcagccgcagtccatcctgatcgagcacaaggggaccatcatcggcaagcagaacgacacgtgcaccgccaaggccagctgctggctcgagtccgtgaagagcttcttctacgggctgaagaacatgctgggctccgtgttcggcagcttcttcgtcgggatcctcctgttcctggcgcccttcgtgctcctggtgctgttcttcatgttcggctggaagatcctcttctgcttcaagtgctgccggcgcacccgggggctgttcaagtaccgccacttcaaggacgacgaggagaccggctaccggcgcatcatcgagcggctgaactccaagaaggggaagaaccgcctcctggacggcgagcggctggccgaccgcaagatcgccgagctcttcagcacgaagacccacatcggc

SEQ ID NO: 12285 - RNA, 2916 nt, synthetic construct
  misc_feature 1..2916: note = derived and/or modified CDS sequence (opt1) from CCHFV(Mamon, Artificial)__KX013478.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgtccgacgcgtgcgacagctcctgcgaggtgatgatccccaaggggacgggcgacatcctcgtcgactgcagcggcgggcagcagcacttcctgaaggacaacctgatcgacctcggctgcccccacatcccgctgctggggaagatggccatctacatctgccggatgtccaaccacccccgcaccaccgtggccttcctcttctggttcagcttcggctacgtgatcacgtgcatcttctgcaaggccctgttctactccctgatcatcatcggcaccctcgggaagaagatcaagcagtaccgggagctgaagccccagacctgcaccatctgcgagaccgcccccgtcaacgcgatcgacgccgagatgcacgacctgaactgcagctacaacatctgcccgtactgcgcctcccgcctcacgagcgacggcctggcccggcacgtgccccagtgccccaagcgcaaggagaaggtggaggagaccgagctgtacctcaacctggagcggatcccctggatcgtccgcaagctgctccaggtgtccgagagcaccggggtggcgctgaagcggagctcctggctgatcgtcctcctggtgctgctcaccgtgagcctgtccccggtccagagcgcccccgtgggccgcaagcccctgttcctcgactccatcgtgaaggggatgaagaacctgctgaacagcacgtccctcgagaccagcctgtccatcgaggccccctggggcgccatcaacgtccagagcaccttcaagccgaccgtgtccacggccaacatcgcgctgagctggtccagcgtggagcaccggggcaacaagatcctcgtcaccgggcgctccgagagcatcatgaagctggaggagcggaccggcgtgtcctgggacctgggggtcgaggacgccagcgagtccaagctcctgaccgtgagcatcatggacctgagccagatgtactcccccgtgttcgagtacctcagcggcgaccgccaggtcgaggagtggcccaaggccacgtgcaccggggactgccccgagcggtgcggctgcacctccagcacgtgcctgcacaaggagtggccgcactcccgcaactggcgctgcaaccccacctggtgctggggcgtggggaccggctgcacgtgctgcggggtggacgtcaaggacctgttcaccgaccacatgttcgtgaagtggaaggtggagtacatcaagaccgaggccatcgtctgcgtggagctcaccagccaggagcggcagtgctccctgatcgaggccggcacccgcttcaacctggggcccgtgaccatcaccctgagcgagccccggaacatccagcagaagctcccgcccgagatcatcacgctgcaccccaaggtcgaggagggcttcttcgacctgatgcacgtgcagaaggtgctctccgcgagcaccgtctgcaagctgcagtcctgcacccacggcatccccggggacctccaggtgtaccacatcggcaacctgctgaagggggaccgcgtgaacggccacctgatccacaagatcgagccgcacttcaacaccagctggatgtcctgggacggctgcgacctcgactactactgcaacatgggggactggcccagctgcacgtacaccggcgtcacccagcacaaccacgccgccttcgtgaacctgctgaacatcgagaccgactacacgaagaccttccacttccactccaagcgggtgaccgcccacggggacacgccccagctcgacctgaaggcccgcccgacctacggcgcgggggagatcaccgtcctggtggaggtggccgacatggagctccacaccaagaaggtcgagatcagcggcctgaagttcgcctccctggcctgcaccggctgctacgcctgcagcagcgggatctcctgcaaggtgcggatccacgtggacgagcccgacgagctcacggtccacgtcaagagctccgaccccgacgtggtggcggccagcacctccctgatggcccgcaagctggagttcggcaccgacagcaccttcaaggccttctccgcgatgcccaagacgagcctctgcttctacatcgtggagcgggagtactgcaagtcctgcagcgaggaggacacccagaagtgcgtggacaccaagctggagcagccgcagtccatcctgatcgagcacaaggggaccatcatcggcaagcagaacgacacgtgcaccgccaagaccagctgctggctcgagtccgtcaagagcttcttctacgggctgaagaacatgctgggctccgtgttcggcaacttcttcatcgggatcctcctgttcctggcccccttcgtgctcctggtcctgttcttcatgttcggctggaagatcctcttctgcttcaagtgctgccgccggacccgcgggctgctgaagtaccggcacctcaaggacgacgaggagacgggctaccgccggatcatcgagcgcctgaacaacaagaaggggaagaaccggctgctcgacggcgagcgcctggccgaccggaagatcgccgagctgttcagcaccaagacccacatcggc

SEQ ID NO: 12286 - RNA, 2916 nt, synthetic construct
  misc_feature 1..2916: note = derived and/or modified CDS sequence (opt1) from CCHFV(Min, Artificial)__KX013481.1__Gn-4aa-Gc
  source 1..2916: mol_type = other RNA
agcgaggagcccggcgacgactgcatctcccgcacccagctcctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcctggacagcatcgtgaaggggacgaagaacctgctcaactccaccagcctggagacctccctgagcatcgaggccccctggggcgccatcaacgtgcagtccaccttcaagccgacggtcagcaccgccaacatcgcgctctcctggagctccgtggagcaccggggcaacaagatcctggtgaccgggcgcagcgagtccatcatgaagctggaggagcggaccggcgtcagctgggacctcggggtggaggacgcctccgagagcaagctgctgacggtctccatcatggacctcagccagatgtacagccccgtgttcgagtacctgtccggcgaccgccaggtggaggagtggcccaaggcgacctgcaccggggactgccccgagcggtgcggctgcaccagctccacgtgcctgcacaaggagtggccgcacagccgcaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcggcagtgcagcctgatcgaggccggcacccgcttcaacctggggcccgtgaccatcacgctctccgagccccggaacatccagcagaagctgccgcccgagatcatcaccctgcaccccaaggtggaggagggcttcttcgacctcatgcacgtccagaaggtgctgagcgcctccaccgtgtgcaagctgcagagctgcacccacggcatccccggggacctccaggtctaccacatcggcaacctgctgaagggggaccgcatcaacggccacctcatccacaagatcgagccgcacttcaacacgtcctggatgagctgggacggctgcgacctggactactactgcaacatgggggactggccctcctgcacctacaccggcgtgacccagcacaaccacgccgccttcgtgaacctgctcaacatcgagacggactacaccaagaccttccacttccacagcaagcgggtcaccgcccacggggacacgccccagctggacctgaaggcccgcccgacctacggcgcgggggagatcaccgtgctcgtggaggtcgccgacatggagctgcacaccaagaaggtggagatctccggcctgaagttcgccagcctcgcctgcacgggctgctacgcctgctccagcgggatcagctgcaaggtgcggatccacgtcgacgagcccgacgagctgaccgtgcacgtgaagtccagcgaccccgacgtcgtggcggcctccaccagcctgatggcccgcaagctcgagttcggcaccgactccacgttcaaggccttcagcgcgatgcccaagacctccctgtgcttctacatcgtggagcgggagtactgcaagagctgctccgaggaggacacccagaagtgcgtcgacaccaagctggagcagccgcagagcatcctcatcgagcacaaggggacgatcatcggcaagcagaacgacacgtgcaccgccaaggcctcctgctggctggagagcgtgaagtccttcttctacgggctgaagaacatgctcggcagcgtgttcggcaacttcttcatcgggatcctgctgttcctcgcccccttcgtcctgctggtgctgttcttcatgttcggctggaagatcctcttctgcttcaagtgctgccgccggacccgcgggctgctcaagtaccggcacctgaaggacgacgaggagaccggctaccgccggatcatcgagcgcctgaacaacaagaaggggaagaaccggctcctggacggcgagcgcctggccgaccggaagatcgcggagctgttctccaccaagacccacatcggc

SEQ ID NO: 12287 - RNA, 2916 nt, synthetic construct
  misc_feature 1..2916: note = derived and/or modified CDS sequence (opt1) from CCHFV(Nakiwogo, Artificial)__KX013484.1__Gn-4aa-Gc
  source 1..2916: mol_type = other RNA
gccgagggcgtgagcaacgactgcgtgtcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgtgatcgacgccgagatgcacgagctgaactgcaactacaacatctgcccctactgcgcctcccggctcaccagcgacggcctggtgcgccacgtcacccagtgcccgaagcggaaggagaaggtggaggagacggagctgtacctcaacctggagcgcatcccctggctggtgcggcgcctcctgcaggtctccgagagcaccgggatggcgctgaagcggtcctgctggatgaccaccctcctgatcctgctcgtggtcagcctgtcccccgtgcagagcgcccccgtgggccgcaagccgctgtacctcgacagcatcgccaaggggatgaagtccctgctgaacagcacgaacctcgagacctccctgagcatcgaggccccctggggcgcgatcaacgtccagtccaccttcaagcccaccgtgagcgccgccaacatcgccctgtcctggagctccgtggagcaccggggcaacaagatcctcgtcagcgggcgctccgagagcatcatgaagctggaggagcggacgggcatctcctggagcctgggggtggaggacgcctccgagagcaagaccctcaccgtgtccgtcatggacctgagccagatgtactcccccgtgttcgagtacctgagcggcgaccgccaggtggaggagtggccgaaggcgacctgcacgggggactgccccgagcggtgcggctgcaccagctccacgtgcctccacaaggagtggccccacagccgcaactggcggtgcaaccccacctggtgctggggcgtcgggaccggctgcacgtgctgcgggctggacgtgcgcgacctgttcaccgactacatgatggtgaagtggaaggtcgagtacgtgaagaccgaggccatcatgtgcgtggagctgacctcccaggagcgccagtgcagcctcatcgaggccggcacccggttcaacctggggccggtcaccatcaccctgtccgagccccgcaacgtgcagcagcggctccccagcgagatcgtgaccctgcaccccaagatcgaggagggcttcttcgacctgatgcacgtccagaaggtgctgttctgcaagcactccctccaggccacgagctgcacccacggcgtgccgggggacctgcaggtctaccacgtgggcaacctcctgaagggggacaaggtgaacggccactccatccacaagatcgagagccacttcaacacctcctggatgagctgggacggctgcgacctggactacttctgcaacatgggggactggccctcctgcacctacacgggcgtcacccagcacaaccgcgccgcgttcgtgaacatgctcaacatcgagaccgactacaccaagacgttccacttccacagcaagcgggtgaccgcccacggggacacgccccagctggacctgaaggcccgccccacctacggcgccggggaggtcaccgtgctcgtggaggtcgccgacctggagctgcacaccaagaagatcgaggtgtccggcctcaagttcgcgagcctgacctgctccggctgctacgcctgcagcagcgggatctcctgcaaggtgcggatccacgtcaacgagccggacgagttcaccgtgcacgtcaagagcaacgaccccgacgtggtggccgccggctccagcctgatggcccgcaagatcgagctcggggcggactccacgttcaaggccttcagctccatgcccaagaacagcctgtgcttctacatcgtggagcgggactactgctccagctgcaccgacgacgacacccagaagtgcgtcaacaccaagctggagcacccgcagtccatcctcatcgagcacaagggcacgatcatcgggaagcagaacgacacgtgccccaccaagaccagctgctggctggagtccgtcaagagcttcttctacggcctgaagaacatgctcggcgggatcttcggcaacgtgttcctggggatcttcctgttcctcgcccccttcgccctgctgatcctcttcttcttcttcggctggcgcctgctgttctgcctcaagtgctgccggcgcacccgggggctgctgaagtacaagcagctcaaggacgaggaggaggcgggctacaagaagatcatcgagcgcctgaacgacaagaagggcaagtcccggctgttcgacggggagcgcctcgccgaccggaagatcgccgagctgttcagcaccaagacccacatcggc

SEQ ID NO: 12288 - RNA, 2916 nt, synthetic construct
  misc_feature 1..2916: note = derived and/or modified CDS sequence (opt1) from CCHFV(Saf, Artificial)__KX013487.1__Gn-4aa-Gc
  source 1..2916: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcactacctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggccgcaagcccctcttcagcgactccatcgtgaaggggatgaagaacctgctgaacagcacgtccctcgagaccagcctgtccatcgaggccccctggggcgccatcaacgtgcagagcaccttcaagccgaccgtctccacggccaacatcgcgctgagctggtccagcgtggagcaccggggcaacaagatcctcgtgaccgggcgctccgagagcatcatgaagctggaggagcggaccggcgtctcctgggacctgggggtggaggacgccagcgagtccaagctcctgaccgtcagcatcatggacctgagccagatgtactcccccgtgttcgagtacctcagcggcgaccgccaggtggaggagtggcccaaggccacgtgcaccggggactgccccgagcggtgcggctgcacctccagcacgtgcctgcacaaggagtggccgcactcccgcaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctcaccagccaggagcggcagtgctccctgatcgaggccggcacccgcttcaacctggggcccgtgaccatcaccctgagcgagccccggaacatccagcagaagctcccgcccgagatcatcacgctgcaccccaaggtggaggagggcttcttcgacctgatgcacgtccagaaggtgctctccgcgagcaccgtgtgcaagctgcagtcctgcacccacggcatccccggggacctgcaggtctaccacatcggcaacctcctgaagggggaccgcgtgaacggccacctgatccacaagatcgagccgcacttcaacaccagctggatgtcctgggacggctgcgacctcgactactactgcaacatgggggactggcccagctgcacgtacaccggcgtgacccagcacaaccacgccgccttcgtcaacctgctgaacatcgagaccgactacatgaagacgttccacttccactccaagcgggtgaccgcccacggggacacgccccagctcgacctgaaggcccgcccgacctacggcgcgggggagatcaccgtgctggtcgaggtggccgacatggagctccacaccaagaaggtggagatcagcggcctgaagttcgtctccctggcctgcaccggctgctacgcctgcagcagcgggatctcctgcaaggtgcggatccacgtggacgagcccgacgagctcaccgtccacgtcaagagctccgaccccgacgtggtggccgcgagcacgtccctgatggcccgcaagctggagttcggcaccgacagcaccttcaaggccttctccgccatgcccaagaccagcctctgcttctacatcgtggagcgggagtactgcaagtcctgcagcgaggaggacacgcagaagtgcgtggacaccaagctggagcagccgcagtccatcctgatcgagcacaaggggaccatcatcggcaagcagaacgacacgtgcaccgcgaaggccagctgctggctcgagtccgtcaagagcttcttctacgggctgaagaacatgctgggctccgtgttcggcaacttcttcatcgggatcctcctgttcctggcccccttcgtgctcctggtcctgttcttcatgttcggctggaagatcctcttctgcttcaagtgctgccgccggacccgcgggctgctgaagtaccggcacctcaaggacgacgaggagaccggctaccgccggatcatcgagcgcctgaacaacaagaaggggaagaaccggctgctcgacggcgagcgcctggccgaccggaagatcgccgagctgttcagcaccaagacgcacatcggc

SEQ ID NO: 12289 - RNA, 2916 nt, synthetic construct
  misc_feature 1..2916: note = derived and/or modified CDS sequence (opt1) from CCHFV(Ast199, Artificial)__KX056051.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgctgcagctggctcatcgtgctgctggtgctcctgacggtcagcctgtcccccgtgcagagcgccccggtgggccggaagcccctcttcctggactccatcgtcaaggggatgaagaacctgctcaacagcacctccctggagaccagcctgtccatcgaggccccctggggcgccatcaacgtgcagagcaccttcaagcccacggtgtccaccgccaacatcgcgctcagctggtccagcgtcgagcaccgcggcaacaagatcctggtgaccgggcggtccgagagcatcatgaagctggaggagcgcaccggcgtgtcctgggacctcggggtcgaggacgccagcgagtccaagctgctgacggtgagcatcatggacctctcccagatgtacagcccggtcttcgagtacctgagcggcgaccgccaggtggaggagtggcccaaggcgacctgcaccggggactgccccgagcggtgcggctgcacctccagcacgtgcctgcacaaggagtggccccactcccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgaccagccaggagcgccagtgctccctgatcgaggccggcacccggttcaacctggggcccgtgaccatcacgctcagcgagccccgcaacatccagcagaagctgcccccggagatcatcaccctgcaccccaagatcgaggagggcttcttcgacctcatgcacgtccagaaggtgctgtccgccagcaccgtgtgcaagctgcagtcctgcacccacggcatccccggggacctccagatctaccacatcggcaacctgctgaagggggaccggctcaacggccacctgatccacaagatcgagccccacttcaacacgagctggatgtcctgggacggctgcgacctggactactactgcaacatgggggactggccgagctgcacctacaccggcgtcacccagcacaaccacgccgccttcgtgaacctcctgaacatcgagacggactacaccaagaccttccacttccactccaagcgcgtgaccgcccacggggacacgccccagctggacctcaaggcccggcccacctacggcgcgggggagatcaccgtcctggtggaggtggccgacatggagctgcacaccaagaaggtcgaggtgagcggcctcaagttcgcctccctggcctgcacgggctgctacgcctgcagctccgggatcagctgcaaggtgcgcatccacgtcgacgagccggacgagctgaccgtgcacgtcaagagctccgaccccgacgtggtggcggccagcacctccctcatggcccggaagctggagttcggcaccgacagcacgttcaaggccttctccgcgatgcccaagaccagcctgtgcttctacatcgtggagcgcgagtactgcaagtcctgcagcgaggacgacaccaagaagtgcgtcgacaccaagctcgagcagccccagtccatcctgatcgagcacaaggggacgatcatcggcaagcagaacgacacgtgcaccgccaaggccagctgctggctggagtccgtcaagagcttcttctacgggctcaagaacatgctgggctccgtgttcggcaacttcttcgtggggatcctcctcttcctggccccgttcgtgctgctcgtgctgttcttcatcttcggctggaagatcctgttctgcttcaagtgctgccggcgcacccgggggctgttcaagtaccgccacctgaaggacgacgaggagaccggctaccggaagatcatcgagcgcctgaacagcaagaaggggaagaaccggctcctggacggcgagcgcctggccgaccggaagatcgcggagctgttctccaccaagacccacatcggc

SEQ ID NO: 12290 - RNA, 2916 nt, synthetic construct
  misc_feature 1..2916: note = derived and/or modified CDS sequence (opt1) from CCHFV(Ast149, Artificial)__KX056054.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctcatcgtgctgctggtgctcctgacggtctccctgagccccgtgcagtccgccccggtgggccggaagcccctcttcctggacagcatcgtcaaggggatgaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcggcaacaagatcctggtgaccgggcggagcgagtccatcatgaagctggaggagcgcaccggcgtgagctgggacctcggggtcgaggacgcctccgagagcaagctgctgacggtgtccatcatggacctcagccagatgtacagcccggtcttcgagtacctgtccggcgaccgccaggtggaggagtggcccaaggcgacctgcaccggggactgccccgagcggtgcggctgcaccagctccacgtgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggccggcacccggttcaacctggggcccgtgaccatcacgctctccgagccccgcaacatccagcagaagctgcccccggagatcatcaccctgcaccccaagatcgaggagggcttcttcgacctcatgcacgtccagaaggtgctgagcgcctccaccgtgtgcaagctgcagagctgcacccacggcatccccggggacctccagatctaccacatcggcaacctgctgaagggggaccggctcaacggccacctgatccacaagatcgagccccacttcaacacgtcctggatgagctgggacggctgcgacctggactactactgcaacatgggggactggccgtcctgcacctacaccggcgtcacccagcacaaccacgccgccttcgtgaacctcctgaacatcgagacggactacaccaagaccttccacttccacagcaagcgcgtgaccgcccacggggacacgccccagctggacctcaaggcccggcccacctacggcgcgggggagatcaccgtcctggtggaggtggccgacatggagctgcacaccaagaaggtcgaggtgtccggcctcaagttcgccagcctggcctgcacgggctgctacgcctgctccagcgggatcagctgcaaggtgcgcatccacgtcgacgagccggacgagctgaccgtgcacgtgaagtccagcgaccccgacgtcgtggcggcctccaccagcctcatggcccggaagctggagttcggcaccgactccacgttcaaggccttcagcgcgatgcccaagacctccctgtgcttctacatcgtggagcgcgagtactgcaagagctgctccgaggacgacaccaagaagtgcgtcgacaccaagctcgagcagccccagagcatcctgatcgagcacaaggggacgatcatcggcaagcagaacgacacgtgcaccgccaaggcctcctgctggctggagagcgtgaagtccttcttctacgggctcaagaacatgctgggcagcgtgttcggcaacttcttcgtcgggatcctcctcttcctggccccgttcgtgctgctcgccctgttcttcatcttcggctggaagatcctgttctgcttcaagtgctgccggcgcacccgggggctgttcaagtaccgccacctgaaggacgacgaggagaccggctaccggaagatcatcgagcgcctgaactccaagaaggggaagaaccggctcctggacggcgagcgcctggcggaccggaagatcgccgagctgttcagcaccaagacccacatcggc

SEQ ID NO: 12291 - RNA, 2916 nt, synthetic construct
  misc_feature 1..2916: note = derived and/or modified CDS sequence (opt1) from CCHFV(Ast137, Artificial)__KX056057.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatccacatctgccgcatgagcaaccacccccggaccaccatggccttcctgttctggttctccttcggctacgtcatcacctgcatcttctgcaaggccctgttctacagcctcatcatcatcggcacgctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctgcaggtgagcgagtccaccggggtcgcgctgaagcgcagcagctggctcatcgtgctgctggtgctcctgacggtctccctgagccccgtgcagtccgccccggtgggccggaagcccctcttcctggacagcatcgtcaaggggaccaagaacctgctcaactccaccagcctggagacctccctgagcatcgaggccccctggggcgccatcaacgtgcagtccacgttcaagcccaccgtgagcaccgccaacatcgcgctctcctggagctccgtcgagcaccgcggcaacaagatcctggtgaccgggcggagcgagtccatcatgaagctggaggagcgcacgggcgtgagctgggacctcggggtcgaggacgcctccgagagcaagctgctgaccgtgtccatcatggacctcagccagatgtacagcccggtcttcgagtacctgtccggcgaccggcaggtggaggagtggcccaaggccacctgcaccggggactgccccgagcgctgcggctgcacgagctccacctgcctgcacaaggagtggccccacagccggaactggcgctgcaacccgacctggtgctggggcgtggggaccggctgcacgtgctgcggggtcgacgtgaaggacctcttcaccgaccacatgttcatcaagtggaaggtggagtacatcaagaccgaggccatcgtctgcgtggagctgacctcccaggagcgccagtgcagcctgatcgaggccggcacccggttcaacctggggcccgtgacgatcaccctctccgagccccgcaacatccagcagaagctgcccccggagatcatcaccctgcaccccaagatcgaggagggcttcttcgacctcatgcacgtccagaaggtgctgagcgcgtccaccgtgtgcaagctgcagagctgcacgcacggcatccccggggacctccagatctaccacatcggcaacctgctgaagggggaccggctcaacggccacctgatccacaagatcgagccccacttcaacacctcctggatgagctgggacggctgcgacctggactactactgcaacatgggggactggccgtcctgcacctacaccggcgtcacgcagcacaaccacgccgccttcgtgaacctcctgaacatcgagaccgactacaccaagaccttccacttccacagcaagcgcgtgacggcccacggggacaccccccagctggacctcaaggcccggcccacctacggcgcgggggagatcaccgtcctggtggaggtggccgacatggagctgcacacgaagaaggtcgaggtgtccggcctcaagttcgccagcctggcctgcaccggctgctacgcctgctccagcgggatcagctgcaaggtgcgcatccacgtcgacgagccggacgagctgaccgtgcacgtgaagtccagcgaccccgacgtcgtggcggcctccaccagcctcatggcccggaagctggagttcggcacggactccaccttcaaggccttcagcgcgatgcccaagacctccctgtgcttctacatcgtggagcgcgagtactgcaagagctgctccgaggacgacaccaagaagtgcgtcgacacgaagctcgagcagccccagagcatcctgatcgagcacaaggggaccatcatcggcaagcagaacgacacctgcaccgccaaggcctcctgctggctggagagcgtgaagtccttcttctacgggctcaagaacatgctgggcagcgtgttcggcaacttcttcgtcgggatcctgctcttcctggccccgttcgtgctgctcgtgctgttcttcatcttcggctggaagatcctgttctgcttcaagtgctgccggcgcacgcgggggctcttcaagtaccgccacctgaaggacgacgaggagaccggctaccggaagatcatcgagcgcctgaactccaagaaggggaagaaccggctcctggacggcgagcgcctggccgaccggaagatcgcggagctcttcagcaccaagacccacatcggc

SEQ ID NO: 12292 - RNA, 2916 nt, synthetic construct
  misc_feature 1..2916: note = derived and/or modified CDS sequence (opt1) from CCHFV(Ast133, Artificial)__KX056060.1__Gn-4aa-Gc
  source 1..2916: mol_type = other RNA
agcgaggagcccgacgacgactgcatctcccgcacccagctgctcaagaccgagacggccgagatccacgacgacaactacggcgggccgggcgacaagatcaccatctgcaacgggagcaccatcgtggaccagcggctgggctccgagctggggtgctacaccatcaaccgcgtcaagagcttcaagctctgcgagaactccgccacgggcaagacctgcgagatcgacagcacccccgtgaagtgccggcagggcttctgcctgaagatcacccaggaggggcgcggccacgtgaagctgtcccgggggagcgaggtcgtgctcgacgcgtgcgactccagctgcgagatcatgatccccaagggcacgggggacatcctggtggactgctccggcggccagcagcacttcctgaaggacaacctcatcgacctggggtgcccccacatcccgctgctcggcaagatggccatctacatctgccgcatgagcaaccacccccggaccaccatggccttcctgttctggttctccttcgggtacgtcatcacgtgcatcttctgcaaggccctgttctacctcctgatcatcatcggcaccctgggcaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacgggctcgcccgccacgtgacccagtgccccaagcggaaggagaaggtcgaggagaccgagctgtacctgaacctcgagcgcatcccctggatcgtgcggaagctgctccaggtgtccgagagcaccggcgtcgcgctcaagcgctccagctggctgatcgtgctgctcgtgctgctgacggtcagcctctcccccgtgcagagcgccccggtggggcggaagcccctgttctccgacagcatcgtcaagggcatgaagaacctgctcaactccaccagcctggagacctccctgagcatcgaggccccctggggcgccatcaacgtgcagtccaccttcaagcccacggtgagcaccgccaacatcgcgctctcctggagctccgtcgagcaccgcgggaacaagatcctggtgaccggccggagcgagtccatcatgaagctggaggagcgcaccggggtgagctgggacctcggcgtcgaggacgcctccgagagcaagctgctgacggtgtccatcatggacctcagccagatgtacagcccggtcttcgagtacctgtccggggaccgccaggtggaggagtggcccaaggcgacctgcaccggcgactgccccgagcggtgcgggtgcaccagctccacgtgcctgcacaaggagtggccccacagccggaactggcgctgcaacccgacctggtgctggggcgtgggcaccgggtgcacgtgctgcggcgtcgacgtgaaggacctcttcaccgaccacatgttcatcaagtggaaggtggagtacatcaagaccgaggccatcgtctgcgtggagctgacctcccaggagcgccagtgcagcctgatcgaggccgggacccggttcaacctgggccccgtgaccatcacgctctccgagccccgcaacatccagcagaagctgcccccggagatcatcaccctgcaccccaagatcgaggaggggttcttcgacctcatgcacgtccagaaggtgctgagcgcctccaccgtgtgcaagctgcagagctgcacccacggcatccccggcgacctccagatctaccacatcgggaacctgctgaagggcgaccgggtcaacgggcacctcatccacaagatcgagccccacttcaacacgtcctggatgagctgggacggctgcgacctggactactactgcaacatgggcgactggccgtcctgcacctacaccggggtgacccagcacaaccacgccgccttcgtgaacctgctcaacatcgagacggactacaccaagaccttccacttccacagcaagcgcgtcaccgcccacggcgacacgccccagctggacctgaaggcccggcccacctacggggcgggcgagatcaccgtgctcgtggaggtcgccgacatggagctgcacaccaagaaggtggagatctccgggctgaagttcgccagcctcacgtgcaccggctgctacgcctgctccagcggcatcagctgcaaggtgcgcatccacgtcgacgagccggacgagctgaccgtgcacgtgaagtccagcgaccccgacgtcgtggccgcgtccaccagcctgatggcccggaagctcgagttcgggacggactccaccttcaaggccttcagcgccatgcccaagacctccctgtgcttctacatcgtggagcgcgagtactgcaagagctgctccgaggacgacaccaagaagtgcgtcgacacgaagctggagcagccccagagcatcctcatcgagcacaagggcaccatcatcgggaagcagaacgacacgtgcaccgcgaaggcctcctgctggctggagagcgtgaagtccttcttctacggcctgaagaacatgctcgggagcgtgttcggctccttcttcgtcggcatcctgctgttcctcgccccgttcgtgctgctggtgctgttcttcatgttcgggtggaagatcctgttctgcttcaagtgctgccggcgcacccggggcctgttcaagtaccgccacctcaaggacgacgaggagaccgggtaccggcgcatcatcgagcggctgaacagcaagaagggcaagaaccgcctgctcgacggggagcggctggccgaccgcaagatcgccgagctgttctccagcaagacccacatcggc

SEQ ID NO: 12293 - RNA, 2916 nt, synthetic construct
  misc_feature 1..2916: note = derived and/or modified CDS sequence (opt1) from CCHFV(SK/2015/human, Artificial)__KX458183.1__Gn-4aa-Gc
  source 1..2916: mol_type = other RNA
agcgaggagtccggcgacgactgcatcagccgcacccggctcctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacgggcaagagctgcgagatcgactccatcccggtgcggtgccgccaggggtactgcctcaagatcacccaggaggggcggggccacgtgaagctgagccgcgggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaccatctgcccctactgcgccagccgcctgacgtccgacgggctggcccggcacgtcacccagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtcctcttcacggtgtccctgagccccgtgcagtccgcccccatcgggcgccggccgctgttcctcgacagcatcgtgcgcggcatgaagaacctgctgaactccaccagcctcgagacctccctgagcatcgaggccccctggggcgccatcaacgtgcagtccacctacaagcccacggtcagcaccgccaacatcgcgctgtcctggagctccgtggagcaccgggggaacaagatcctcgtgagcggccgctccgagagcatcatgaagctggaggagcgcaccggggtctcctgggacctgggcgtggaggacgccagcgagagcaagctcctgaccgtctccgtgatggacctgagccagatgtactcccccgtgttcgagtacctcagcggggaccggcaggtcgaggagtggccgaaggccacgtgcaccggcgactgccccgagcgctgcggctgcaccacctccacgtgcctgcacaaggagtggccccacagccggaactggcgctgcaaccccacctggtgctggggcgtggggaccgggtgcacgtgctgcggcctggacgtgaaggacctcttcaccgactacatgttcgtcaagtggaaggtggagtacatcaagaccgaggccatcgtgtgcgtcgagctgacctcccaggggcggcagtgcagcctgatcgaggccggcacccgcttcaacctgggctccgtgaccatcacgctcagcgagccgcggaacatccagcacaagctgccgcccgagatcatcaccctgcacccccgcatcgaggaggggttcttcgacctcatgcacgtgcagaaggtcctgtccgcgagcaccgtgtgcaagctgcagtcctgcacccacggcgtgcccggggacctccaggtctaccacatcggcaacctgctgaagggcgacaaggtgaacgggcacctcatccacaagatcgagccccacttcaacacgagctggatgtcctgggacggctgcgacctggactactactgcaacatgggggactggcccagctgcacctacaccggcgtgacccagcacaaccacgcctccttcgtcaacctgctcaacatcgagacggactacaccaagaacttccacttccacagcaagcgggtgaccgcccacggggacacgccccagctggacctgaaggcccgcccgacctacggcgccggcgagatcaccgtgctcgtcgaggtggcggacatggagctgcacaccaagaagatcgagatcagcgggctgaagttcgcctccctgacctgcacgggctgctacgcctgcagctccgggatcagctgcaaggtgcggatccacgtcgacgagcccgacgagctgaccgtgcacgtgaagtccgacgaccccgacgtcgtggccgccagctccagcctgatggcgcgcaagctcgagttcggcaccgactccaccttcaaggccttcagcgccatgccgaagacgtccctgtgcttctacatcgtggagcgggagtactgcaagagctgctccaaggaggacacccagaagtgcgtcaacaccaagctggagcagccccagagcatcctcatcgagcaccgcgggaccatcatcggcaagcagaacaacacgtgcatcgccaaggcgtcctgctggctggagagcgtgaagtccttcttctacggcctgaagaacatgctcagcgggatcttcggcaacctgttcctggggatcttcctcttcctggcccccttcatcctgctcatcctgttcttcatgttcggctggcggatcctgttctgcttcaagtgctgccgccggacccgcggcctcttcaagtaccggcacctgaaggacgacgaggagaccgggtaccgccgcatcatcgagcggctgaacaacaagaagggcaagaacaagctcctggacggggagcgcctggccgaccggcgcatcgccgagctgttctccaccaagacgcacatcggc

SEQ ID NO: 12294 - RNA, 2916 nt, synthetic construct
  misc_feature 1..2916: note = derived and/or modified CDS sequence (opt1) from CCHFV(YL16070, Artificial)__KY354081.1__Gn-4aa-Gc
  source 1..2916: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggctccgagctgggctgctacaccatcaaccgcgtcaagagctacaagctgtgcgagaactccgcgagcgggaagtcctgcgagatcgacagcatcccggtgaagtgcaagcagggcttctgcctcaagatcacccaggaggggcggggccacgtgaagctgtcccgcgggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccggatgtccaaccacccgaagaccaccatggccttcctgttctggttcagcttcggctacgtgatcacgtgcatcgtgtgccgcgtcctgttctacctcctgatcgccatcgggaccgtgggcaagaagctgaagcagtaccgggagctcaagccccagacctgcatcgtgtgcgagtccgtccccgtgaacgccatcgacgcggagatgcacgagctgaactgcagctacaacatctgcccctactgcgcctcccgcctgagcaccgacgggctcatccggcacgtgacgcagtgcccgaagcgccgggagaaggtcgaggagaccgagctgttcctgaacctcgagcgcatcccctggctggtgcggaagctgctccaggtgagcgagtccaccggcatggccctgaagcgcagctgctggatgatcaccctgctcatcctgctgctcgtctccatgagccccgtgcagtccgcccccgtggggcggaagccgctgttcctggacagcatcgcgaagggcatgaagtccctcctgaacagcacgtccctggagaccagcctctccatcgaggccccctggggcgccatcaacgtccagagcaccttcaagcccaccgtgtccgccgccaacatcgcgctgagctggtccagcgtcgagcaccgcgggaacaagatcctggtgtccggccggagcgagtccatcatgaagctcgaggagcgcacgggggtgagctggaacctgggcgtcgaggacgccagcgagtccaagaccctgaccgtgagcgtgatggacctctcccagatgtacagccccgtcttcgagtacctgtccggggaccgccaggtggaggagtggccgaaggcgacctgcacgggcgactgccccgagcggtgcggctgcaccagctccacgtgcctgcacaaggagtggccccacagccggaactggcgctgcaaccccacctggtgctggggcgtggggaccgggtgcacgtgctgcggcctcgacgtcaaggacttcttcaccgactacatgctggtgaagtggaaggtggagtacatcaagaccgaggccatcgtctgcgtggagctgacctcccaggagcgccagtgcagcctgatcgaggccgggacccggttcaacctcggcccggtgaccatcaccctgtccgagccccgcaacgtccagcagcggctgccgcccgagatcgtgacgctccaccccaagatcgaggagggcttcttcgacctgatgcacgtgcagaagatcctgagcgcctccaccgtctgcaagctccagagctgcacccacggggtgcccggcgacttccaggtgtaccacgtcgggaacctgctgcgcggcgacaaggtgaacggccactccatccacaagatcgagccccacttcaacaccagctggatgtcctgggacgggtgcgacctcgactacttctgcaacatgggcgactggcccagctgcacctacacgggggtgacccagcacaaccgggccgccttcatcaacatgctgaacatcgagaccgactacaccaagacgttccacttccacagcaagcgcgtcaccgcccacggcgacaccccgcagctggacctcaaggcccggcccgcgtacggggccggcgaggtgaccgtgctggtcgaggtggccgacctggagctccacacgaagaagctggaggtgtccggcctgaagatcgccagcctgacctgctccgggtgctacgcctgcagctccggcatcagctgcaaggtccgcatccacgtgaacgagcccgacgagttcaccgtgcacgtccggtccagcgacccggacgtggtggcggccgggtccagcctgatggcccgcaagatcgagttcggcgccgactccaccttcaaggcgttcagctccatgcccaaggacagcctgtgcttctacatcgtcgagaaggactactgctccagctgcacggacgacgacacccagaagtgcgtgaacaccaagctcgaccacccccagtccatcctgatcgagcacaaggggaccatcatcggcaagcagaacgacacgtgcagcaccaagacctcctgctggctcaagagcttcaagggcttcttctacgggctcaagaacatgctgagcggcatcttcgggaacgtgttcctgggcatcctcctgttcctggcccccttcgtcctcctgatcttcttcttcttcttcgggtggcggctcctcttctgcctgaagtgctgcaagaagaccaagggcctgctcaagtacaagcacctgaaggacaaggaggaggccggctacaagaagatcatcgagcgcctgaacgggaagaagggcaagtcccagctgttcgacggggagcggctggccaaccgcaagatcgccgagctgttcagcacgaagatccacatcggc

SEQ ID NO: 12295 - RNA, 2916 nt, synthetic construct
  misc_feature 1..2916: note = derived and/or modified CDS sequence (opt1) from CCHFV(Oman_812956, Artificial)__KY362518.1__Gn-4aa-Gc
  source 1..2916: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtgaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctgaagcggagcagctggctgatcgtgctgctcgtgctgctgaccgtctccctcagccccgtgcagtccgcccccatcggccgcaagccgctgttcttcgacagcatcgcgaaggggatgaagaacctgctcaactccacgagcctggagacctccctgagcatcgaggccccctggggcgccatcaacgtgcagtccaccttcaagcccaccgtcagcacggccaacatcgccctctcctggagctccgtggagcaccggggcaacaagatcctggtgagcgggcgctccgagagcatcatgaagctggaggagcggaccggcatctcctgggacctcggggtcgaggacgcgagcgagtccaagctgctgaccgtgagcgtcatggacctcagccagatgtactcccccgtgttcgagtacctgagcggcgaccgccaggtggaggagtggccgaaggcgacctgcacgggggactgccccgagcggtgcggctgcacctccagcacgtgcctgcacaaggagtggccccactcccgcaactggcggtgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcgccagtgctccctgatcgaggccggcacccgcttcaacctcgggccggtcaccatcaccctgagcgagccccggaacatccagcagaagctgccgcccgagatcgtgaccctccacccccgcatcgaggagggcttcttcgacctgatgcacgtgcagaaggtcctgtccgccagcacggtgtgcaagctccagtcctgcacccacggcgtgcccggggacctgcaggtctaccacatcggcaacctgctcaagggggacaaggtgaacggccacctgatccacaaggtggagccccacttcaacaccagctggatgtcctgggacggctgcgacctggactactactgcaacatgggggactggcccagctgcacctacacgggcgtcacccagcacaaccacgccgccttcgtgaacctcctgaacatcgagaccgactacaccaagaacttccacttccactccaagcgggtgacggcccacggggacaccccgcagctggacctcaaggcccgccccaactacggcgccggggagatcaccgtcctggtggaggtggcggacatggagctgcacaccaagaagatcgagatcagcggcctcaagttcgcctccctgacgtgcaccggctgctacgcctgcagcagcgggatctcctgcaaggtccggatccacgtggacgagcccgacgagctgaccgtgcacgtcaagagcgaggacccggacatcgtggccgcctccagctccctcatggcgcgcaagctggagttcggcaccgacagcacgttcaaggccttctccgccatgcccaagaccagcctgtgcttctacatcgtggagcgggagtactgcaagtcctgcagcaaggaggacacccagaagtgcgtcaacgccaagctcgagcgcccccagtccatcctgatcgagcacaaggggaccatcatcggcaagcagaacgacacgtgcaccgcgaaggccagctgctggctggagtccgtcaagagcttcttctacgggctcaagaacatgctgtccggcatcttcggcaacgtgttcatcgggatcttcctgttcctcgcccccttcatcctgctgatcctcttcttcatgttcggctggcggatcctgttctgcttcaagtgctgccgccggacccgcgggctgttcaagtaccggcacctcaaggacgacgaggagaccggctaccgcaagatcatcgagcggctgaacaacaagaaggggaagaacaagctgctcgacggcgagcgcctggccgaccggaagatcgccgagctgttcagcacgaagacccacatcggc

SEQ ID NO: 12296 - RNA, 2916 nt, synthetic construct
  misc_feature 1..2916: note = derived and/or modified CDS sequence (opt1) from CCHFV(UCCR4405, Artificial)__KY484029.1__Gn-4aa-Gc
  source 1..2916: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacctgcatcttctgcaaggccctgttctacagcctcatcatcatcggcacgctggggaagaagatcaagcagtaccgcgagctgaagccccagacctgcaccatctgcgagaccgcccccgtgaacgcgatcgacgccgagatgcacgacctcaagtgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggccggaagcccctcttcctggacagcaccgtgaaggggatgaagaacctgctcaactccaccagcctggagacctccctgagcatcgaggccccctggggcgccatcaacgtgcagtccacgttcaagcccaccgtcagcaccgccaacatcgcgctctcctggagctccgtggagcaccgcggcaacaagatcctggtgaccgggcggagcgagtccatcatgaagctggaggagcgcacgggcgtcagctgggacctcggggtggaggacgcctccgagagcaagctgctgaccgtctccatcatggacctcagccagatgtacagcccggtgttcgagtacctgtccggcgaccggcaggtggaggagtggcccaaggccacctgcaccggggactgccccgagcgctgcggctgcacgagctccacctgcctgcacaaggagtggccccacagccggaactggcgctgcaacccgacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgacctcccaggagcgccagtgcagcctgatcgaggccggcacccggttcaacctggggcccgtgacgatcaccctctccgagccccgcaacatccagcagaagctgcccccggagatcatcaccctgcaccccaagatcgaggagggcttcttcgacctcatgcacgtgcagaaggtcctgagcgcgtccaccgtgtgcaagctgcagagctgcacgcacggcatccccggggacctccagatctaccacatcggcaacctgctgaagggggaccgggtgaacggccacctcatccacaagatcgagccccacttcaacacctcctggatgagctgggacggctgcgacctggactactactgcaacatggggaactggccgtcctgcacctacaccggcgtcacgcagcacaaccacgccgccttcgtgaacctgctcaacatcgagaccgactacaccaagaccttccacttccacagcaagcgcgtgacggcccacggggacaccccccagctggacctgaaggcccggcccacctacggcgcgggggagatcaccgtcctcgtggaggtggccgacatggagctgcacacgaagaaggtcgagatctccggcctgaagttcgccagcctcgtgtgcaccggctgctacgcctgctccagcgggatcagctgcaaggtgcgcatccacgtcgacgagccggacgagctgaccgtgcacgtgaagtccagcgaccccgacgtcgtggccgcgtccaccagcctgatggcccggaagctcgagttcggcacggactccatcttcaaggccttcagcgccatgcccaagacctccctgtgcttctacatcgtggagcgcgagtactgcaagagctgctccgaggacgacaccaagaagtgcgtcgacaccaagctggagcagccccagagcatcctcatcgagcacaaggggacgatcatcggcaagcagaacgacacctgcaccgcgaaggcctcctgctggctggagagcgtgaagtccttcttctacgggctgaagaacatgctcggcagcgtgttcggcaacttcttcgtcgggatcctgctgttcctcgccccgttcgtgctgctggtgctcttcttcatgttcggctggaagatcctgttctgcttcaagtgctgccggcgcacccgggggctgttcaagtaccgccacctcaaggacgacgaggagacgggctaccggcgcatcatcgagcggctgaactccaagaaggggaagaaccgcctgctcgacggcgagcggctggccgaccgcaagatcgccgagctgttcagcaccaagacccacatcggc

SEQ ID NO: 12297 - RNA, 2916 nt, synthetic construct
  misc_feature 1..2916: note = derived and/or modified CDS sequence (opt1) from CCHFV(UCCR4401, Artificial)__KY484035.1__Gn-4aa-Gc
  source 1..2916: mol_type = other RNA
agcgaggagccctccgacgactgcatcagccgcacccagctcctccggaccgagacggccgagatccacggcgacaactacgggggcccgggggacaagatcaccatctgcaacggctccaccatcgtggaccagcgcctggggagcgagctgggctgctacaccatcaaccgggtccgctccttcaagctctgcgagaacagcgccacgggcaagaactgcgagatcgactccgtgcccgtgaagtgccggcaggggtactgcctgcgcatcacccaggagggccgggggcacgtcaagctgagccgcggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtgggcaccctggggaagcgcctcaagcagtaccgggagctgaagccccagacctgcaccatctgcgagaccacccccgtcaacgccatcgacgcggagatgcacgacctgaactgcagctacaacatctgcccgtactgcgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgagagcaccggggtcgccctgaagcggtccagctggctgatcgtgctcctggtgctgttcaccgtcagcctctcccccgtgcagagcgcgccgatcggccgcaagcccctgttcctggactccacggccaaggggatgaagaacctcctgaacagcacctccctggagaccagcctctccatcgaggccccctggggcgccatcaacgtgcagagcacctacaagcccacggtctccaccgccaacatcgcgctgagctggtccagcgtggagcaccggggcaacaagatcctggtgtccgggcgcagcgagtccatcatgaagctcgaggagcggaccggcatcagctgggacctgggggtcgaggacgcctccgagagcaagctgctcaccgtgtccgtcatggacctgagccagatgtacagcccggtgttcgagtacctgtccggcgaccgccaggtggaggagtggcccaaggccacgtgcaccggggactgccccgagcgctgcggctgcaccagctccacgtgcctccacaaggagtggccccacagccggaactggcgctgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctgacctcccaggagcggcagtgcagcctcatcgaggccggcacccgcttcaacctggggcccgtcaccatcaccctgtccgagccccggaacatccagcagaagctgcccccggagatcatcacgctgcacccccgcatcgaggagggcttcttcgacctgatgcacgtgcagaaggtgctcagcgcgtccaccgtctgcaagctgcagagctgcacccacggcgtgcccggggacctccaggtgtaccacatcggcaacctcctgaagggggacaaggtcaacggccacctgatccacaagatcgagccccacttcaacacctcctggatgagctgggacggctgcgacctcgactactactgcaacatgggggactggccgtcctgcacgtacaccggcgtgacccagcacaaccacgccagcttcgtgaacctgctgaacatcgagaccgactacacgaagaacttccacttccactccaagcgggtcaccgcccacggggacacgccccagctcgacctgaaggcccgccccacctacggcgccggggagatcaccgtgctggtggaggtcgcggacatggagctccacaccaagaagatcgagatcagcggcctgaagttcgcctccctggcctgcaccggctgctacgcctgcagcagcgggatctcctgcaaggtgcggatccacgtggacgagccggacgagctcaccgtccacgtcaagagcgacgaccccgacgtggtggccgcgtccagctccctgatggcccgcaagctggagttcggcacggacagcaccttcaaggccttctccgccatgcccaagaccagcctctgcttctacatcgtggagcgggagcactgcaagtcctgcagcgaggaggacaccaagaagtgcgtgaacacgaagctggagcagccccagtccatcctgatcgagcacaaggggaccatcatcggcaagcagaacagcacgtgcaccgcgaaggcctcctgctggctcgagagcgtcaagtccttcttctacgggctgaagaacatgctgagcggcatcttcggcaacgtgttcatggggatcttcctcttcctggccccgttcatcctgctcatcctgttcttcatgttcggctggcgcatcctgttctgcttcaagtgctgccggcgcacccggggcctcttcaagtaccgccacctgaaggacgacgaggagaccgggtaccggcgcatcatcgagaagctgaacaacaagaaggggaagaacaagctcctggacggcgagcggctggccgaccgccgcatcgccgagctgttctccaccaagacccacatcggc

SEQ ID NO: 12298 - RNA, 2916 nt, synthetic construct
  misc_feature 1..2916: note = derived and/or modified CDS sequence (opt1) from CCHFV(UCCR4448, Artificial)__KY484042.1__Gn-4aa-Gc
  source 1..2916: mol_type = other RNA
agcgaggagacctccgacgactgcatcagccgcacccagctgctccggacggagaccgccgagatccacggcgacaactacgggggccccggggacaagatcaccatctgcaacggctccaccatcgtggaccagcgcctggggagcgagctgggctgctacacgatcaaccgggtcaagtccttcaagctctgcgagaacagcgccaccggcaagtcctgcgagatcgacagcgtgccggtgaagtgccgccaggggtactgcctgcggatcacccaggagggccgcgggcacgtcaagctgtcccggggcagcgaggtggtgctcgacgcgtgcgacacctcctgcgagatcatgatccccaaggggacgggcgacatcctggtcgactgcagcggcgggcagcagcacttcctgaaggacaacctcatcgacctgggctgccccaagatccccctgctcgggaagatggccatctacatctgccgcatgtccaaccacccgaagaccaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacgcccgtgaacgccatcgacgcggagatgcacgacctgaactgctcctacaacatctgcccctactgcgccagccggctgacctccgacggcctcgcccgccacgtcacccagtgcccgaagcggaaggagaaggtggaggagaccgagctgtacctgaacctcgagcgcatcccctgggtggtccggaagctgctccaggtgagcgagtccacgggggtggccctgaagcgcagcagctggctgatcgtcctgctcgtgctgttcaccatctccctgagccccgtgcagtccgcgcccatcagccggaagcccctcttcctggactccatcgtcaagggcatgaagaacctgctcaacagcacctccctggagaccagcctgtccatcgaggccccctggggcgccatcaacgtgcagagcacgtacaagcccaccgtgtccaccgccaacatcgccctcagctggtccagcgtcgagcaccgcgggaacaagatcctggtgtccggccggagcgagtccatcatgaagctggaggagaagaccgggatcagctgggacctcggcgtggaggacgcgtccgagagcaagctgctgacggtcagcgtgatggacctctcccagatgtacagccccgtcttcgagtacctgtccggggaccgccaggtggaggagtggccgaaggcgacctgcaccggcgactgccccgagcggtgcgggtgcaccagctccacgtgcctgcacaaggagtggccccacagccgcaactggcgctgcaaccccacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgacctcccaggagcggcagtgcagcctgatcgaggccgggacccgcttcaacctcggcccggtgaccatcacgctgtccgagccccggaacatccagcagaagctgccgcccgagatcatcaccctccacccgcgcatcgaggaggggttcttcgacctgatgcacgtccagaaggtgctgagcgcctccaccgtgtgcaagctccagagctgcacccacggcgtccccggcgacctccaggtgtaccacatcgggaacctgctgaagggcgacaaggtgaacgggcacctgatccacaagatcgagccccacttcaacacgtcctggatgagctgggacggctgcgacctggactactactgcaacatgggcgactggccctcctgcacctacaccggggtcacccagcacaaccacgccagcttcgtgaacctcctgaacatcgagacggactacaccaagaacttccacttccactccaagcgggtgaccgcccacggcgacaccccgcagctggacctcaaggcccgccccacgtacggggccggcgagatcaccgtcctggtggaggtggccgacatggagctgcacaccaagaagatcgagatcagcgggctcaagttcgcgagcctgacctgcacgggctgctacgcctgctccagcggcatctcctgcaaggtccggatccacgtggacgagcccgacgagctgaccgtgcacgtcaagagcgacgacccggacgtggtggccgcctccagctccctcatggcccgcaagctggagttcgggaccgacagcaccttcaaggcgttctccgccatgcccaagacgagcctgtgcttctacatcgtcgagcgggagcactgcaagtcctgcagcgaggaggacaccaagaagtgcgtgaacaccaagctcgagcagccccagtccatcctgatcgagcacaagggcaccatcatcgggaagcagaacagcacgtgcaccgccaaggcctcctgctggctggagagcgtgaagtccttcttctacggcctcaagaacatgctgagcgggatcttcggcaacgtcttcatcggcatcttcctgttcctcgcgcccttcatcctgctgatcctcttcttcatgttcgggtggaagatcctgttctgcttcaagtgctgccgccggacccgcggcctgttcaagtaccggcacctcaaggacgacgaggagaccgggtaccgccggatcatcgagcgcctgaacaacaagaagggcaagaacaagctgctcgacggggagatcctggccgaccggcgcatcgccgagctgttctccacgaagacccacatcggc

SEQ ID NO: 12299 - RNA, 2916 nt, synthetic construct
  misc_feature 1..2916: note = derived and/or modified CDS sequence (opt1) from CCHFV(SPU 45/88, Artificial)__KJ682809.1__Gn-4aa-Gc
  source 1..2916: mol_type = other RNA
agcgaggagtccagcgacgactgcctgtcccgcacccagctcctgcggaccgagaacacggagatccacagcgacaactacggcgggcccggcgacaagatcaccatctgcaacgggtccaccatcgtggaccagcgcctgggcagcgagctcgggtgctacaccatcaaccgggtcaagtccttcaagctgtgcgagaacagcgccacgggcaagtcctgcgagatcgacagcaccccggtgcgctgccggcagggcttctgcctgaagatcacccaggaggggcgcggccacgtgaagctctcccgggggagcgaggtcgtgctggacgcctgcgactccagctgcgagatcatgatccccaagggcaccggggacatcctggtggactgctccggcggccagcagcacttcctcaaggacaacctggtcgacctggggtgccccaacatccccctcctgggcaagatggcgatctacatctgccgcatgagcaaccacccgaagacgaccatggggttcctgttctggttctccttcggctacgtgatcacctgcatcctctgcaaggtgatcttctacctgctgatcgtcgtgggcaccctcgggaagaagttcaagcagtaccgggagctgaagccccagacgtgcaccatctgcgagaccacccccgtgaacgccatcgacgccgagatgcacgacctgaactgcagctacaacatctgcccctactgcgcctcccgcctcacgagcgacggcctggcccggcacgtcatgcagtgcccgaagcgcaaggagaagatcgaggagaccgagctgtacctcaacctggagcggatcccctggatcgtgcgcaagctgctccaggtgagcgagtccaccggggtcgcgctgaagcggagctcctggctggtggtgctcctggtcctgctcaccgtgagcctgtcccccgtgcagagcgcccccatcggccgcaagccgctgttcctcgactccatcgtcaaggggaagaagaacctgctgaacagcacgtccctcgagaccagcctgtccatcgaggccccctggggcgccatcaacgtgcagagcaccttcaagcccaccgtgtccgcggccaacatcgccctgagctggtccagcgtcgagcaccggggcaacaagatcctcgtgtccgggcgcagcgagtccatcatgaagctggaggagcggacgggcatcagctgggacctgggggtcgaggacgccagcgagtccaagctcctgaccgtgagcgtgatggacctgtcccagatgtacagccccgtcttcgagtacctctccggcgaccgccaggtggaggagtggccgaaggccacctgcaccggggactgccccgagcggtgcggctgcacgagctccacctgcctgcacaaggagtggccccacagccgcaactggcgctgcaaccccacctggtgctggggcgtggggaccggctgcacgtgctgcgggctggacgtcaaggacctgttcaccgactacatgttcgtgaagtggaaggtggactacatcaagaccgaggcgatcgtctgcgtggagctcacctcccaggagcggcagtgcagcctgatcgaggccggcacgcgcttcaacctggggccggtgaccatcaccctctccgagccccggaacatccagcagaagctgccccccgagatcgtcaccctgcacccgcgcatcgaggagggcttcttcgacctcatgcacgtgcagaacgtgctgagcgcctccaccgtctgcaagctgcagagctgcacgcacggcgtgcccggggacctccagatctaccacatcggcaacctgctgaagggggacaaggtgaacggccacctcatccacaagatcgagccccacttcaacacctcctggatgagctgggacggctgcgacctggactactactgcaacatgggggactggccctcctgcagctacaccggcgtcacccagcacaaccacgccgccttcgtgaacatgctgaacatcgagacggactacaccaagaacttccacttccacagcaagcgggtgaccgcgcacggggacaccccgcagctcgacctgaaggcccgccccacgtacggcgccggggagatcaccgtcctggtggaggtggccgacatggagctccacaccaagaagatcgagatctccggcctgaagttcgccagcctgacctgcacgggctgctacgcgtgctccagcgggatctcctgcaaggtccggatccacgtggacgagcccgacgagctcaccgtgcacgtcaagagcgaggacccggacatcgtggccgcctccagctccctgatggcccgcaagctggagttcggcaccgacagcaccttcaaggccttctccgcgatgcccaagacgagcctctgcttctacatcgtggagcgggagtactgcaagtcctgcagcaaggaggacacccagaagtgcgtcaacaccaagctggagcagccccagtccatcctgatcgagcacaaggggaccatcatcggcaagcagaacgacacgtgcaccgccaaggccagctgctggctcgagtccgtgaagagcttcttctacgggctgaagaacatgctgtccggcatcttcggcaacgtgttcatcgggatcctcctgttcctggcccccttcatcatgctcatcctgttcttcatgttcggctggcgcatcctgttctgcttcaagtgctgccggcgcacccgggggctcttcaagtaccgccacctgaaggacgacgaggagatcggctaccggaagatcatcgagcgcctgaacaacaagaaggggaagaacaagctcctggacggcgagcggctggcggaccgcaagatcgccgagctcttcagcaccaagacgcacatcggc

SEQ ID NO: 12300 - RNA, 2916 nt, synthetic construct
  misc_feature 1..2916: note = derived and/or modified CDS sequence (opt1) from CCHFV(3010, Artificial)__DQ019222.1__Gn-4aa-Gc
  source 1..2916: mol_type = other RNA
gccgagggcgtgagcaacgactgcgtgtcccgcacccagctcatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcatcgtgtgcaaggtgctgttctacctcctgatcgtcatcggcaccctgagcaagaagctcaagcagtaccgcgagctgaagccccagacctgcatcgtgtgcgagtccacccccgtgaacgccatcgacgccgagatgcacgagctgaactgcaactacaacatctgcccctactgcgcgagccggctcacctccgacgggctggtccgccacgtgaaccagtgcccgaagcggaaggagaaggtggaggagacggagctgtacctcaacctggagcgcatcccctggctggtccggcgcctcctccaggtgagcgagtccaccggcatggccctgaagcggagctgctggatgaccaccctcctgatcctgctcgtggtctccctgagccccgtgcagagcgcccccgtcgggcgccggccgctgttcctcgactccatcgtgaagggcatgaagaacctgctgaacagcacgtccctcgagaccagcctgtccatcgaggccccctggggcgcgatcaacgtgcagagcacctacaagcccaccgtctccacggccaacatcgccctgagctggtccagcgtggagcaccgcgggaacaaggtgctcgtctccggccggagcgagtccatcatgaagctggaggagcgcaccgggatcagctgggacctgggcgtggaggacgcctccgagagcaagctcctgaccgtgtccgtcatggacctgagccagatgtactcccccgtgttcgagtacctcagcggggaccgccaggtggaggagtggccgaaggcgacctgcacgggcgactgccccgagcggtgcgggtgcaccagctccacgtgcctgcacaaggagtggccccacagccggaactggcgctgcaaccccacctggtgctggggcgtcggcaccgggtgcacgtgctgcggcctggacgtgaaggacctgttcaccgactacatgttcgtgaagtggaaggtcgagtacatcaagaccgaggccatcgtgtgcgtggagctcacctcccaggagcgccagtgcagcctgatcgaggccgggacccggttcaacctgggctccgtcaccatcaccctcagcgagccgcgcaacatccagcagaagctgccgcccgagatcatcaccctgcaccccaagatcgaggaggggttcttcgacctcatgcacgtgcagaaggtgctgtccgccagcacggtctgcaagctgcagtcctgcacccacggcgtgcccggcgacctccaggtgtaccacatcgggaacctgctgaagggcgaccgggtcaacgggcacctcatccacaagatcgagcagcacttcaacaccagctggatgtcctgggacggctgcgacctggactactactgcaacatgggcgactggcccagctgcacctacacgggggtgacccagcacaaccacgcctccttcgtgaacctgctcaacatcgagaccgactacaccaagacgttccacttccacagcaagcgcgtcaccgcccacggcgacacgccccagctggacctgaaggcgcggcccacctacggggccggcgaggtgaccgtgctcgtcgaggtggccgacatggagctgcacaccaagaagatcgagatctccgggctgaagttcgccggcctgacctgcaccggctgctacgcctgcagctccgggatcagctgcaaggtgcgcatccacgtcgacgagccggacgagctgacggtgcacgtcaagagcgacgaccccgacgtggtggcggcctccagctccctgatggcccggaagctcgagttcggcaccgacagcaccttcaaggccttctccgccatgcccaagaccagcctgtgcttctacatcgtggagcgcgagtactgcaagtcctgcagcaaggaggacacgcagaagtgcgtcaacaccaagctggagcagccgcagtccatcctcatcgagcacaaggggaccatcatcggcaagcagaacaacacgtgcaccgcgaaggccagctgctggctggagtccgtcaagagcttcttctacgggctgaagaacatgctcggcggcatcttcgggaacgtgttcatcggcatcttcaccttcctgacccccttcatcctgctcatcctgttcttcatgttcgggtggcggatcctgttctgcttcaagtgctgccgccggacccgcggcctcttcaagtaccggcacctgaaggacgacgaggagacggggtaccgcaagatcatcgagcggctgaacaacaagaagggcaagaaccgcctcctggacggcgagcggctggccgaccgcaagatcgccgagctgttctccaccaagacccacatcggg

SEQ ID NO: 12301 - RNA, 972 nt, synthetic construct
  misc_feature 1..972: note = derived and/or modified CDS sequence (opt1) from CCHFV(10200)__U39455.2__Gn
  source 1..972: mol_type = other RNA
agcgaggagccctccgacgactgcgtgagccgcacccagctgctccggaccgagacggccgagatccacggcgacaactacgggggcccgggggacaagatcaccatctgcaacggctccaccatcgtcgaccagcgcctggggagcgagctgggctgctacaccatcaaccgggtgcgctccttcaagctctgcgagaacagcgccacgggcaagaactgcgagatcgactccgtgcccgtcaagtgccggcaggggtactgcctgcgcatcacccaggagggccgggggcacgtgaagctgagccgcggctccgaggtggtcctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtcggcaccctggggcgccggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggc

SEQ ID NO: 12302 - RNA, 972 nt, synthetic construct
  misc_feature 1..972: note = derived and/or modified CDS sequence (opt1) from CCHFV(IbAr10200)__AF467768.2__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtccgctccttcaagctctgcgagaacagcgccacgggcaagaactgcgagatcgactccgtgcccgtgaagtgccggcaggggtactgcctgcgcatcacccaggagggccgggggcacgtcaagctgagccgcggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccggatgagcaaccaccccaagacgaccatggccttcctgttctggttctccttcggctacgtgatcacgtgcatcctgtgcaaggccatcttctacctcctgatcatcgtgggcaccctggggaagcgcctcaagcagtaccgggagctgaagccccagacctgcaccatctgcgagaccacccccgtcaacgccatcgacgcggagatgcacgacctgaactgcagctacaacatctgcccgtactgcgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgagagcaccggggtcgccctgaagcggtccagctggctgatcgtgctcctggtgctgttcaccgtcagcctctcccccgtgcagagcgcgccgatcggc

SEQ ID NO: 12303 - RNA, 972 nt, synthetic construct
  misc_feature 1..972: note = derived and/or modified CDS sequence (opt1) from CCHFV(Turkey-Kelkit06)__GQ337054.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcaagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggcggatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtcaacgcgatcgacgccgagatgcacgacctcaactgctcctacaacatctgcccgtactgcgccagccggctgacgtccgacggcctggcccgccacgtgacccagtgccccaagcggaaggagaaggtggaggagaccgagctctacctgaacctggagcgcatcccctggatcgtccggaagctcctccaggtgagcgagtccaccggggtggcgctgaagcgcagcagctggctgatcgtcctgctggtgctcctgacggtgtccctgagccccgtccagtccgccccggtgggc

SEQ ID NO: 12304 - RNA, 972 nt, synthetic construct
  misc_feature 1..972: note = derived and/or modified CDS sequence (opt1) from CCHFV(SR3)__AJ538199.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcggg

SEQ ID NO: 12305 - RNA, 972 nt, synthetic construct
  misc_feature 1..972: note = derived and/or modified CDS sequence (opt1) from CCHFV(UCCR4413)__KY484038.1__Gn
  source 1..972: mol_type = other RNA
agcgagtccagcgcctccggctgcatcagccgcacccagatgatcaagtccgagaccgccgagatccacgacgacatctacgggggccccggggagaagctgacgatctgcaacggcaccaccgtggtcgaccagcggctcgggagcgagctgggctgctacaccatcaaccgcatcaagacgtacaagctgtgcgagaactccgtgaaggagaagacctgcgagatcgacagcgtgccggtcaagtgccggcagggcctctgcctgaagatcacccaggaggggcgcggccacgtgaagctgtcccgggggagcgagatcgtgctcgacatctgcgactccagctgcgagctgatgatccccaagggcaccggggacatcctggtcgactgctccggcggccagcagcacttcctccaggacaacctggtggacctggggtgccccaacatccccctcctgggcaaggtggcgatctacatctgccgcatgagcaaccacccgaagacgaccatggccttcctgttctggttctccttcgggtacgtcatcacgtgcatcctctgcaagatcctgttctacctgctcatcatcaccggcaccctgggcaagaagctgaagcagtaccgggagctcaagccccagacctgcaccatctgcgagagcacccccgtgaacgccatcgacgccgagatgcacgacctgaactgctcctacaacatctgcccctactgcgccagccgcctgacgtccgacgggctcatccggcacgtgaacctgtgcccgaagcgcaaggagaaggtcgaggagaccgagctgtacctcaacctggagcggatcccctggttcgtgcgcaagctgctccaggtgagcgagagcaccggcgtcgcgctgaagcggtccagctggctgctcatcctggtgatcctgctcaccgtgtccatgagccccgtccagtccgcccccatcaac

SEQ ID NO: 12306 - RNA, 972 nt, synthetic construct
  misc_feature 1..972: note = derived and/or modified CDS sequence (opt1) from CCHFV(66019)__AB069669.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtcgaccagcgcctgggcagcgagctgggctgctacaccatcaaccgggtgaagtccttcaagctctgcgagaacagcgggacgggcaagtcctgcaagatcgacaacaccccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagacgaccatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccacgaacgccatcgacgccgagatgcacgacctcaagtgctcctacaacatctgcccctactgcgccagccggctgacctccgacggcctggcgcgccacgtgacccagtgcccgaagcggaaggagaaggtcgaggagaccgagctctacctgaacctggagcgcatcccctggatcgtgcggaagctcctccaggtgagcgagtccacgggggtcgccctgaagcgcagcagctggctgatcgtgctgctggtgctcctgaccgtctccctgagccccgtgcagtccgcccccatcggc

SEQ ID NO: 12307 - RNA, 972 nt, synthetic construct
  misc_feature 1..972: note = derived and/or modified CDS sequence (opt1) from CCHFV(7001)__AB069670.1__Gn
  source 1..972: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggctccgagctgggctgctacaccatcaaccgcgtgcggagctacaagctgtgcgagaactccgcgagcgggaagtcctgcgagatcgacagcatcccggtcaagtgcaagcagggcttctgcctcaagatcacccaggaggggcgcggccacgtgaagctgtcccgggggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccgcatgtccaaccacccgaagaccaccatggccttcctgttctggttcagcttcggctacgtgatcacgtgcatcgcctgccgggtgctgttctacctcctgatcgccatcgggaccgtcggcaagaagctgaagcagtaccgcgagctcaagccccagacctgcatcgtgtgcgagtccgtgcccgtcaacgcgatcgacgccgagatgcacgagctgaactgcagctacaacatctgcccctactgcgcctcccggctgagcaccgacgggctcatccgccacgtgacgcagtgcccgaagcggcgcgagaaggtggaggagaccgagctgttcctgaacctcgagcggatcccctggctggtccgcaagctgctccaggtgagcgagtccaccggcatggccctgaagcggagctgctggatgatcaccctgctcatcctgctgctcgtgtccatcagccccgtccagtccgcgcccgtgggg

SEQ ID NO: 12308 - RNA, 972 nt, synthetic construct
  misc_feature 1..972: note = derived and/or modified CDS sequence (opt1) from CCHFV(75024)__AB069671.1__Gn
  source 1..972: mol_type = other RNA
agcgaggagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagatgggctgctacaccatcaaccgggtcaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcgtgctggacgcgtgcgactccagctgcgaggtgatgatccccaagggcaccggcgacatcctcgtcgactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaacatctgcccctactgcgccagccgcctgacctccgacgggctggcccggcacgtcacgcagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtgctgttcgccatctccctgagccccgtgcagtccgcccccatcggg

SEQ ID NO: 12309 - RNA, 972 nt, synthetic construct
  misc_feature 1..972: note = derived and/or modified CDS sequence (opt1) from CCHFV(7803)__AB069672.1__Gn
  source 1..972: mol_type = other RNA
agcgaggagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagatgggctgctacaccatcaaccgggtcaagtccttcaagctgtgcgagaacagcgccacggggaagtcctgcgagatcgacagcatcccggtgaagtgccgccagggctactgcctcaagatcacccaggaggggcggggccacgtgaagctgtcccgcgggagcgaggtcatcctggacgcgtgcgactccagctgcgaggtgatgatccccaagggcaccggcgacatcctcgtggactgctccgggggccagcagcacttcctgaaggacaacctgatcgacctcgggtgccccagcatccccctgctgggcaagatggccatctacatctgccggatgtccaaccacccgaagaccacgatggccttcctcttctggttcagcttcggctacgtcatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaacatctgcccctactgcgccagccgcctgacctccgacgggctggcccggcacgtgacgcagtgcccgaagcgcaaggagaaggtcgaggagaccgagctctacctgaacctggagcggatcccctgggtggtgcgcaagctcctgcaggtcagcgagagcaccggcgtggcgctgaagcggtccagctggctcatcgtgctgctggtcctcttcgccatctccctgagccccgtgcagtccgcccccatcagc

SEQ ID NO: 12310 - RNA, 972 nt, synthetic construct
  misc_feature 1..972: note = derived and/or modified CDS sequence (opt1) from CCHFV(79121)__AB069673.1__Gn
  source 1..972: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagggcctcggctccgagctggggtgctacaccatcaaccgggtgcgcagctacaagctgtgcgagaactccgcgagcggcaagtcctgcgagatcgacagcatcccggtcaagtgcaagcaggggttctgcctcaagatcacccaggagggccgggggcacgtgaagctgtcccgcggcacggagatcgtgctggacgtctgcgacagctcctgcgagctcatgatccccaagggcaccggggacatcctggtggactgcagcggcgggcagcagcacttcctgcagaacaacctcatcgacctgggctgccccaacgtgcccctgctcggcaagatggccatctacgtctgccggatgtccaaccacccgaagaccaccatggccttcctgttctggttcagcttcgggtacgtgatcacgtgcatcgcctgccgcgtgctgttctacctcctgatcgccatcggcaccgtcgggaagaagctgaagcagtaccgggagctcaagccccagacctgcatcgtgtgcgagtccgtgcccgtcaacgcgatcgacgccgagatgcacgagctgaactgcagctacaacatctgcccctactgcgcctcccgcctgagcaccgacggcctcatccggcacgtgacgcagtgcccgaagcgccgggagaaggtggaggagaccgagctgttcctgaacctcgagcgcatcccctggctggtccggaagctgctccaggtgagcgagtccaccgggatggccctgaagcgcagctgctggatgatcaccctgctcatcctgctgctcgtgtccatcagccccgtccagtccgcgcccgtgggc

SEQ ID NO: 12311 - RNA, 972 nt, synthetic construct
  misc_feature 1..972: note = derived and/or modified CDS sequence (opt1) from CCHFV(8402)__AB069674.1__Gn
  source 1..972: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtggtgacctgcatcctgtgcaaggtcatcttctacctcctgatcgtggtgggcaccctggggaagaagttcaagcagtaccgcgagctcaagccccagacgtgcaccatctgcgagaccacccccgtcaacgccatcgacgccgagatgcacgacctgaactgcagctacaacatctgcccctactgcgcgtcccggctgacgagcgacggcctcgcccgccacgtgatgcagtgcccgaagcggaaggagaagatcgaggagaccgagctgtacctgaacctcgagcgcatcccctgggtggtccggaagctgctccaggtgtccgagagcaccggggtggccctgaagcgcagctcctggctggtcgtgctgctcgtgctgctgaccgtcagcctctcccccgtgcagagcgcccccatcggc

SEQ ID NO: 12312 - RNA, 972 nt, synthetic construct
  misc_feature 1..972: note = derived and/or modified CDS sequence (opt1) from CCHFV(88166)__AB069675.1__Gn
  source 1..972: mol_type = other RNA
agcgaggagtccggcgacgactgcatcagccgcacccagctgctccggaccgagacggccgagatccactccgacaactacgggggccccggggacaagatcaccatctgcaacggcagcaccgtggtcgaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggtcatcttctacctcctgatcgtggtggggaccctgggcaagaagttcaagcagtaccgcgagctcaagccccagacgtgcaccatctgcgagaccacccccgtcaacgccatcgacgccgagatgcacgacctgaactgctcctacaacatctgcccctactgcgccagccggctgacgtccgacgggctcgcgcgccacgtgatgcagtgcccgaagcggaaggagaagatcgaggagaccgagctgtacctgaacctcgagcgcatcccctgggtggtccggaagctgctccaggtgagcgagagcaccggcgtggccctgaagcgctccagctggctggtcgtgctgctcgtgctgctgaccgtctccctcagccccgtgcagtccgcccccatcggg

SEQ ID NO: 12313 - RNA, 972 nt, synthetic construct
  misc_feature 1..972: note = derived and/or modified CDS sequence (opt1) from CCHFV(BA88166)__AF338470.1__Gn
  source 1..972: mol_type = other RNA
agcgaggagtccggcgacgactgcatcagccgcacccagctgctccggaccgagacggccgagatccactccgacaactacgggggccccggggacaagatcaccatctgcaacggcagcaccgtggtcgaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgaggtggtgctcgacgcgtgcgacagctcctgcgagatcatgatccccaaggggaccggcgacatcctggtcgactgcagcggcgggcagcagcacttcctgaaggacaacctcatcgacctgggctgccccaacatccccctgctcgggaagatggccatctacatctgccggatgtccaaccacccgaagacgaccatgggcttcctgttctggttcagcttcggctacgtggtgacctgcatcctgtgcaaggggatcttctacctcctgatcgtcgtgggcaccctggggaagaagttcaagcagtaccgcgagctcaagccccagacgtgcaccatctgcgagaccacccccgtgaacgccatcgacgccgagatgcacgacctgaactgctcctacaacatctgcccctactgcgccagccggctgacgtccgacggcctcgcgcgccacgtcatgcagtgcccgaagcggaaggagaagatcgaggagaccgagctgtacctgaacctcgagcgcatcccctgggtggtgcggaagctgctgcaggtcagcgagagcaccggggtggccctcaagcgctccagctggctggtggtcctgctcgtgctgctgaccgtgtccctcagccccgtccagtccgcccccatcggc

SEQ ID NO: 12314 - RNA, 972 nt, synthetic construct
  misc_feature 1..972: note = derived and/or modified CDS sequence (opt1) from CCHFV(BA66019)__AF350448.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccatcgtcgaccagcgcctgggcagcgagctgggctgctacaccatcaaccgggtgaagtccttcaagctctgcgagaacagcgggacgggcaagtcctgcaagatcgacaagcacccggtgaagtgccgccaggggttctgcctgaagatcacccaggagggccgggggcacgtcaagctgagccgcggctccgaggtggtgctcgacgcctgcgacagctcctgcgagatcatgatccccaagggcaccggggacatcctggtcgactgcagcggcgggcagcagcacttcctgaaggacaacctcgtggacctgggctgccccaacatccccctgctcggcaagatggcgatctacatctgccggatgtccaaccacccgaagaccacgatggccttcctgttctggttcagcttcgggtacgtgatcacgtgcatcttctgcaagatcatcttctacctgctcatcgtcgtgggcaccctggggaagaagttcaagcagtaccgcgagctgaagccccagacctgcaccatctgcgagaccacccccaccaacgccatcgacgccgagatgcacgacctcaagtgctcctacaacatctgcccctactgcgccagccggctgacgtccgacggcctggcgcgccacgtgacccagtgcccgaagcggaaggagaaggtcgaggagaccgagctctacctgaacctggagcgcatcccctggatcgtgcggaagctcctccaggtgagcgagtccaccggggtcgccctgaagcgcagcagctggctgatcgtgctgctggtgctcctgacggtctccctgagccccgtgcagtccgcccccatcggc

SEQ ID NO: 12315 - RNA, 972 nt, synthetic construct
  misc_feature 1..972: note = derived and/or modified CDS sequence (opt1) from CCHFV(BA8402)__AF350449.1__Gn
  source 1..972: mol_type = other RNA
agcgaggagtccggcgacgactgcatcagccgcacccagctgctccggaccgagacggccgagatccacaacgacaactacgggggccccggggacaagatcaccatctgcaacggctccaccgtggtcgaccagcgcctggggagcgagctgggctgctacaccatcaaccgggtgaactccttcaacctctgcgagaacacggccaccggcaagagctgcgagatcgactccaccccggtgaagtgccgccaggggttctgcctgaagatcacccaggagggccgggggcacgtcaagctgagccgcggctccgaggtggtgctcgacgcgtgcgagagctcctgcgagatcatgatccccaaggggacgggcgacatcctggtcgactgcagcggcgggcagcagcacttcctgaaggacaacctcatcgacctgggctgccccaacatccccctgctcgggaagatggccatctacatctgccggatgtccaaccacccgaagaccaccatggccttcctgttctggttcagcttcggctacgtggtgacctgcatcctgtgcaaggtcatcttctacctcctgatcgtggtgggcacgctggggaagaagttcaagcagtaccgcgagctcaagccccagacctgcaccatctgcgagaccacgcccgtcaacgccatcgacgccgagatgcacgacctgaactgctcctacaacatctgcccctactgcgcgagccggccgacctccgacggcctggcccgccacgtgatgcagtgccccaagcggaaggagaagatcgaggagaccgccctctacctgaacctggagcgcatcccctgggtggtccggaagctcctccaggtgagcgagtccaccggggtggccctgaagcgcagcagctggctggtcgtgctgctggtgctcctgacggtctccctgagccccgtgcagtccgcgccgatcggc

SEQ ID NO: 12316 - RNA, 972 nt, synthetic construct
  misc_feature 1..972: note = derived and/or modified CDS sequence (opt1) from CCHFV(Matin)__AF467769.2__Gn
  source 1..972: mol_type = other RNA
agcgaggagtccggcgacgactgcatcagccgcacccagctgctccggaccgagacggccgagatccactccgacagctacgggggccccggggacaagatcaccatctgcaacggctccaccgtggtcgaccagcgcctggggagcgagctgggctgctacaccatcaaccgggtgaagtccttcaagctctgcgagaacagcgccacgggcaagtcctgcgagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggtgttcctgttctggttctccttcggctacgtgatcacgtgcatcctgtgcaaggtcatcttctacctcctgatcgtggtgggcaccctggggaagaagttcaagcagtaccgcgagctcaagccccagacctgcaccatctgcgagaccacccccgtcaacgccatcgacgccgagatgcacgacctgaactgcagctacaacatctgcccctactgcgcctcccggctgacgagcgacggcctcgcgcgccacgtgatgcagtgcccgaagcggaaggagaagatcgaggagaccgagctgtacctgaacctcgagcgcatcccctgggtggtccggaagctgctccaggtgagcgagtccaccggggtggccctgaagcgcagctcctggctggtcgtgctgctcgtgctgctgaccgtcagcctctcccccgtgcagagcgcccccatcggc

SEQ ID NO: 12317 - RNA, 972 nt, synthetic construct
  misc_feature 1..972: note = derived and/or modified CDS sequence (opt1) from CCHFV(Baghdad 12)__AJ538197.2__Gn
  source 1..972: mol_type = other RNA
agcgaggagtccggcgacgactgcatcagccgcacccggctgctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacgggcaagagctgcaagatcgactccatcccggtgaagtgccggcaggggtactgcctcaagatcacccaggaggggcgcggccacgtgaagctgagccgggggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccgcatgtccaaccacccgaagaccacgatggccttcctcttctggttcagcttcggctacgtgatcacgtgcatcctgtgcaaggccatcttctacctgctcatcatcgtggggaccctgggcaagcggttcaagcagtaccgcgagctgaagccccagacctgcaccatctgcgagaccacccccgtcaacgccatcgacgcggagatgcacgacctcaactgctcctacaacatctgcccctactgcgccagccggctgacctccgacgggctggcccgccacgtgacgcagtgcccgaagcggaaggagaaggtggaggagaccgagctctacctgaacctggagcgcatcccctgggtcgtgcggaagctcctccaggtgagcgagagcaccggcgtcgccctgaagcgctccagctggctgatcgtgctgctggtgctcctggcggtctccagctcccccgtgcagagcgcccccatcggg

SEQ ID NO: 12318 - RNA, 972 nt, synthetic construct
  misc_feature 1..972: note = derived and/or modified CDS sequence (opt1) from CCHFV(VLG/TI29414)__AY179961.1__Gn
  source 1..972: mol_type = other RNA
agcgaggagcccggcgacgactgcatctcccgcacccagctgctccgggccgagccggccgagatccacgacgacaactacgggggccccggggacaagatcaccatctgcaacggcagcacgatcgtggaccagcgcctggggtccgagctgggctgctacaccatcaaccgggtcaagagcttcaagctctgcgagaactccgcgaccggcaagacctgcgagatcgacagcacgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccgcacatccccctgctcgggaagatggccatctacatctgccggatgagcaaccacccccgcaccacgatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcgccggtgaacgccatcgacgccgagatgcacgacctcaactgctcctacaacatctgcccctactgcgccagccgcctgacctccgacggcctggcgcggcacgtcccccagtgccccaagcgcaaggagaaggtggaggagaccgagctctacctgaacctggagcggatcccgtggaacgtgcgcaagctcctgcaggtcagcgagtccacgggggtggccctgaagcggagcagctggctcatcgtgctgctggtcctcctgaccgtgtccctgagccccgtgcagtccgcccccgtcggc

SEQ ID NO: 12319 - RNA, 972 nt, synthetic construct
  misc_feature 1..972: note = derived and/or modified CDS sequence (opt1) from CCHFV(TADJ/HU8966)__AY179962.1__Gn
  source 1..972: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagaactgcgagatcgactccgtgccggtgaagtgccgccagggctactgcctgaagatcacccaggaggggcggggccacgtcaagctgagccgcgggtccgaggtggtgctcgacgcgtgcgacagctcctgcgaggtcatgatccccaagggcaccggcgacatcagcgtggactgctccgggggccagcagcacttcctgaaggacaacctgatcgacctcgggtgccccaagatccccctgctgggcaagatggccatctacatctgccggatgagcaaccacccgaagaccacgatggccttcctcttctggttctccttcggctacgtgatcacccgcatcctgtgcaaggccatcttctacctgctcatcatcgtcgggaccctgggcaagcggttcaagcagtaccgcgagctgaagccccagacctgcacgatctgcgagaccacccccgccaacgcgatcgacgccgagatgcacgacctcaactgcagctacaacatctgcccctactgcgcctcccggctgaccagcgacgggctggcccgccacgtgacgcagtgcccgaagcggaaggagcgcgtggaggagaccgagctctacctgaacctggagcggatcccctggatcgtccgcaagctcctccaggtgtccgagagcaccggcgtggcgctgaagcggagctcctggctcatcgtcctgctggtgctgttcaccgtgagcctgtcccccgtccagagcgcccccatcggg

SEQ ID NO: 12320 - RNA, 972 nt, synthetic construct
  misc_feature 1..972: note = derived and/or modified CDS sequence (opt1) from CCHFV(Hodzha)__AY223476.1__Gn
  source 1..972: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcaagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccgaagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcggg

SEQ ID NO: 12321 - RNA, 972 nt, synthetic construct
  misc_feature 1..972: note = derived and/or modified CDS sequence (opt1) from CCHFV(Kosovo/9553/2001)__AY675511.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatcgcccggatgagcaaccaccccaagaccaccatggccttcctgttctggttctccctgggctacgtgatcacgtgcatcctctgcaaggccctgttctacagcctgatcatcatcggcaccctcgggaagaagatcaagcagtaccgcgagctgaagccccagacctgcaccatctgcgagaccgcgcccgtgaacgccatcgacgccgagatgcacgacctgaactgctcctacaacatctgcccgtactgcgccagccggctcacgtccgacggcctggcgcgccacgtcaagcagtgccccaagcggaaggagaaggtggaggagaccgagctgtacctcaacctggagcgcatcccctgggtggtccggaagctgctccaggtgagcgagtccaccggggtggccctgaagcgcagcagctggctgatcgtcctcctggtgctgctcaccgtgtccctgagccccgtccagtccgccccggtgggc

SEQ ID NO: 12322 - RNA, 972 nt, synthetic construct
  misc_feature 1..972: note = derived and/or modified CDS sequence (opt1) from CCHFV(SPU41/84)__AY900142.1__Gn
  source 1..972: mol_type = other RNA
agcgaggagtccagcgacgactgcatctcccgcacccagctgctccggaccgagacggccgagatccacggcgacaactacgggggccccggggacaagatcaccatctgcaacggcagcaccgtggtcgaccagcgcctggggtccgagctgggctgctacaccatcaaccgggtgaagacgttcaagctctgcgagaacagcgccaccggcaagtcctgcgagatcgacagcgtgccggtcaagtgccgccaggggtactgcctgaagatcacccaggagggccgggggcacgtgaagctgtcccgcggcagcgaggtggtcctcgacgcgtgcgacacctcctgcgaggtgatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtcatcacgtgcatcatctgcaaggtgatcttctacctgctcatcatcgtgggcaccctggggaagcgcttcaagcagtaccgggagctgaagccccagacctgcaccatctgcgagaccacgcccgtcaacgccatcgacgccgagatgcacgacctcaactgctcctacaacatctgcccctactgcgcgagccgcctgacctccgacggcctggcccggcacgtgacccagtgcccgaagcgcaaggagaaggtggaggagaccgagctctacctgaacctggagcggatcccctgggtcgtgcgcaagctcctccaggtgagcgagtccacgggggtcgccctgaagcggagcagctggctggtggtgctgctggtcctcctgaccgtgtccctgagccccgtgcagtccgcccccatcagc

SEQ ID NO: 12323 - RNA, 972 nt, synthetic construct
  misc_feature 1..972: note = derived and/or modified CDS sequence (opt1) from CCHFV(UG3010)__AY900143.1__Gn
  source 1..972: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcatcgtgtgcaaggtgctgttctacctcctgatcgtcatcggcaccctgagcaagaagctcaagcagtaccgcgagctgaagccccagacctgcatcgtgtgcgagtccacccccgtgaacgccatcgacgccgagatgcacgagctgaactgcaactacaacatctgcccctactgcgcgagccggctcacctccgacgggctggtccgccacgtgaaccagtgcccgaagcggaaggagaaggtggaggagacggagctgtacctcaacctggagcgcatcccctggctggtccggcgcctcctccaggtgagcgagtccaccggcatggccctgaagcggagctgctggatgaccaccctgctgatcctgctcgtggtctccctgagccccgtgcagagcgcccccgtcggg

SEQ ID NO: 12324 - RNA, 972 nt, synthetic construct
  misc_feature 1..972: note = derived and/or modified CDS sequence (opt1) from CCHFV(Hy13)__AY900145.1__Gn
  source 1..972: mol_type = other RNA
agcgaggagtccggcgacgactgcatcagccgcacccagctgtcccggaccgagacggccgagatccacagcgacaactacgggggccccggggacaagatcaccatctgcaacggctccaccatcgtggaccagcgcctcgggagcgagctgggctgctacaccatcaaccgggtcaagtccttcaagctgtgcgagaacagcgccacgggcaagtcctgcgagatcgacagcaccccgatcaagtgccgccaggggttctgcctcaagatcacccaggagggccgggggcacgtgaagctgtcccgcggcagcgaggtggtcctggacgcgtgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccggatgagcaaccacccgaagacgaccatggccttcctcttctggttctccttcggctacgtgatcacgtgcatcctgtgcaaggtcatcttctacctgctcatcgtggtgggcaccctggggaagaagttcaagcagtaccgcgagctgaagccccagacctgcaccatctgcgagaccacccccgtcaacgccatcgacgccgagatgcacgacctcaactgcagctacaacatctgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctccaggtgagcgagtccaccggggtcgccctgaagcgcagctcctggctggtggtgctgctggtcctcctgaccgtgagcctgtcccccgtgcagagcgcccccatcggc

SEQ ID NO: 12325 - RNA, 972 nt, synthetic construct
  misc_feature 1..972: note = derived and/or modified CDS sequence (opt1) from CCHFV(Semunya)__DQ094832.1__Gn
  source 1..972: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgccatcgacgccgagatgcacgagctgaactgcaactacaacatctgcccctactgcgcgtcccggctcaccagcgacggcctggtgcgccacgtgacccagtgcccgaagcggaaggagaaggtcgaggagacggagctgtacctcaacctggagcgcatcccctggctggtgcggcgcctcctccaggtgtccgagagcaccgggatggccctgaagcggtcctgctggatgaccaccctgctgatcctgctcgtcgtgagcctgtcccccgtccagagcgcccccgtgggc

SEQ ID NO: 12326 - RNA, 972 nt, synthetic construct
  misc_feature 1..972: note = derived and/or modified CDS sequence (opt1) from CCHFV(SPU128/81/7)__DQ157174.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgagagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctgaagcgcagcagctggctgatcgtcctgctcgtgctgttcacggtgtccctgagccccgtccagtccgcgccgatcggc

SEQ ID NO: 12327 - RNA, 972 nt, synthetic construct
  misc_feature 1..972: note = derived and/or modified CDS sequence (opt1) from CCHFV(ROS/HUVLV-100)__DQ206448.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggc

SEQ ID NO: 12328 - RNA, 972 nt, synthetic construct
  misc_feature 1..972: note = derived and/or modified CDS sequence (opt1) from CCHFV(AP92)__DQ211625.1__Gn
  source 1..972: mol_type = other RNA
agcgagggcggggacggcgggtgcatctcccgcacccagctgatcaagaccgagacggccgaggtgcacggcgacgactacgggggccccggcgagaagatcaccatctgcaacgggagcaccatcgtcgaccagcggctcggctccgagctggggtgctacaccatcaaccgcatcaagagcttcaagctgtgcgagaactccgcccagggcaagaactgcgagatcgacagcgcgccggtgcagtgccggcaggggtactgcctcaagatctcccaggagggccgcggccacgtgaagctgagccgggggtccgagatcgtcctggacgtgtgcgacacgagctgcgagatcatgatccccaagggcaccggggacatcctcgtggactgctccggcggccagcagcacttcctgcagagcaacctggtcgacctcgggtgccccaacatccccctgctgggcaagatggccatctacatctgccgcatgtccaaccacccgaagaccaccatggccttcctcttctggttcagcttcgggtacgtgatcacgtgcatcctgtgcaagaccctgttctacatcctcatcatcatcggcaccctggggaagaagctgaagcagtaccgggagctcaagccccagacctgcacgatctgcgagtccgtgcccgtcaacgccatcgacgccgagatgcacgacctgaactgcagctacaacatctgcccctactgcgcgtcccgcctgaccagcgagggcctcacccggcacgtgaaccagtgcccgaagcgcaaggagaaggtggaggagaccgagctgtacctgaacctcgagcggatcccctggatcgtccgcaagctgctccaggtgtccgagagcacgggcgtggccctgaagcggagctcctggatgatcgtcctgctgatcctcctgatcgtgagcatgtcccccgtgcagagcgcccccatctcc

SEQ ID NO: 12329 - RNA, 972 nt, synthetic construct
  misc_feature 1..972: note = derived and/or modified CDS sequence (opt1) from CCHFV(ArD8194)__DQ211626.1__Gn
  source 1..972: mol_type = other RNA
gccgagggcgggagcaacgactgcgtgtcccgcacccagctggtcaagaccgaggtggccgagatccacgaggacagctacggcgggcccggcgagaagatcacgatctgcaacgggtccaccatcgtggaccagcggctcggcagcgagctgggctgctacaccatcaaccgcgtccggacctacaagctgtgcgagaactccgcgacggagaagtcctgcgagatcgacagcgtgccggtgaagtgcaagcaggggttctgcctcaagatcacccaggagggccgcgggcacgtcaagctgagccggggcaccgagatcgtgctggacgtgtgcgacacctcctgcgagctcatgatccccaaggggacgggcgacatcctggtcgactgcagcggcgggcagcagcacttcctgcaggacaacctcatcgacctgggctgccccaacatccccctgctcgggcgcaccgccatctacgtgtgccggatgtccaaccacccgaagaccaccatggccttcctgttctggttcagcttcggctacgtgatcacgtgcgtcgtgtgcaaggtgctgttctacctcctgatcgtcatcggcaccctggggaagcgcctcaagcagtaccgggagctgaagccccagacctgcatcgtgtgcgagtccatccccgtgaacgccatcgacgccgagatgcacgacctgaactgcaactacaacatctgcccctactgcgcgagccgcctcacctccgacggcctggtccggcacgtgacgcagtgcccgaagcgcaaggagaaggtggaggagaccgagctgtacctcaacctggagcggatcccctggctggtccgcaagctcctccaggtgagcgagtccaccggggtggccctgaagcggagctgctggatgatcaccctgctgatcctgctcacggtctccatgagccccgtgcagagcgcccccgtcggc

SEQ ID NO: 12330 - RNA, 972 nt, synthetic construct
  misc_feature 1..972: note = derived and/or modified CDS sequence (opt1) from CCHFV(ArD15786)__DQ211627.1__Gn
  source 1..972: mol_type = other RNA
gccgagggcgggagcaacgactgcgtgtcccgcacccagctggtcaagaccgaggtgacggagatccacgaggacagctacggcgggcccggcgagaagatcaccatctgcaacgggtccaccatcgtggaccagcggctcggcagcgagctgggctgctacaccatcaaccgcgtccggacgtacaagctgtgcgagaactccgccaccgagaagtcctgcgagatcgacagcgtgccggtgaagtgcaagcaggggttctgcctcaagatcacccaggagggccgcgggcacgtcaagctgagccggggcaccgagatcgtgctggacgtgtgcgacacgtcctgcgagctcatgatccccaaggggaccggcgacatcctggtcgactgcagcggcgggcagcagcacttcctgcaggacaacctcatcgacctgggctgccccaacatccccctgctcgggcagaccgcgatctacgtgtgccgcatgtccaaccacccgaagaccacgatggccttcctgttctggttcagcttcggctacgtgatcacgtgcgtcgtgtgcaaggtgctgttctacctcctgatcgtcatcggcaccctggggaagcggctcaagcagtaccgcgagctgaagccccagacctgcatcgtgtgcgagtccatccccgtgaacgccatcgacgccgagatgcacgacctgaactgcaactacaacatctgcccctactgcgccagccggctcacctccgacggcctggtccgccacgtgacccagtgcccgaagcggaaggagaaggtggaggagaccgagctgtacctcaacctggagcgcatcccctggctggtccggaagctcctccaggtgagcgagtccaccggggtggcgctgaagcgcagctgctggatcatcacgctgctgatcctgctcaccgtctccatgagccccgtgcagagcgcccccgtcggc

SEQ ID NO: 12331 - RNA, 972 nt, synthetic construct
  misc_feature 1..972: note = derived and/or modified CDS sequence (opt1) from CCHFV(ArD39554)__DQ211628.1__Gn
  source 1..972: mol_type = other RNA
agcgagtccaacaacaacgactgcgtgagccgcacccagctgatcaagaccgagaacgccgagatccacggcgacgactacgggggccccggggagaagatcacgatctgcaacggctccaccatcgtcgagcagcggctcgggagcgagctgggctgctacaccatcaaccgcatcaagtccttcaagctgtgcgagaacagcgcctccggcaaggggtgcgagatcgacagcaccccggtgaagtgcaagcagggcttctgcctcaagatcacgcaggaggggcggggccacgtgaagctgtcccgcgggagcgagatcatcctggacgtctgcgactccagctgcgagatgatgatccccaagggctccggcgacatcctcgtggactgcagcgggggccagcagcacttcctgcaggacaacctggtggacctcgggtgccccaacgtccccctgctgggcaagatggcgatctacatctgccggatgtccaaccacccgaagaccaccatggccttcctcttctggttcagcttcggctacgtgatcacgtgcatcttctgcaaggtgatcttctacgtcctgatcatcatcgggaccctgggcaagcgcatcaagcagtaccgggagctcaagccccagacctgcaccatctgcgaggccacccccgtgaacgccatcgacgccgagatgcacgacctgaactgctcctacaacatctgcccctactgcgcgagccgcctgacgtccgaggggctcgtgcggcacgtcacccagtgcccgaagcgcaaggagaagatcgaggagaccgagctgtacctgaacctcgagcggatcccctggttcgtgcgcaagctgctccaggtgagcgagagcaccggcgtcgccctgaagcggtccagctggctggtgacgctgctcgtgctgctgaccgtctccctcagccccgtgcagtccgcccccatcggg

SEQ ID NO: 12332 - RNA, 972 nt, synthetic construct
  misc_feature 1..972: note = derived and/or modified CDS sequence (opt1) from CCHFV(Drosdov)__DQ211630.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaagtgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggc

SEQ ID NO: 12333 - RNA, 972 nt, synthetic construct
  misc_feature 1..972: note = derived and/or modified CDS sequence (opt1) from CCHFV(Oman)__DQ211632.1__Gn
  source 1..972: mol_type = other RNA
agcgaggagtccggcgaggactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccagacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtgagcgagtccaccggggtcgccctgaagcggagcagctggctgatcgtgctgctcgtgctgctgaccgtctccctcagccccgtgcagtccgcccccatcggc

SEQ ID NO: 12334 - RNA, 972 nt, synthetic construct
  misc_feature 1..972: note = derived and/or modified CDS sequence (opt1) from CCHFV(SPU97/85)__DQ211633.1__Gn
  source 1..972: mol_type = other RNA
agcgaggagtccgacggcgactgcatcagccgcacccagctgctccggaccgagacggccgagatccactccgacaactacgggggccccggggacaagatcaccatctgcaacggcagcaccatcgtggaccagcgcctggggtccgagctgggctgctacaccatcaaccgggtcaagagcttcaagctctgcgagaactccgccacgggcaagagctgcgagatcgactccaccccggtgaagtgccgccaggggttctgcctgaagatcacccaggagggccgggggcacgtgaagctgagccgcggctccgagatcgtcctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggcggatggccatctacatctgccgcatgtccaaccacccgaagacgaccatggccttcctgttctggttcagcttcggctacgtgatcacgtgcatcctgtgcaaggtcatcttctacctcctgatcgtggccggcaccgtggggaagaagttcaagcagtaccgggagctgcgcccccagacctgcaccatctgcgagaccacccccgtcaacgccatcgacgcggagatgcacgacctcaactgctcctacaacatctgcccctactgcgccagccggctgacgtccgacggcctggcccgccacgtgatgcagtgcccgaagcggaaggagaagatcgaggagaccgagctctacctgaacctggagcgcatcccctgggtggtccggaagctcctccaggtgagcgagagcaccggggtggccctgaagcgctccagctggctgaccgtcctgctggtgctcctgatcgtgtccctgagccccgtccagtccgcgcccatcggc

SEQ ID NO: 12335 - RNA, 972 nt, synthetic construct
  misc_feature 1..972: note = derived and/or modified CDS sequence (opt1) from CCHFV(SPU103/87)__DQ211634.1__Gn
  source 1..972: mol_type = other RNA
agcgaggagtccagcgacgactgcatctcccgcacccagctgctccggaccgagacggccgagatccacggcgacaactacgggggccccggggacaagatcaccatctgcaacggcagcaccatcgtggaccagcgcctggggtccgagctgggctgctacaccatcaaccgggtcaagacgttcaagctctgcgagaacagcgccaccggcaagtcctgcgagatcgacagcgtgccggtgaagtgccgccaggggtactgcctgaagatcacccaggagggccgggggcacgtcaagctgtcccgcggcagcgaggtggtgctcgacgcgtgcgacacctcctgcgaggtcatgatccccaaggggacgggcgacatcctggtggactgcagcggcgggcagcagcacttcctgaaggacaacctcatcgacctgggctgccccaagatccccctgctcgggaagatggccatctacatctgccggatgtccaaccacccgaagaccaccatggccttcctgttctggttcagcttcggctacgtgatcacgtgcgtcctgtgcaaggccatcttctacctcctgatcatcgtgggcaccctggggaagcgcctcaagcagtaccgggagctgaagccccagacctgcaccatctgcgagaccacgcccgtgaacgccatcgacgcggagatgcacgacctgaactgctcctacaacatctgcccctactgcgccagccgcctcacctccgacggcctggcccggcacgtcacccagtgcccgaagcgcaaggagaaggtggaggagaccgagctgtacctcaacctggagcggatcccctgggtggtccgccggctgctccaggtgagcgagtccacgggggtggccctgaagcgcagcagctggctgatcgtcctcctggtgctgttcaccgtgtccctcagccccgtccagtccgcgcccatcagc

SEQ ID NO: 12336 - RNA, 972 nt, synthetic construct
  misc_feature 1..972: note = derived and/or modified CDS sequence (opt1) from CCHFV(SPU415/85)__DQ211635.1__Gn
  source 1..972: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtggaccagcgcctggggtccgagctgggctgctacacgatcaaccgggtcaagagcttcaagctctgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgacagcaactgcgagatcatgatccccaaggggacgggcgacatcctggtggactgctccggcgggcagcagcacttcctgaaggacaacctcatcgacctgggctgccccaacatccccctgctcgggaagatggcgatctacatctgccggatgagcaaccacccgaagaccaccatggccttcctgttctggttctccttcggctacgtgatcacgtgcatcctgtgcaaggtcatcttctacctcctgatcgtggccggcaccgtggggaagaagttcaagcagtaccgcgagctgcggccccagacctgcaccatctgcgagaccatccccgtcaacgccatcgacgccgagatgcacgacctcaactgcagctacaacatctgcccctactgcgcgtcccgcctgacgagcgacggcctggcccggcacgtgatgcagtgcccgaagcgcaaggagaaggtggaggagaccgagctctacctgaacctggagcggatcccctgggtcgtgcgcaagctcctccaggtgtccgagagcaccggggtcgccctgaagcggagctcctggctgaccgtgctgctggtgctcctgatcgtcagcctgtcccccgtgcagagcgcccccatcggc

SEQ ID NO: 12337 - RNA, 972 nt, synthetic construct
  misc_feature 1..972: note = derived and/or modified CDS sequence (opt1) from CCHFV(Turkey200310849)__DQ211636.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgaggtggacagcacccccgtgaagtgccgccaggggttctgcctgaagatcacccaggagggccgggggcacgtcaagctgtcccgcggcagcgaggtggtgctcgacgcgtgcgactccagctgcgaggtcatgatccccaaggggacgggcgacatcctggtggactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcagctgcaaggccctgttctactccctcatcatcatcggcaccctggggaagaagatcaagcagtaccgggagctgaagccccagacctgcaccatctgcgagaccgcccccgtcaacgcgatcgacgccgagatgcacgacctcaactgcagctacaacatctgcccgtactgcgcctcccgcctgacgagcgacggcctggcccggcacgtgacccagtgccccaagcgcaaggagaaggtggaggagaccgagctctacctgaacctggagcggatcccctggatcgtccgcaagctcctccaggtgtccgagagcaccggggtggcgctgaagcggagctcctggctgatcgtcctgctggtgctcctgacggtgagcctgtcccccgtccagagcgccccggtgggc

SEQ ID NO: 12338 - RNA, 972 nt, synthetic construct
  misc_feature 1..972: note = derived and/or modified CDS sequence (opt1) from CCHFV(Kosova Hoti)__EU037902.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccagaagggccgggggcacgtgaagctgtcccgcggcagcgaggtcgtgctcgacgcgtgcgactccaactgcgaggtgatgatccccaaggggacgggcgacatcctggtcgactgcagcggcgggcagcagcacttcctgaaggacaacctcatcgacctgggctgcccccacatcccgctgctcgggaagatggccatctacatctgccggatgtccaaccaccccaagaccaccatggccttcctgttctggttcagcttcggctacgtgatcacgtgcatcttctgcaaggccctgttctactccctcatcatcatcggcaccctggggaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacggcctggcccgccacgtcaagcagtgccccaagcggaaggagaaggtggaggagaccgagctctacctgaacctggagcgcatcccctgggtggtccggaagctcctccaggtgtccgagagcaccggggtggcgctgaagcgctccagctggctgatcgtcctgctggtgctcctgaccgtgagcctgtcccccgtccagagcgccccggtgggc

SEQ ID NO: 12339 - RNA, 972 nt, synthetic construct
  misc_feature 1..972: note = derived and/or modified CDS sequence (opt1) from CCHFV(YL04057)__FJ562094.1__Gn
  source 1..972: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggccgcgagctgggctgctacaccatcaaccgggtgcgctcctacaagctgtgcgagaacagcgcgtccggcaagagctgcgagatcgactccatcccggtcaagtgcaagcaggggttctgcctcaagatcacccaggaggggcggggccacgtgaagctgagccgcgggacggagatcgtgctggacgtctgcgactccagctgcgagctcatgatccccaagggcaccggcgacatcctggtggactgctccgggggccagcagcacttcctgcagaacaacctcatcgacctggggtgccccaacgtgcccctgctcggcaagatggccatctacgtctgccggatgagcaaccacccgaagaccaccatggccttcctgttctggttctccttcggctacgtgatcacgtgcatcgcctgccgcgtgctgttctacctcctgatcgccatcgggaccgtcggcaagaagctgaagcagtaccgggagctcaagccccagacctgcatcgtgtgcgagagcgtgcccgtcaacgcgatcgacgccgagatgcacgagctgaactgctcctacaacatctgcccctactgcgccagccgcctgtccaccgacgggctcatccggcacgtgacgcagtgcccgaagcgccgggagaaggtggaggagaccgagctgttcctgaacctcgagcgcatcccctggctggtccggaagctgctccaggtgagcgagagcaccggcatggccctgaagcgctcctgctggatgatcaccctgctcatcctgctgctcgtgagcatctcccccgtccagagcgcgcccgtgggg

SEQ ID NO: 12340 - RNA, 972 nt, synthetic construct
  misc_feature 1..972: note = derived and/or modified CDS sequence (opt1) from CCHFV(V42/81)__GU477490.1__Gn
  source 1..972: mol_type = other RNA
agcaaggagcccggcgacgactgcatctcccgcacccagctgatgcggaccgagacggccgagatccacgacgacaactacgggggcccgggggacaagatcaccatctgcaacggcagcaccatcgtggaccagcgcctcgggtccgagctgggctgctacaccatcaaccgggtcaagagcttcaagctgtgcgagaactccgccacgggcaaggcgtgcgaggtggacagcacccccgtgaagtgccgccaggggttctgcctcaagatcacccaggagggccgggggcacgtcaagctgtcccgcggcagcgaggtggtgctggacgcctgcgactccagctgcgaggtcatgatccccaaggggaccggcgacatcctcgtggactgctccggcgggcagcagcacttcctgaaggacaacctgatcgacctcgagtgcccccacatcccgctgctgggcaagctcgccatctacatctgccggatgagcaaccacccccgcacgaccatggccttcctgttctggttcgggttcggctacgtgatcacgtgcatcctgtgcaaggccctcttctactccctgatcatcatcggcaccctggggaagaagatcaagcagtaccgggagctcaagccccagacctgcaccatctgcgagaccgcgcccgtcaacgccatcgacgccgagatgcacgacctgaactgcagctacaacatctgcccgtactgcgcctcccgcctgaccagcgacggcctcgcgcggcacgtgacgcagtgccccaagcgcaaggagaaggtggaggagaccgagctgtacctgaacctcgagcggatcccctggatcgtccgcaagctgctccaggtgtccgagagcaccggggtggtcctgaagcggtccagctggctgatcgtgctgctcgtgctgctgaccgtcagcctctcccccgtgcagagcgccccggtgggc

SEQ ID NO: 12341 - RNA, 972 nt, synthetic construct
  misc_feature 1..972: note = derived and/or modified CDS sequence (opt1) from CCHFV(Afg09-2990)__HM452306.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggctactgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcactacctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcggg

SEQ ID NO: 12342 - RNA, 972 nt, synthetic construct
  misc_feature 1..972: note = derived and/or modified CDS sequence (opt1) from CCHFV(Sudan Al-Fulah 3-2008)__HQ378184.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcgtggacctgggctgccccaagatcccgctgctcgggaagatggccatctacatctgccgcatgtccaaccaccccaagacgaccatggccttcctgttctggttcagcttcggctacgtcatcacgtgcatcctgtgcaaggccatcttctacctcctgatcatcatcggcaccctggggaagcggttccgccagtaccgggagctcaagccccagacctgcaccatctgcgagaccacccccgtgaacgccatcgacgcggagatgcacgacctgaactgctcctacaacatctgcccgtactgcgccagccgcctgacgtccgacggcctcgcccggcacgtgacccagtgccccaagcgcaaggagaaggtcgaggagaccgagctgtacctgaacctcgagcggatcccctgggtggtgcgcaagctgctgcaggtcagcgagtccaccggggtggccctcaagcggagcagctggctgatcgtgctgctcgtcctgttcacggtgtccctgagccccgtgcagtccgcgccgatcggc

SEQ ID NO: 12343 - RNA, 972 nt, synthetic construct
  misc_feature 1..972: note = derived and/or modified CDS sequence (opt1) from CCHFV(Sudan AB1-2009)__HQ378187.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgaggtggtgctcgacgcgtgcgacaccagctgcgagatcatgatccccaaggggaccggcgacatcctggtcgactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacctgatcacgtgcatcctctgcaaggccatcttctacctgctgatcatcatcggcaccctcgggaagcggctgaagcagtaccgcgagctgaagccccagacctgcaccatctgcgagaccacccccgtgaacgccatcgacgcggagatgcacgacctcaactgcagctacaacatctgcccgtactgcgcctcccggctgacgagcgacggcctggcccgccacgtgatccagtgccccaagcggaaggagaaggtcgaggagaccgagctctacctgaacctggagcgcatcccctgggtggtgcggaagctcctgcaggtctccgagagcaccggggtggccctgaagcgctccagctggctcatcgtgctgctggtcctcttcaccgtgagcctgtcccccgtgcagagcgcgccgatcggc

SEQ ID NO: 12344 - RNA, 972 nt, synthetic construct
  misc_feature 1..972: note = derived and/or modified CDS sequence (opt1) from CCHFV(NIVA 118595)__JN572083.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacccaggaggggcggggccacgtgaagctgtcccgcgggagcgaggtggtcctcgacgcgtgcgactccagctgcgaggtgatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtcatcacgtgcatcctgtgcaaggtgatcttctacctcctgatcatcttcgggaccctgggcaagcgcttcaagcagtaccgggagctcaagccccagacctgcaccatctgcgagaccacccccgtgaacgccatcgacgccgagatgcacgacctgaactgcagctacaacatctgcccctactgcgcgtcccgcctgaccagcgacgggctcgcccggcacgtcacgcagtgcccgaagcgcaaggagaaggtggaggagaccgagctgtacctgaacctcgagcggatcccctgggtggtccgcaagctgctccaggtgtccgagagcaccggcatcgccctgaagcggagctcctggctgatcgtgctgctcgtcctgttcaccgtgagcatcacgcccgtgcagtccgcccccatcggg

SEQ ID NO: 12345 - RNA, 972 nt, synthetic construct
  misc_feature 1..972: note = derived and/or modified CDS sequence (opt1) from CCHFV(SCT ex Afghanistan)__KC344856.1__Gn
  source 1..972: mol_type = other RNA
agcgaggagtccggcgacgactgcatcagccgcacccagctgctccggaccgagacggccgaggtgcacaacgacaactacgggggccccggggacaagatcaccatctgcaacggctccaccatcgtcgaccagcgcctggggagcgagctgggctgctacaccatcaaccgggtgaagtccttcaagctctgcgagaacagcgccacgggcaagtcctgcaagatcgacagcaccccggtgaagtgccgccaggggttctgcctgaagatcacccaggagggccgggggcacgtcaagctgtcccgcggcagcgaggtggtgctcgacgcgtgcgactccagctgcgagatcatgatccccaaggggaccggcgacatcctggtcgactgctccggcgggcagcagcacttcctgaaggacaacctcatcgacctgggctgccccaacatccccctgctcgggaagatggccatctacatctgccggatgagcaaccacccgaagacgaccatggccttcctgttctggttctccttcggctacgtgatcacgtgcatcttctgcaaggtgatcttctacctgctcatcgtcgtgggcaccctggggaagaagttcaagcagtaccgcgagctgaagccccagacctgcaccatctgcgagaccacccccacgaacgccatcgacgccgagatgcacgacctcaactgcagctacaacatctgcccctactgcgcgtcccggctgaccagcgacggcctggcccgccacgtgacccagtgcccgaagcggaaggagaaggtcgaggagaccgagctctacctgaacctggagcgcatcccctggatcgtgcggaagctcctccaggtgtccgagagcacgggggtcgccctgaagcgcagctcctggctgatcgtgctgctggtgctcctgaccgtcagcctgtcccccgtgcagagcgcccccatcggc

SEQ ID NO: 12346 - RNA, 972 nt, synthetic construct
  misc_feature 1..972: note = derived and/or modified CDS sequence (opt1) from CCHFV(Zahedan 2007)__KC867273.1__Gn
  source 1..972: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtggaccagcgcctgggcagcgagctgggctgctacaccatcaaccgggtgcgctccttcaagctctgcgagaacagcgccacggggaagtcctgcgagatcgacagcatcccggtcaagtgcaagcagggcttctgcctgaagatcacccaggaggggcggggccacgtgaagctgtcccgcgggagcgaggtggtcctcgacgtgtgcgactccagctgcgaggtgatgatccccaagggcaccggcgacatcctggtcgactgctccgggggccagcagcacttcctgaaggacaacctcgtggacctggggtgccccaagatccccctgctcggcaagatggcgatctacatctgccggatgagcaaccacccgaagaccacgatggccttcctgttctggttctccttcggctacgtgatcacgtgcatcctgtgcaaggccatcttcttcctcctgatcatcttcgggaccctgggcaagcgcttcaagcagtaccgggagctcaagccccagacctgcaccatctgcgagaccacccccgtcaacgccatcgacgccgagatgcacgacctgaactgcagctacaacatctgcccctactgcgcgtcccgcctgaccagcgacgggctcgcccggcacgtgacgcagtgcccgcgccggaaggagaaggtggaggagaccgagctgtacctgaacctcgagcgcatcccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcggg

SEQ ID NO: 12347 - RNA, 972 nt, synthetic construct
  misc_feature 1..972: note = derived and/or modified CDS sequence (opt1) from CCHFV(SPU 44/08)__KJ682805.1__Gn
  source 1..972: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggccatcttctacctgctgatcgtggtcggcaccctcggcaagaagttcaagcagtaccgggagctgaagccccagacctgcaccatctgcgagaccaaccccgtgaacgccatcgacgcggagatgcacgacctgaactgctcctacaacatctgcccctactgcgccagccgcctcacctccgacgggctggcccggcacgtgatgcagtgcccgaagcgcaaggagaagatcgaggagaccgagctgtacctcaacctggagcggatcccctgggtcgtgcgcaagctgctccaggtgagcgagagcacgggcgtcgccctgaagcggtccagctggctggtgatcctcctggtgctgctcaccgtctccctgagccccgtgcagtccgcgcccatcagc

SEQ ID NO: 12348 - RNA, 972 nt, synthetic construct
  misc_feature 1..972: note = derived and/or modified CDS sequence (opt1) from CCHFV(SPU 383/87)__KJ682806.1__Gn
  source 1..972: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggccttcctgttctggttcagcttcgggtacgtgatcacgtgcatcctctgcaaggtgatcttctacctgctggtcgtggtgggcaccctcggcaagaagttcaagcagtaccgggagctgaagccccagacctgcaccatctgcgagaccaaccccgtcaacgccatcgacgccgagatgcacgacctgaactgctcctacaacatctgcccctactgcgcgagccgcctcacctccgacgggctggcccggcacgtgatccagtgcccgaagcgcaaggagaagatcgaggagaccgagctgtacctcaacctggagcggatcccctgggtggtccgcaagctgctccaggtgagcgagagcacgggcgtggccctgaagcggtccagctggctggtcatcctcctggtgctgctcaccgtgtccctgagccccgtccagtccgcccccatcagc

SEQ ID NO: 12349 - RNA, 972 nt, synthetic construct
  misc_feature 1..972: note = derived and/or modified CDS sequence (opt1) from CCHFV(SPU 130/89)__KJ682807.1__Gn
  source 1..972: mol_type = other RNA
agcgaggagcccaactacgactgcctgtcccgcacccagctcctgcggaccgagaacgccgagatccacagcgacaactacggcgggccgggcgacaagatcacgatctgcaacgggtccaccatcgtggaccagcgcctgggcagcgagctcgggtgctacaccatcaaccgggtcaagtccttcaagctgtgcgagaacagcgccaccggcaagtcctgcgagatcgacagcacgcccgtgcgctgccggcagggcttctgcctgaagatcacccaggaggggcgcggccacgtgaagctctcccgggggagcgaggtcgtgctggacgcgtgcgactccagctgcgagatcatgatccccaagggcaccggggacatcctggtggactgctccggcggccagcagcacttcctcaaggacaacctggtcgacctggggtgccccaacatcccgctcctgggcaagatggccatctacatctgccgcatgagcaaccaccccaagaccacgatggccttcctgttctggttctccttcgggtacgtgatcacgtgcatcctctgcaaggtgatcttctacctgctgatcgtcgtgggcaccctcggcaagaagttcaagcagtaccgggagctgaagccccagacctgcaccatctgcgagaccaaccccgtgaacgccatcgacgccgagatgcacgacctgaactgcagctacaacatctgcccgtactgcgcgtcccgcctcaccagcgacgggctggcccggcacgtcatgcagtgccccaagcgcaaggagaagatcgaggagaccgagctgtacctcaacctggagcggatcccctgggtggtgcgcaagctgctccaggtctccgagagcacgggcgtggccctgaagcggagctcctggctggtggtcctcctggtgctgctcaccgtgagcctgtcccccgtccagagcgccccgatctcc

SEQ ID NO: 12350 - RNA, 972 nt, synthetic construct
  misc_feature 1..972: note = derived and/or modified CDS sequence (opt1) from CCHFV(SPU 497/88)__KJ682808.1__Gn
  source 1..972: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggaagggccacgtgaagctcagccgcgggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccggatgtccaaccacccgaagaccacgatggtgttcctgttctggttcagcttcgggtacgtgatcacgtgcatcctctgcaaggtcatcttctacctgctgatcgtggtgggcaccctcggcaagaagttcaagcagtaccgcgagctgaagccccagacctgcaccatctgcgagaccaaccccgtcaacgccatcgacgccgagatgcacgacctgaactgctcctacaacatctgcccctactgcgccagccggctcacctccgacgggctggcgcgccacgtgatgcagtgcccgaagcggaaggagaagatcgaggagaccgagctgtacctcaacctggagcgcatcccctgggtggtccggaagctgctccaggtgagcgagagcacgggcgtggccctgaagcgctccagctggctggtcatcctcctggtgctgctcaccgtgtccctgagccccgtccagtccgcccccatcagc

SEQ ID NO: 12351 - RNA, 972 nt, synthetic construct
  misc_feature 1..972: note = derived and/or modified CDS sequence (opt1) from CCHFV(SPU 18/88)__KJ682810.1__Gn
  source 1..972: mol_type = other RNA
agcgaggagtccaacgacgactgcctgagccgcacccagctcctgcggaccgagaacgccgagatccactccgacaactacggcgggcccggcgacaagatcacgatctgcaacgggagcaccatcgtggaccagcgcctgggctccgagctcgggtgctacaccatcaaccgggtcaagagcttcaagctgtgcgagaactccgccaccggcaagagctgcgagatcgactccacgccggtgcgctgccggcagggcttctgcctgaagatcacccaggaggggcgcggccacgtgaagctcagccgggggtccgaggtcgtgctggacgcgtgcgacagctcctgcgagatcatgatccccaagggcaccggggacatcctggtggactgcagcggcggccagcagcacttcctcaaggacaacctggtcgacctggggtgccccaacatccccctcctgggcaagatggccatctacatctgccgcatgtccaaccacccgaagaccacgatggggttcctgttctggttcagcttcggctacgtgatcacgtgcatcctctgcaaggtgatcttctacctgctgatcgtcgtgggcaccctcgggaagaagttcaagcagtaccgggagctgaagccccagacctgcaccatctgcgagaccaaccccgtgaacgccatcgacgccgagatgcacgacctgaactgctcctacaacatctgcccctactgcgccagccgcctcacctccgacggcctggcgcggcacgtcatgcagtgcccgaagcgcaaggagaagatcgaggagaccgagctgtacctcaacctggagcggatcccctgggtggtgcgcaagctgctccaggtcagcgagagcacgggggtggccctgaagcggtccagctggctggtgatcctcctggtcctgctcaccgtgtccctgagccccgtgcagtccgcccccatcagc

SEQ ID NO: 12352 - RNA, 972 nt, synthetic construct
  misc_feature 1..972: note = derived and/or modified CDS sequence (opt1) from CCHFV(SPU 48/90)__KJ682813.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgtgatcgacagcgtgcccgtcaagtgccgccaggggtactgcctgcggatcacccaggagggccgcgggcacgtgaagctgtcccggggcagcgaggtggtcctcgacgcgtgcgacacctcctgcgagatcatgatccccaaggggaccggcgacatcctggtggactgcagcggcgggcagcagcacttcctgaaggacaacctcatcgacctgggctgccccaagatcccgctgctcgggaagatggccatctacatctgccgcatgtccaaccaccccacgaccaccatggccttcctgttctggttcagcttcggctacgtgatcacgtgcatcctgtgcaaggccatcttctacctcctgatcatcatcggcaccctggggaagcggttccgccagtaccgggagctcaagccccagacctgcaccatctgcgagaccacgcccgtcaacgccatcgacgcggagatgcacgacctgaactgctcctacaacatctgcccgtactgcgccagccgcctgacctccgacggcctcgcccggcacgtgacccagtgccccaagcgcaaggagaaggtggaggagaccgagctgtacctgaacctcgagcggatcccctgggtcgtgcgcaagctgctccaggtgagcgagtccacgggggtcgccctgaagcggagcagctggctgatcgtgctgctcgtgctgttcaccgtctccctgagccccgtgcagtccgcgccgatcggc

SEQ ID NO: 12353 - RNA, 972 nt, synthetic construct
  misc_feature 1..972: note = derived and/or modified CDS sequence (opt1) from CCHFV(SPU 187/90)__KJ682814.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagtcctgcgagatcgacagcgtgcccgtgaagtgccgccaggggtactgcctgcggatcacccaggagggccgcgggcacgtcaagctgtcccggggcagcgaggtggtgctcgacgcgtgcgacacctcctgcgagatcatgatccccaaggggaccggcgacatcctggtcgactgcagcggcgggcagcagcacttcctgaaggacaacctcatcgacctgggctgccccaagatcccgctgctcgggaagatggccatctacatctgccgcatgtccaaccaccccaagacgaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacccccgtgaacgccatcgacgcggagatgcacgacctgaactgctcctacaacatctgcccgtactgcgccagccggctgacgtccgacggcctcgcccgccacgtcacccagtgccccaagcggaaggagaaggtggaggagaccgagctgtacctgaacctcgagcgcatcccctgggtggtccggaagctgctccaggtgagcgagtccaccggggtggccctgaagcgcagcagctggctgatcgtcctgctcgtgctgttcacggtgtccctgagccccgtccagtccgcgccgatcggc

SEQ ID NO: 12354 - RNA, 972 nt, synthetic construct
  misc_feature 1..972: note = derived and/or modified CDS sequence (opt1) from CCHFV(Haskovo-V46/13)__KR092379.1__Gn
  source 1..972: mol_type = other RNA
agcgaggagctgggcgacgactgcatctcccgcacccagctcctgcggaccgagacggccgagatccacgacgacaactacgggggccccggggacaagatcaccatctgcaacggcagcaccatcgtggaccagcgcctggggtccgagctcggctgctacaccatcaaccggggcaagagcttcaagctgtgcgagaactccgccacggggaagacctgcgagatcgacagcaccccggtcaagtgccgccagggcttctgcctgaagatcacccaggaggggcggggccacgtgaagctctcccgcgggagcgaggtggtcctggacgcgtgcgactccagctgcgaggtgatgatccccaagggcacgggcgacatcctggtggactgctccgggggccagcagcacttcctcaaggacaacctgatcgacctggggtgcccccacatccccctcctgggcaagatggccatctacatctgccggatgagcaaccacccgcgcaccaccatggccttcctgttctggttctccttcggctacgtcatcacgtgcatcttctgcaaggccctcttctacagcctgatcatcatcgggaccctgggcaagaagatcaagcagtaccgggagctcaagccccagacctgcaccatctgcgagaccacgcccgtgaacgccatcgacgcggagatgcacgacctgaactgctcctacaacatctgcccctactgcgccagccgcctgacctccgacgggctcgcccggcacgtgacccagtgcccgaagcgcaaggagaaggtcgaggagaccgagctgtacctgaacctcgagcggatcccctggatcgtgcgcaagctgctccaggtgagcgagtccacgggcgtcgccctgaagcggagcagctggctgatcgtgctgctcgtgctgctgcccgtctccctcagccccgtgcagtccgcgccggtgggg

SEQ ID NO: 12355 - RNA, 972 nt, synthetic construct
  misc_feature 1..972: note = derived and/or modified CDS sequence (opt1) from CCHFV(24-R-2012)__KR814856.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtgaacgcgatcgacgccgagatgcacgacctcaactgcagctacaacatctgcccgtactgcgcctcccgcctgaccagcgacggcctggcccggcacgtcccccagtgccccaagcgcaaggagaaggtggaggagaccgagctctacctgaacctggagcggatcccctggatcgtgcgcaagctcctgcaggtctccgagagcaccggggtggcgctgaagcggtccagctggctcatcgtgctgctggtcctcctgacggtgagcctgtccccggtgcagagcgcccccgtcggc

SEQ ID NO: 12356 - RNA, 972 nt, synthetic construct
  misc_feature 1..972: note = derived and/or modified CDS sequence (opt1) from CCHFV(36-ST-2014)__KR814857.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctgatcgtgctgctggtgctcctgacggtctccctgagccccgtgcagtccgccccggtgggc

SEQ ID NO: 12357 - RNA, 972 nt, synthetic construct
  misc_feature 1..972: note = derived and/or modified CDS sequence (opt1) from CCHFV(44-ST-2010)__KR814859.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgctgtggttctccttcggctacgtcatcacgtgcatcttctgcaaggccctcttctacagcctgatcatcatcggcaccctggggaagaagatcaagcagtaccgcgagctcaagccccagacctgcaccatctgcgagaccgcccccgtgaacgcgatcgacgccgagatgcacgacctgaactgctcctacaacatctgcccgtactgcgccagccggctgacgtccgacggcctcgcccgccacgtgacccagtgccccaagcggaaggagaaggtcgaggagaccgagctgtacctgaacctcgagcgcatcccctggatcgtgcggaagctgctccaggtgagcgagtccaccggggtcgcgctgaagcgcagcagctggctgatcgtgctgctcgtgctgctgacggtctccctcagccccgtgcagtccgccccggtgggc

SEQ ID NO: 12358 - RNA, 972 nt, synthetic construct
  misc_feature 1..972: note = derived and/or modified CDS sequence (opt1) from CCHFV(47-ST-2013)__KR814861.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctgatcgtgctgctggtgctcctgacggtctccctgagccccgtgcagtccgccccggtgggc

SEQ ID NO: 12359 - RNA, 972 nt, synthetic construct
  misc_feature 1..972: note = derived and/or modified CDS sequence (opt1) from CCHFV(52-R-2014)__KR814862.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgacacgtcctgcgaggtgatgatccccaaggggaccggcgacatcctggtcgactgcagcggcgggcagcagcacttcctgaaggacaacctcatcgacctgggctgcccccacgtgccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaagccccagacctgcaccatctgcgagacggcccccgtcaacgcgatcgacgccgagatgcacgacctcaactgcagctacaacatctgcccgtactgcgcctcccgcctgaccagcgacggcctggcccggcacgtgccccagtgccccaagcgcaaggagaaggtggaggagaccgagctctacctgaacctggagcggatcccctggatcgtccgcaagctcctccaggtgtccgagagcaccggggtggcgctgaagcggtccagctggctgatcgtcctgctggtgctcctgacggtgagcctgtccccggtccagagcgcccccgtgggc

SEQ ID NO: 12360 - RNA, 972 nt, synthetic construct
  misc_feature 1..972: note = derived and/or modified CDS sequence (opt1) from CCHFV(75-R-2012)__KR814863.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcgcgcccgtgaagtgccgccaggggttctgcctgaagatcacccaggagggccgggggcacgtgaagctgtcccgcggcagcgaggtcgtgctcgacgcctgcgactccagctgcgaggtgatgatccccaaggggaccggcgacatcctggtcgactgctccggcgggcagcagcacttcctgaaggacaacctcatcgacctgggctgcccccacatcccgctgctcgggaagatggccatctacatctgccggatgagcaaccacccccgcacgaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcgcccgtgaacgccatcgacgccgagatgcacgacctcaactgctcctacaacatctgcccgtactgcgccagccgcctgacctccgacggcctggcgcggcacgtcccccagtgccccaagcgcaaggagaaggtggaggagacggagctctacctgaacctggagcggatcccctggatcgtgcgcaagctcctgcaggtcagcgagtccaccggggtggccctgaagcggagcagctggctcatcgtgctgctggtcctcctgaccgtgtccctgagcccggtgcagtccgcccccgtcggc

SEQ ID NO: 12361 - RNA, 972 nt, synthetic construct
  misc_feature 1..972: note = derived and/or modified CDS sequence (opt1) from CCHFV(75-ST-2010)__KR814864.1__Gn
  source 1..972: mol_type = other RNA
agcgaggagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacctgcgagatcgactccaccccggtgaagtgccgccaggggttctgcctgaagatcacccaggagggccgggggcacgtgaagctgagccgcggctccgaggtcgtgctcgacgcgtgcgacagctcctgcgaggtgatgatccccaaggggacgggcgacatcctggtcgactgcagcggcgggcagcagcacttcctgaaggacaacctcatcgacctgggctgcccccacatccccctgctcgggaagatggccatctacatctgccggatgtccaaccacccgcgcaccaccatggccttcctgttctggttcagcttcggctacgtgatcacgtgcctgttctgcaaggccctcttctactccctgatcatcatcggcaccctggggaagaagatcaagcagtaccgggagctccgcccccagacctgcaccatctgcgagaccgcccccgtgaacgcgatcgacgccgagatgcacgacctgaactgcagctacaacatctgcccctactgcgcctcccggctgacgagcgacggcctcgcccgccacgtcccgcagtgccccaagcggaaggagaaggtggaggagaccgagctgtacctgaacctcgagcgcatcccctggatcgtgcggaagctgctgcaggtctccgagagcaccggggtggcgctcaagcgcagctcctggctgatcgtgctgctcgtcctgctgaccgtgagcctctcccccgtgcagagcgccccggtcggc

SEQ ID NO: 12362 - RNA, 972 nt, synthetic construct
  misc_feature 1..972: note = derived and/or modified CDS sequence (opt1) from CCHFV(3820-ST-2007)__KR814868.1__Gn
  source 1..972: mol_type = other RNA
agcgaggagcccggcgacgactgcatctcccgcacccagctgctcaagaccgagacggccgagatccacgacgacaactacgggagcccgggcgacaagatcaccatctgcaacgggtccaccatcgtggaccagcggctgggcagcgagctggggtgctacaccatcaaccgcgtcaagtccttcaagctctgcgagaacagcgccacgggcaagacctgcgagatcgactccacccccgtgaagtgccggcagggcttctgcctgaagatcacccaggaggggcgcggccacgtgaagctgagccgggggtccgaggtcgtgctcgacgcgtgcgacagctcctgcgagatcatgatccccaagggcacgggggacatcctggtggactgcagcggcggccagcagcacttcctgaaggacaacctcatcgacctggggtgcccccacatcccgctgctcggcaagatggccatctacatctgccgcatgtccaaccacccccggaccaccatggccttcctgttctggttcagcttcgggtacgtcatcacgtgcatcttctgcaaggccctgttctactccctcatcatcatcggcaccctgggcaagaagatcaagcagtaccgcgagctgaagccccagacctgcaccatctgcgagaccgcccccgtgaacgcgatcgacgccgagatgcacgacctcaactgcagctacaacatctgcccgtactgcgcctcccggctgacgagcgacgggctggcccgccacgtgacccagtgccccaagcggaaggagaaggtcgaggagaccgagctctacctgaacctggagcgcatcccctggatcgtgcggaagctcctccaggtgtccgagagcaccggcgtcgcgctgaagcgcagctcctggctgatcgtgctgctggtgctcctggccgtcagcctgtcccccgtgcagagcgccccggtgggg

SEQ ID NO: 12363 - RNA, 972 nt, synthetic construct
  misc_feature 1..972: note = derived and/or modified CDS sequence (opt1) from CCHFV(4701-ST-2009)__KR814872.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgcgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtcacccagtgccccaagcggaaggagaaggtggaggagaccgagctctacctgaacctggagcgcatcccctggatcgtgcggaagctcctgcaggtcagcgagtccaccggggtggcgctgaagcgcagcagctggctcatcgtgctgctggtcctcctgacggtgtccctgagccccgtgcagtccgccccggtcggc

SEQ ID NO: 12364 - RNA, 972 nt, synthetic construct
  misc_feature 1..972: note = derived and/or modified CDS sequence (opt1) from CCHFV(5170-R-2011)__KR814873.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgtgtgcgactccagctgcgagatcatgatccccaaggggacgggcgacatcctggtcgactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgagggcctggcccgccacgtcacccagtgccccaagcggaaggagaaggtggaggagaccgagctctacctgaacctggagcgcatcccctggatcgtgcggaagctcctgcaggtcagcgagtccaccggggtggccctgaagcgcagcagctggctcatcgtgctgctggtcctcctgacggtgtccctgagccccgtgcagtccgcgccggtcggc

SEQ ID NO: 12365 - RNA, 972 nt, synthetic construct
  misc_feature 1..972: note = derived and/or modified CDS sequence (opt1) from CCHFV(200406546-Turkey)__KR864902.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgtgtgcgactccagctgcgaggtcatgatccccaaggggacgggcgacatcctggtggactgctccggcgggcagcagcacttcctgaaggacaacctcatcgacctgggctgcccccacgtgccgctgctcgggcggatggcgatctacatctgccgcatgagcaaccacccccggaccaccatggccttcctgttctggttctccttcggctacgtcatcacgtgcatcttctgcaaggccctgttctacagcctcatcatcatcggcaccctggggaagaagttcaagcagtaccgcgagctgaagccccagacctgcaccatctgcgagaccgcccccgtgaacgccatcgacgcggagatgcacgacctcaactgctcctacaacatctgcccgtactgcgccagccggctgacgtccgacggcctggcccgccacgtgccccagtgccccaagcggaaggagaaggtcgaggagaccgagctctacctgaacctggagcgcatcccctggatcgtgcggaagctcctccaggtgagcgagtccaccggggtcgccctgaagcgcagcagctggctgatcgtgctgctggtgctcctgaccgtctccctgagcccggtgcagtccgcgcccgtgggc

SEQ ID NO: 12366 - RNA, 972 nt, synthetic construct
  misc_feature 1..972: note = derived and/or modified CDS sequence (opt1) from CCHFV(1-CR/HU-2015)__KU161584.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcacttcctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcacccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgacggtgtccctgagccccgtgcagtccgccccggtcggc

SEQ ID NO: 12367 - RNA, 972 nt, synthetic construct
  misc_feature 1..972: note = derived and/or modified CDS sequence (opt1) from CCHFV(Gaib)__KX013445.1__Gn
  source 1..972: mol_type = other RNA
agcgaggagtccagcgacgactgcatctcccgcacccagctgctccggaccgagacggccgagatccacaacgacaactacggcgggcccggcgacaagatcaccatctgcaacgggagcaccatcgtggaccagcgcctgggctccgagctggggtgctacaccatcaaccgggtcaagagcttcaagctctgcgagaactccgccacgggcaagagctgcgagatcgactccatcccggtgaagtgccgccagggcttctgcctgaagatcacccaggaggggcggggccacgtgaagctgagccgcgggtccgaggtcgtgctcgacgcgtgcgacagctcctgcgagatcatgatccccaagggcaccggggacatcctggtggactgcagcggcggccagcagcacttcctgaaggacaacctcatcgacctggggtgccccaacatccccctgctcggcaagatggccatctacatctgccggatgtccaaccacccgaagaccacgatggccttcctgttctggttcagcttcgggtacgtcatcacgtgcatcttctgcaaggccatcttctacctgctcatcatcgtgggcaccctgggcaagaagttcaagcagtaccgcgagctgaagccccagacctgcaccatctgcgagaccacccccgtgaacgccatcgacgcggagatgcacgacctcaactgctcctacaacatctgcccctactgcgccagccggctgacctccgacgggctggcccgccacgtcgtgcactgcccgaagcggaaggagaagatcgaggagacggagctctacctgaacctggagcgcgtgccctgggtcgtgcggaagctcctccaggtgagcgagagcaccggcgtcgccctgaagcgctccagctggctgatcgtgctgctggtgctcctgaccgtctccctgagccccgtgcagtccgcgcccatcggg

SEQ ID NO: 12368 - RNA, 972 nt, synthetic construct
  misc_feature 1..972: note = derived and/or modified CDS sequence (opt1) from CCHFV(Hodzha)__KX013448.1__Gn
  source 1..972: mol_type = other RNA
agcgaggagtccggcgacgactgcatcagccgcacccagctgctccggaccgagacggccgagatccacggggacgactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcaccccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgcccccggatccccctgctcggcaagatggccatctacatctgccgcatgagcaaccacccggagacgaccatggccttcctgttctggttctccttcggctacgtgatcacgtgcatcctgtgcaaggccatcttctacctcctgatcatcgtggggaccctgggcaagcggttcaagcagtaccgcgagctcaagccccagacctgcaccatctgcgagaccacccccgccaacgcgatcgacgccgagatgcacgacctgaactgcagctacaacatctgcccctactgcgcctcccggctgacgagcgacgggctcgcccgccacgtcacccagtgcccgaagcggaaggagaaggtggaggagaccgagctgtacctgaacctcgagcgcatcccctggatcgtgcggaagctgctgcaggtctccgagagcaccggcgtggcgctcaagcgcagctcctggctgatcgtgctgctcgtcctgttcgccgtgagcctgtcccccgtgcagagcgcccccatcggg

SEQ ID NO: 12369 - RNA, 972 nt, synthetic construct
  misc_feature 1..972: note = derived and/or modified CDS sequence (opt1) from CCHFV(IbAn7620)__KX013451.1__Gn
  source 1..972: mol_type = other RNA
agcgaggagccctccgacgactgcatcagccgcacccagctgctccggaccgagacggccgagatccacggcgacaactacgggggcccgggggacaagatcaccatctgcaacggctccaccatcgtggaccagcgcctggggagcgagctgggctgctacaccatcaaccgggtcaagtccttcaagctctgcgagaacagcgccacgggcaagaactgcgagatcgactccgtgcccgtgaagtgccgccaggggtactgcctgcggatcacccaggagggccgcgggcacgtcaagctgagccggggctccgagatcgtgctcgacgcgtgcgacaccagctgcgagatcatgatccccaaggggaccggcgacatcctggtggactgctccggcgggcagcagcacttcctgaaggacaacctcatcgacctgggctgccccaagatcccgctgctcgggaagatggccatctacatctgccgcatgagcaaccaccccaagacgaccatggccttcctgttctggttctccttcggctacgtcatcacgtgcatcctgtgcaaggccatcttctacctcctgatcatcatcggcaccctggggaagcggctcaagcagtaccgcgagctgaagccccagacctgcaccatctgcgagaccacccccgtgaacgccatcgacgcggagatgcacgacctgaactgcagctacaacatctgcccgtactgcgcctcccggctcacgagcgacggcctggcccgccacgtgatccagtgccccaagcggaaggagaaggtcgaggagaccgagctgtacctcaacctggagcgcatcccctgggtggtgcggaagctgctccaggtctccgagagcaccggggtggccctgaagcgctccagctggctgatcgtgctcctggtcctgttcaccgtgagcctctcccccgtgcagagcgcgccgatcggc

SEQ ID NO: 12370 - RNA, 972 nt, synthetic construct
  misc_feature 1..972: note = derived and/or modified CDS sequence (opt1) from CCHFV(K128_76)__KX013454.1__Gn
  source 1..972: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgagatcgacagcatcccggtgaagtgccgccagggctactgcctgaagatcacccaggaggggcggggccacgtgaagctgtcccgcgggagcgaggtcgtgctcgacgcgtgcgactccagctgcgaggtgatgatccccaagggcaccggcgacatcctggtcgactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacgtgcatcgtgtgcaaggccatcttctacctgctcatcatcgtcgggaccctgggcaagcgcttcaagcagtaccgggagctgaagccccagacctgcaccatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtggaggagaccgagctctacctgaacctggagcggatcccctgggtcgtgcgcaagctcctccaggtgtccgagagcaccggcgtcgccctgaagcggagctcctggctcatcgtgctgctggtgctgttcgcggtcagcctgtcccccgtgcagagcgcccccatctcc

SEQ ID NO: 12371 - RNA, 972 nt, synthetic construct
  misc_feature 1..972: note = derived and/or modified CDS sequence (opt1) from CCHFV(K168_40)__KX013457.1__Gn
  source 1..972: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaagatccccctgctcggcaagatggccatctacatctgccggatgagcaaccacccgaagaccacgatggccttcctgttctggttctccttcggctacgtgatcacgtgcatcgtctgcaaggccatcttctacctgctcatcatcgtggggaccctgggcaagcgcttcaagcagtaccgggagctgaagccccagacctgcaccatctgcgagaccacccccaccaacgccatcgacgcggagatgcacgacctcaactgcagctacaacatctgcccctactgcgcctcccgcctgacgagcgacgggctggcccggcacgtgacccactgcccgaagcgcaaggagaaggtcgaggagaccgagctctacctgaacctggagcggatcccctgggtggtgcgcaagctcctgcaggtctccgagagcaccggcgtggccctgaagcggagctcctggctcatcgtgctgctggtcctcttcgcggtgagcctgtcccccgtgcagagcgcccccatcggg

SEQ ID NO: 12372 - RNA, 972 nt, synthetic construct
  misc_feature 1..972: note = derived and/or modified CDS sequence (opt1) from CCHFV(K168_125)__KX013460.1__Gn
  source 1..972: mol_type = other RNA
agcgacgagtccggcgacgactgcatcagccgcacccagctgctccggaccgagacggccgagatccacggggacaactacggcgggcccggcgacaagatcaccatctgcaacgggtccaccatcgtggaccagcgcctgggcagcgagctgggctgctacaccatcaaccgggtcaagtccttcaagctctgcgagaacagcgccacggggaagtcctgcgaggtggacagcatcccggtgaagtgccgccagggctactgcctgaagatcacccaggaggggcggggccacgtcaagctgtcccgcgggagcgaggtggtgctcgacgcgtgcgactccagctgcgaggtcatgatccccaagggcaccggcgacatcctggtggactgctccgggggccagcagcacttcctgaaggacaacctcatcgacctggggtgccccaaggtgcccctgctcggcaagatggccatctacatctgccggatgagcaaccacccgaagaccacgatggccttcctgttctggttctccttcggctacgtcatcacgtgcatcgtgtgcaaggccatcttctacctgctcatcatcgtggggaccctgggcaagcgcttcaagcagtaccgggagctgaagccccagacctgcaccatctgcgagaccacccccaccaacgccatcgacgcggagatgcacgacctcaactgcagctacaacatctgcccctactgcgcctcccgcctgacgagcgacgggctggcccggcacgtcacccactgcccgaagcgcaaggagaaggtggaggagaccgagctctacctgaacctggagcggatcccctgggtggtccgcaagctcctccaggtgtccgagagcaccggcgtggccctgaagcggagctcctggctcatcgtcctgctggtgctgttcgcggtgagcctgtcccccgtccagagcgcccccatcggg

SEQ ID NO: 12373 - RNA, 972 nt, synthetic construct
  misc_feature 1..972: note = derived and/or modified CDS sequence (opt1) from CCHFV(K229_194)__KX013463.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaagggcaacctcatcgacctggggtgcccccacatcccgctgctcggcaagatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacgggctggcccgccacgtgacccagtgccccaagcggaaggagaaggtcgaggagaccgagctctacctgaacctggagcgcatcccctggatcgtgcggaagctcctccaggtgagcgagtccaccggcgtcgcgctgaagcgcagcagctggctgatcgtgctgctggtgctcctgacggtctccctgagccccgtgcagtccgccccggtgggg

SEQ ID NO: 12374 - RNA, 972 nt, synthetic construct
  misc_feature 1..972: note = derived and/or modified CDS sequence (opt1) from CCHFV(K315_14)__KX013469.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccgtggtcgaccagcggctggggtccgagctgggctgctacaccatcaaccgcgtcaagagcttcaagctctgcaagaactccgccacgggcaagacctgcgagatcgacagcacccccgtgaagtgccggcaggggttctgcctgaagatcacccaggagggccgcgggcacgtgaagctgtcccggggcagcgaggtggtgctcgacgtctgcgactccagctgcgagatcatgatccccaaggggacgggcgacatcctggtggactgctccggcgggcagcagcacttcctgaaggacaacctcatcgacctgggctgcccccacatcccgctgctcgggaagatggcgatctacatctgccgcatgagcaaccacccccggaccaccatggccttcctgttctggttctccttcggctacgtgatcacgtgcatcttctgcaaggccctgttctacagcctcatcatcatcggcaccctggggaagaagatcaagcagtaccgcgagctgaagccccagacctgcaccatctgcgagaccgcccccgtcaacgccatcgacgcggagatgcacgacctcaactgctcctacaacatctgcccgtactgcgccagccggctgacgtccgagggcctggcccgccacgtgacccagtgccccaagcggaaggagaaggtggaggagaccgagctctacctgaacctggagcgcatcccctggatcgtccggaagctcctccaggtgagcgagtccaccggggtggccctgaagcgcagcagctggctgatcgtcctgctggtgctcctgacggtgtccctgagccccgtccagtccgcgccggtgggc

SEQ ID NO: 12375 - RNA, 972 nt, synthetic construct
  misc_feature 1..972: note = derived and/or modified CDS sequence (opt1) from CCHFV(K323_27)__KX013472.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacctcctgatcatcatcggcaccctggggaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacggcctcgcccgccacgtgacccagtgccccaagcggaaggagaaggtcgaggagaccgagctgtacctgaacctcgagcgcatcccctggatcgtgcggaagctgctccaggtgtccgagagcaccggggtcgcgctgaagcgctccagctggctgacggtgctgctcgtgctgctgaccgtcagcctctcccccgtgcagagcgccccggtgggc

SEQ ID NO: 12376 - RNA, 972 nt, synthetic construct
  misc_feature 1..972: note = derived and/or modified CDS sequence (opt1) from CCHFV(K340_6)__KX013475.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccacgaccggcaagacctgcgagatcgacagcacccccgtgaagtgccggcaggggttctgcctgaagatcacgcaggagggccgcgggcacgtgaagctgtcccggggcagcgaggtcgtgctcgacgcctgcgactccagctgcgagatcatgatccccaaggggaccggcgacatcctggtggactgctccggcgggcagcagcacttcctgaaggacaacctcatcgacctgggctgcccccacatcccgcccctggggaagatggcgatctacatctgccgcatgagcaaccacccccggaccaccatggccttcctcttctggttctccttcggctacgtcatcacgtgcatcttctgcaaggccctgttctacagcctgatcatcatcggcaccctcgggaagaagatcaagcagtaccgcgagctgaagccccagacctgcaccatctgcgagacggccccggtgaacgccatcgacgcggagatgcacgacctgaactgctcctacaacatctgcccctactgcgccagccggctcacctccgacggcctggcccgccacgtgacccagtgccccaagcggaaggagaaggtcgaggagaccgagctgtacctcaacctggagcgcatcccctggatcgtgcggaagctgctccaggtgagcgagtccacgggggtcgccctgaagcgcagcagctggctgatcgtgctcctggtgctgctcaccgtctccctgagcccggtgcagtccgcgcccgtgggc

SEQ ID NO: 12377 - RNA, 972 nt, synthetic construct
  misc_feature 1..972: note = derived and/or modified CDS sequence (opt1) from CCHFV(Mamon)__KX013478.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgtccgacgcgtgcgacagctcctgcgaggtgatgatccccaaggggacgggcgacatcctcgtcgactgcagcggcgggcagcagcacttcctgaaggacaacctgatcgacctcggctgcccccacatcccgctgctggggaagatggccatctacatctgccggatgtccaaccacccccgcaccaccgtggccttcctcttctggttcagcttcggctacgtgatcacgtgcatcttctgcaaggccctgttctactccctgatcatcatcggcaccctcgggaagaagatcaagcagtaccgggagctgaagccccagacctgcaccatctgcgagaccgcccccgtcaacgcgatcgacgccgagatgcacgacctgaactgcagctacaacatctgcccgtactgcgcctcccgcctcacgagcgacggcctggcccggcacgtgccccagtgccccaagcgcaaggagaaggtggaggagaccgagctgtacctcaacctggagcggatcccctggatcgtccgcaagctgctccaggtgtccgagagcaccggggtggcgctgaagcggagctcctggctgatcgtcctcctggtgctgctcaccgtgagcctgtccccggtccagagcgcccccgtgggc

SEQ ID NO: 12378 - RNA, 972 nt, synthetic construct
  misc_feature 1..972: note = derived and/or modified CDS sequence (opt1) from CCHFV(Nakiwogo)__KX013484.1__Gn
  source 1..972: mol_type = other RNA
gccgagggcgtgagcaacgactgcgtctcccgcacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtgctggacgtctgcgacaccagctgcgagctcatgatccccaaggggacgggcgacatcctggtggactgctccggcgggcagcagcacttcctgcaggacaacctcatcgacctgggctgccccaacgtgcccctgctcgggaagatggccatctacatctgccggatgagcaaccacccgaagaccaccatggccttcctgttctggttctccttcggctacgtcatcacgtgcgtggtgtgcaaggtcctgttctacctcctgatcgtgatcggcaccctggggaagaagctcaagcagtaccgcgagctgaagccccagacctgcatcgtgtgcgagagcatccccgtcaacgtgatcgacgccgagatgcacgagctgaactgcaactacaacatctgcccctactgcgcctcccggctcaccagcgacggcctggtgcgccacgtcacccagtgcccgaagcggaaggagaaggtggaggagacggagctgtacctcaacctggagcgcatcccctggctggtgcggcgcctcctgcaggtctccgagagcaccgggatggcgctgaagcggtcctgctggatgaccaccctcctgatcctgctcgtggtcagcctgtcccccgtgcagagcgcccccgtgggc

SEQ ID NO: 12379 - RNA, 972 nt, synthetic construct
  misc_feature 1..972: note = derived and/or modified CDS sequence (opt1) from CCHFV(Saf)__KX013487.1__Gn
  source 1..972: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccgggggcacgtgaagctgtcccgcggcagcgaggtcgtgctcgacgcgtgcgactccagctgcgaggtgatgatccccaaggggacgggcgacatcctggtcgactgctccggcgggcagcagcactacctgaaggacaacctcatcgacctgggctgcccccacatcccgctgctcgggaagatggccatctacatctgccggatgagcaaccacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgcccccgtgaacgcgatcgacgccgagatgcacgacctcaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtcctcctgaccgtgtccctgagcccggtgcagtccgcccccgtcggc

SEQ ID NO: 12380 - RNA, 972 nt, synthetic construct
  misc_feature 1..972: note = derived and/or modified CDS sequence (opt1) from CCHFV(Ast199)__KX056051.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatctacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgctgcagctggctgatcgtgctgctggtgctcctgacggtcagcctgtcccccgtgcagagcgccccggtgggc

SEQ ID NO: 12381 - RNA, 972 nt, synthetic construct
  misc_feature 1..972: note = derived and/or modified CDS sequence (opt1) from CCHFV(Ast137)__KX056057.1__Gn
  source 1..972: mol_type = other RNA
agcgaggagcccggcgacgactgcatctcccgcacccagctgctcaagaccgagacggccgagatccacgacgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctccggcgggcagcagcacttcctgaaggacaacctcatcgacctgggctgcccccacatcccgctgctcgggaagatggccatccacatctgccgcatgagcaaccacccccggaccaccatggccttcctgttctggttctccttcggctacgtcatcacgtgcatcttctgcaaggccctgttctacagcctcatcatcatcggcaccctggggaagaagatcaagcagtaccgcgagctgaagccccagacctgcaccatctgcgagaccgcccccgtgaacgcgatcgacgccgagatgcacgacctcaactgctcctacaacatctgcccgtactgcgccagccggctgacgtccgacggcctggcccgccacgtgacccagtgccccaagcggaaggagaaggtcgaggagaccgagctctacctgaacctggagcgcatcccctggatcgtgcggaagctcctccaggtgagcgagtccaccggggtcgcgctgaagcgcagcagctggctgatcgtgctgctggtgctcctgacggtctccctgagccccgtgcagtccgccccggtgggc

SEQ ID NO: 12382 - RNA, 972 nt, synthetic construct
  misc_feature 1..972: note = derived and/or modified CDS sequence (opt1) from CCHFV(Ast133)__KX056060.1__Gn
  source 1..972: mol_type = other RNA
agcgaggagcccgacgacgactgcatctcccgcacccagctgctcaagaccgagacggccgagatccacgacgacaactacggcgggccgggcgacaagatcaccatctgcaacgggagcaccatcgtggaccagcggctgggctccgagctggggtgctacaccatcaaccgcgtcaagagcttcaagctctgcgagaactccgccacgggcaagacctgcgagatcgacagcacccccgtgaagtgccggcagggcttctgcctgaagatcacccaggaggggcgcggccacgtgaagctgtcccgggggagcgaggtcgtgctcgacgcgtgcgactccagctgcgagatcatgatccccaagggcacgggggacatcctggtggactgctccggcggccagcagcacttcctgaaggacaacctcatcgacctggggtgcccccacatcccgctgctcggcaagatggccatctacatctgccgcatgagcaaccacccccggaccaccatggccttcctgttctggttctccttcgggtacgtcatcacgtgcatcttctgcaaggccctgttctacctcctgatcatcatcggcaccctgggcaagaagatcaagcagtaccgcgagctcaagccccagacctgcaccatctgcgagaccgcccccgtgaacgcgatcgacgccgagatgcacgacctgaactgcagctacaacatctgcccgtactgcgcctcccggctgacgagcgacgggctcgcccgccacgtgacccagtgccccaagcggaaggagaaggtcgaggagaccgagctgtacctgaacctcgagcgcatcccctggatcgtgcggaagctgctccaggtgtccgagagcaccggcgtcgcgctgaagcgctccagctggctgatcgtgctgctcgtgctgctgacggtcagcctctcccccgtgcagagcgccccggtgggg

SEQ ID NO: 12383 - RNA, 972 nt, synthetic construct
  misc_feature 1..972: note = derived and/or modified CDS sequence (opt1) from CCHFV(SK/2015/human)__KX458183.1__Gn
  source 1..972: mol_type = other RNA
agcgaggagtccggcgacgactgcatcagccgcacccggctgctccgcaccgagacggccgagatccacggggactcctacggcgggcccggcgacaagatcaccatctgcaacgggagcaccatcgtggaccagcggctgggctccgagatgggctgctacaccatcaaccgcgtcaagagcttcaagctgtgcgagaactccgccacgggcaagagctgcgagatcgactccatcccggtgcggtgccgccaggggtactgcctcaagatcacccaggaggggcggggccacgtgaagctgagccgcgggtccgaggtcgtgctggacgcgtgcgacagctcctgcgaggtgatgatccccaagggcaccggcgacatcctcgtcgactgcagcgggggccagcagcacttcctgaaggacaacctgatcgacctcgggtgccccaacatccccctgctgggcaagatggccatctacatctgccggatgtccaaccacccgaagaccacgatggccttcctcttctggttcagcttcggctacgtgatcacgtgcatcctgtgcaaggccatcttctacctgctcatcatcgtggggaccctgggcaagcgcttcaagcagtaccgggagctgaagccccagacctgcaccatctgcgagaccacccccgccaacgcgatcgacgccgagatgcacgacctcaactgctcctacaccatctgcccctactgcgccagccgcctgacgtccgacgggctggcccggcacgtcacccagtgcccgaagcgcaaggagaaggtggaggagaccgagctctacctgaacctggagcggatcccctgggtggtccgcaagctcctccaggtgagcgagagcaccggcgtggcgctgaagcggtccagctggctcatcgtcctgctggtgctgttcacggtgtccctgagccccgtccagtccgcccccatcggg

SEQ ID NO: 12384 - RNA, 972 nt, synthetic construct
  misc_feature 1..972: note = derived and/or modified CDS sequence (opt1) from CCHFV(YL16070)__KY354081.1__Gn
  source 1..972: mol_type = other RNA
gccgagggcgggagctccgactgcatcagccgcacccagctggtgaagaccgaggtcgccgagatccacgaggactcctacggcgggcccggcgagaagatcacgatctgcaacgggagcaccatcgtggaccagcggctcggctccgagctgggctgctacaccatcaaccgcgtcaagagctacaagctgtgcgagaactccgcgagcgggaagtcctgcgagatcgacagcatcccggtgaagtgcaagcagggcttctgcctcaagatcacccaggaggggcggggccacgtgaagctgtcccgcgggacggagatcgtgctggacgtctgcgacagctcctgcgagctcatgatccccaagggcaccggcgacatcctggtggactgcagcgggggccagcagcacttcctgcagaacaacctcatcgacctggggtgccccaacgtgcccctgctcggcaagatggccatctacgtctgccggatgtccaaccacccgaagaccaccatggccttcctgttctggttcagcttcggctacgtgatcacgtgcatcgtgtgccgcgtcctgttctacctcctgatcgccatcgggaccgtgggcaagaagctgaagcagtaccgggagctcaagccccagacctgcatcgtgtgcgagtccgtccccgtgaacgccatcgacgcggagatgcacgagctgaactgcagctacaacatctgcccctactgcgcctcccgcctgagcaccgacgggctcatccggcacgtgacgcagtgcccgaagcgccgggagaaggtcgaggagaccgagctgttcctgaacctcgagcgcatcccctggctggtgcggaagctgctccaggtgagcgagtccaccggcatggccctgaagcgcagctgctggatgatcaccctgctcatcctgctgctcgtctccatgagccccgtgcagtccgcccccgtgggg

SEQ ID NO: 12385 - RNA, 972 nt, synthetic construct
  misc_feature 1..972: note = derived and/or modified CDS sequence (opt1) from CCHFV(UCCR4448)__KY484042.1__Gn
  source 1..972: mol_type = other RNA
agcgaggagacctccgacgactgcatcagccgcacccagctgctccggacggagaccgccgagatccacggcgacaactacgggggccccggggacaagatcaccatctgcaacggctccaccatcgtggaccagcgcctggggagcgagctgggctgctacacgatcaaccgggtcaagtccttcaagctctgcgagaacagcgccaccggcaagtcctgcgagatcgacagcgtgccggtgaagtgccgccaggggtactgcctgcggatcacccaggagggccgcgggcacgtcaagctgtcccggggcagcgaggtggtgctcgacgcgtgcgacacctcctgcgagatcatgatccccaaggggacgggcgacatcctggtcgactgcagcggcgggcagcagcacttcctgaaggacaacctcatcgacctgggctgccccaagatccccctgctcgggaagatggccatctacatctgccgcatgtccaaccacccgaagaccaccatggccttcctgttctggttcagcttcggctacgtgatcacgtgcatcctgtgcaaggccatcttctacctcctgatcatcatcggcaccctggggaagcggttcaagcagtaccgcgagctcaagccccagacctgcaccatctgcgagaccacgcccgtgaacgccatcgacgcggagatgcacgacctgaactgctcctacaacatctgcccctactgcgccagccggctgacctccgacggcctcgcccgccacgtcacccagtgcccgaagcggaaggagaaggtggaggagaccgagctgtacctgaacctcgagcgcatcccctgggtggtccggaagctgctccaggtgagcgagtccacgggggtggccctgaagcgcagcagctggctgatcgtcctgctcgtgctgttcaccatctccctgagccccgtgcagtccgcgcccatcagc

SEQ ID NO: 12386 - RNA, 972 nt, synthetic construct
  misc_feature 1..972: note = derived and/or modified CDS sequence (opt1) from CCHFV(SPU 45/88)__KJ682809.1__Gn
  source 1..972: mol_type = other RNA
agcgaggagtccagcgacgactgcctgtcccgcacccagctcctgcggaccgagaacacggagatccacagcgacaactacggcgggcccggcgacaagatcaccatctgcaacgggtccaccatcgtggaccagcgcctgggcagcgagctcgggtgctacaccatcaaccgggtcaagtccttcaagctgtgcgagaacagcgccacgggcaagtcctgcgagatcgacagcaccccggtgcgctgccggcagggcttctgcctgaagatcacccaggaggggcgcggccacgtgaagctctcccgggggagcgaggtcgtgctggacgcctgcgactccagctgcgagatcatgatccccaagggcaccggggacatcctggtggactgctccggcggccagcagcacttcctcaaggacaacctggtcgacctggggtgccccaacatccccctcctgggcaagatggcgatctacatctgccgcatgagcaaccacccgaagacgaccatggggttcctgttctggttctccttcggctacgtgatcacgtgcatcctctgcaaggtgatcttctacctgctgatcgtcgtgggcaccctcgggaagaagttcaagcagtaccgggagctgaagccccagacctgcaccatctgcgagaccacccccgtgaacgccatcgacgccgagatgcacgacctgaactgcagctacaacatctgcccctactgcgcctcccgcctcacgagcgacggcctggcccggcacgtcatgcagtgcccgaagcgcaaggagaagatcgaggagaccgagctgtacctcaacctggagcggatcccctggatcgtgcgcaagctgctccaggtgagcgagtccaccggggtcgcgctgaagcggagctcctggctggtggtgctcctggtcctgctcaccgtgagcctgtcccccgtgcagagcgcccccatcggc

SEQ ID NO: 12387 - RNA, 1932 nt, synthetic construct
  misc_feature 1..1932: note = derived and/or modified CDS sequence (opt1) from CCHFV(10200)__U39455.2__Gc
  source 1..1932: mol_type = other RNA
ttcctggacagcaccgccaagggcatgaagaacctcctgaactccaccagcctggagacgtccctcagcatcgaggccccctggggggcgatcaacgtgcagtccacctacaagccgaccgtcagcaccgccaacatcgccctgtcctggagctccgtggagcaccgcggcaacaagatcctggtgagcgggcggtccgagagcatcatgaagctcgaggagcgcacgggcatctcctgggacctgggggtcgaggacgccagcgagtccaagctgctcaccgtgagcgtgatggacctgtcccagatgtacagccccgtcttcgagtacctgtccggcgaccggcaggtggaggagtggcccaaggccacctgcaccggcgactgccccgagcgctgcgggtgcacgagcagcacctgcctccacaaggagtggccgcactcccggaactggcgctgcaaccccacctggtgctggggcgtggggaccggctgcacgtgctgcgggctggacgtcaaggacctgttcaccgactacatgttcgtgaagtggaaggtggagtacatcaagaccgaggcgatcgtctgcgtggagctcaccagccaggagcggcagtgctccctgatcgaggccggcacgcgcttcaacctgggccccgtgaccatcaccctcagcgagccccggaacatccagcagaagctgccgcccgagatcatcaccctgcacccccgcatcgaggaggggttcttcgacctcatgcacgtccagaaggtgctgtccgccagcacggtgtgcaagctgcagtcctgcacccacggcgtccccggggacctccaggtgtaccacatcggcaacctgctgaagggcgacaaggtgaacgggcacctcatccacaagatcgagccgcacttcaacaccagctggatgtcctgggacggctgcgacctggactactactgcaacatgggggactggcccagctgcacctacacgggcgtcacccagcacaaccacgcctccttcgtgaacctgctcaacatcgagaccgactacaccaagaacttccacttccacagcaagcgggtgacggcgcacggggacaccccccagctggacctgaaggcccgccccacctacggcgccggcgagatcaccgtcctcgtggaggtcgccgacatggagctgcacacgaagaagatcgagatctccgggctgaagttcgccagcctcgcgtgcaccggctgctacgcctgctccagctccatcagctgcaaggtgcggatccacgtggacgagccggacgagctgaccgtccacgtgaagtccgacgaccccgacgtggtcgccgccagcagctccctgatggcccgcaagctcgagttcgggaccgacagcacgttcaaggcgttctccgccatgcccaagaccagcctgtgcttctacatcgtggagcgggagcactgcaagtcctgcagcgaggaggacaccaagaagtgcgtgaacaccaagctggagcagccccagtccatcctcatcgagcacaagggcaccatcatcgggaagcagaacagcacgtgcaccgccaaggcctcctgctggctggagagcgtcaagtccttcttctacggcctgaagaacatgctcagcggcatcttcgggaacgtgttcatgggcatcttcctgttcctggccccgttcatcctcctgatcctgttcttcatgttcgggtggcgcatcctgttctgcttcaagtgctgccggcgcacccggggcctcttcaagtaccgccacctgaaggacgacgaggagaccgggtaccggcgcatcatcgagaagctgaacaacaagaagggcaagaacaagctcctggacggcgagcgcctggcggacgggcggatcgccgagctcttctccacgaagacccacatcggc

SEQ ID NO: 12388 - RNA, 1932 nt, synthetic construct
  misc_feature 1..1932: note = derived and/or modified CDS sequence (opt1) from CCHFV(IbAr10200)__AF467768.2__Gc
  source 1..1932: mol_type = other RNA
ttcctggacagcaccgccaagggcatgaagaacctcctgaactccaccagcctggagacgtccctcagcatcgaggccccctggggggcgatcaacgtgcagtccacctacaagccgaccgtcagcaccgccaacatcgccctgtcctggagctccgtggagcaccgcggcaacaagatcctggtgagcgggcggtccgagagcatcatgaagctcgaggagcgcacgggcatctcctgggacctgggggtcgaggacgccagcgagtccaagctgctcaccgtgagcgtgatggacctgtcccagatgtacagccccgtcttcgagtacctgtccggcgaccggcaggtgggcgagtggcccaaggccacctgcaccggggactgccccgagcgctgcggctgcacgagcagcacctgcctccacaaggagtggccgcactcccggaactggcgctgcaaccccacctggtgctggggggtgggcaccgggtgcacgtgctgcggcctggacgtcaaggacctgttcaccgactacatgttcgtgaagtggaaggtggagtacatcaagaccgaggcgatcgtctgcgtggagctcaccagccaggagcggcagtgctccctgatcgaggccggcacgcgcttcaacctggggcccgtgaccatcaccctcagcgagccccggaacatccagcagaagctgccgcccgagatcatcaccctgcacccccgcatcgaggagggcttcttcgacctcatgcacgtccagaaggtgctgtccgccagcacggtgtgcaagctgcagtcctgcacccacggggtccccggcgacctccaggtgtaccacatcggcaacctgctgaagggggacaaggtgaacggccacctcatccacaagatcgagccgcacttcaacaccagctggatgtcctgggacgggtgcgacctggactactactgcaacatgggcgactggcccagctgcacctacacgggggtcacccagcacaaccacgcctccttcgtgaacctgctcaacatcgagaccgactacaccaagaacttccacttccacagcaagcgggtgacggcgcacggcgacaccccccagctggacctgaaggcccgccccacctacggcgccggggagatcaccgtcctcgtggaggtcgccgacatggagctgcacacgaagaagatcgagatctccggcctgaagttcgccagcctcgcgtgcaccgggtgctacgcctgctccagcggcatctcctgcaaggtgcggatccacgtggacgagccggacgagctgaccgtccacgtgaagagcgacgaccccgacgtggtcgccgcctccagcagcctgatggcccgcaagctcgagttcgggaccgactccacgttcaaggcgttcagcgccatgcccaagacctccctgtgcttctacatcgtggagcgggagcactgcaagagctgctccgaggaggacaccaagaagtgcgtgaacaccaagctggagcagccccagagcatcctcatcgagcacaagggcaccatcatcggcaagcagaactccacgtgcaccgccaaggccagctgctggctggagtccgtcaagagcttcttctacgggctgaagaacatgctctccggcatcttcgggaacgtgttcatgggcatcttcctgttcctggccccgttcatcctcctgatcctgttcttcatgttcgggtggcgcatcctgttctgcttcaagtgctgccggcgcacccggggcctcttcaagtaccgccacctgaaggacgacgaggagaccggctaccggcgcatcatcgagaagctgaacaacaagaaggggaagaacaagctcctggacggcgagcgcctggcggaccggcgcatcgccgagctcttcagcacgaagacccacatcggg

SEQ ID NO: 12389 - RNA, 1932 nt, synthetic construct
  misc_feature 1..1932: note = derived and/or modified CDS sequence (opt1) from CCHFV(Turkey-Kelkit06)__GQ337054.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggtccaccgcggcaacaagatcctggtgaccgggcggagcgagtccatcatgaagctcgaggagcgcacgggcgtgagctgggacctgggggtcgaggacgcctccgagagcaagctgctcaccgtgtccatcatggacctgagccagatgtactcccccgtgttcgagtacctgagcggcgaccggcaggtcgaggagtggcccaaggccacctgcaccggcgactgccccgagcgctgcgggtgcacgtccagcacctgcctccacaaggagtggagccactcccggaactggcgctgcaacccgacctggtgctggggcgtggggaccggctgcacgtgctgcggggtggacgtcaaggacctgttcaccgaccacatgttcgtgaagtggaaggtggagtacatcaagaccgaggccatcgtctgcgtggcgctgaccagccaggagcggcagtgctccctcatcgaggccggcacgcgcttcaacctgggccccgtgaccatcaccctgagcgagccccggaacatccagcagaagctccccccggagatcatcaccctgcaccccaagatcgaggaggggttcttcgacctgatgcacgtccagaaggtgctctccgccagcacggtgtgcaagctgcagtcctgcacccacggcatccccggggacctgcaggtctaccacatcggcaacctcctgaagggcgaccgcgtgaacgggcacctgatccacaagatcgagagccacttcaacacctcctggatgagctgggacggctgcgacctcgactactactgcaacatgggggactggccctcctgcacctacacgggcgtgacccagcacaaccacgccgcgttcgtcaacctgctgaacatcgagaccgactacaccaagacgttccacttccacagcaagcgggtgaccgcccacggggacaccccgcagctcgacctgaaggcccgccccacctacggcgccggcgggatcacggtcctggtggaggtggccgacatggagctccacaccaagaaggtcgagatctccggcctgaagttcgcgagcctggcctgcaccgggtgctacgcctgctccagcggcatctcctgcaaggtgcggatccacgtggacgagcccgacgagctcaccgtccacgtgaagagctccgaccccgacgtggtcgccgccagcacgagcctgatggcgcgcaagctggagttcgggaccgactccaccttcaaggccttcagcgccatgccgaagacctccctctgcttctacatcgtggagcgggagtactgcaagagctgctccgaggacgacacccagaagtgcgtggacacgcgcctggagcagccccagagcatcctgatcgagcacaagggcaccatcatcggcaagcagaacgacacctgcaccgccaaggcctcctgctggctcgagagcgtcaagtccttcttctacgggctgaagaacatgctgggcagcgtgttcgggaacctcttcatcggcatcctgctgttcctcgcgcccttcgtgctgctggtcctgttcttcatgttcgggtggaagatcctcttctgcttcaagtgctgccggcgcacgcggggcctgttcaagtaccgccacctgaaggacgacgaggagaccggctaccggcgcatcatcgagcgcctcaactccaagaaggggaagaaccggctgctggacggcgaccgcctcgccgaccggaagatcgccgagctgttcagcaccaagacccacatcggg

SEQ ID NO: 12390 - RNA, 1935 nt, synthetic construct
  misc_feature 1..1935: note = derived and/or modified CDS sequence (opt1) from CCHFV(SR3)__AJ538199.1__Gc
  source 1..1935: mol_type = other RNA
ctcttcctcgacagcatcgtgaagggcatgaagaacctgctgaactccaccagcctcgagacctccctgagcatcgaggccccctggggcgccatcaacgtccagtccacgtacaagccgaccgtgagcaccgcgaacatcgccctgtcctggagctccgtggagcaccgcgggaacaaggtcctcgtgagcgggcggtccgagagcatcatgaagctggaggagcgcaccggcatctcctgggacctgggggtggaggacgccagcgagtccaagctcctgacggtcagcgtgatggacctgtcccagatgtacagccccgtgttcgagtacctctccggcgaccggcaggtcgaggagtggcccaaggcgacctgcaccggcgactgccccgagcgctgcgggtgcaccagcagcacgtgcctgcacaaggagtggccgcactcccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgaccagccaggagcggcagtgctccctgatcgaggccggcacccgcttcaacctcggcagcgtgacgatcaccctgtccgagccccggaacatccagcagaagctgcccccggagatcatcaccctccaccccaagatcgaggaggggttcttcgacctgatgcacgtgcagaaggtcctgagcgcctccaccgtgtgcaagctccagagctgcacgcacggcgtgcccggggacctgcaggtctaccacatcggcaacctgctcaagggcgaccgcgtgaacgggcacctgatccacaagatcgagcagcacttcaacacctcctggatgagctgggacggctgcgacctggactactactgcaacatgggggactggccctcctgcacctacaccggcgtgacgcagcacaaccacgccagcttcgtcaacctcctgaacatcgagaccgactacaccaagaccttccacttccactccaagcgggtgacggcccacggggacaccccgcagctggacctcaaggcgcgccccacctacggcgccggcgagatcaccgtcctggtggaggtggccgacatggagctgcacacgaagaagatcgagatcagcgggctcaagttcgccggcctgacctgcaccgggtgctacgcctgctccagcggcatctcctgcaaggtccggatccacgtggacgagcccgacgagctgaccgtgcacgtcaagagcgacgaccccgacgtggtggcggcctccagcagcctcatggcccgcaagctggagttcgggacggactccaccttcaaggccttcagcgccatgccgaagacctccctgtgcttctacatcgtcgagcgggagtactgcaagagctgcaacaaggaggacacccagaagtgcgtgaacaccaagctcgagcagccccagtccatcctgatcgagcacaagggcacgatcatcggcaagcagaacaacacgtgcaccgcgaaggccagctgctggctggagtccgtcaagagcttcttctacgggctcaagaacatgctgggcgggatcttcggcaacgtgttcatcgggatcttcaccttcctgacccccttcatcctcctgatcctgttcttcatgttcggctggcgcatcctgttctgcttcaagtgctgccggcgcacccggggcctcttcaagtaccgccacctgaaggacgacgaggagaccgggtaccggaagatcatcgagcgcctgaacaacaagaagggcaagaaccgcctcctggacggggagcggctggccgaccgcaagatcgccgagctgttctccaccaagacgcacatcggc

SEQ ID NO: 12391 - RNA, 1935 nt, synthetic construct
  misc_feature 1..1935: note = derived and/or modified CDS sequence (opt1) from CCHFV(UCCR4413)__KY484038.1__Gc
  source 1..1935: mol_type = other RNA
ttcctgagctccatcgtgaagggcaagaagaacctcctgaacagcgcctccctggagaccagcctctccatcgaggccccctggggcgcgatcaacgcccagagcaccttcaagccgacgatctccaccgccaacatcgccctgagctggtccagcgtcgagcaccgcgggaacaaggtgctggtgtccgggcggagcgagtccatcatgaagctcgaggagcgcaccggcatcagctggaacctgggggtcgaggacgcctccgagagccggatgctgaccgtgtccgtgatggacctcagccagatgtacctgcccgtcttcgagtacctgtccggcgaccgccaggtggaggagtggcccaaggcgacgtgcaccggcgactgccccgagcggtgcgggtgcaccagcagcacgtgcctccacaaggagtggccgcactcccgcaactggcggtgcaaccccacctggtgctggggcgtggggaccggctgcacgtgctgcgggctggacgtcaaggacctgttcaccgactacatgttcgtgaagtggaaggtggagtacatcaagaccgaggccatcgtctgcgtggagctcaccagccaggagcgccagtgctccctgatcgaggccggcacccggttcaacctgggccccgtgaccatcacgctcagcgagccccgcaacatccagcagaagctgccgtccgagatcgtcaccctgcaccccaagatcgaggaggggttcttcgacctcatgcacgtgcagaaggtgctgagcgcctccaccgtctgcaagctgcagagctgcacccacggcgtggcgggggacctccaggtgtaccacgtcggcaacctgctgaagggcgacaagatcaacgggcactccatccacaagatcgagccccacctcaacacgagctggatgtcctgggacggctgcgacctggactactactgcaacatgggggactggcccagctgcacctacaccggcgtgacccagcacaaccacgccgccttcgtgaacctgctcaacatcgagacggactacaccaagtccttccacttccacagcaagcgggtcaccgcccacggggacaccccgcagctggacctgaaggcccgccccatgtacggcgcgggcgagatcacggtgctcgtcgaggtggccgacatggagctgcactccaagaacatcgagatcagcgggctgaagttcgcctccctgacctgcagcggctgctacgcctgctccagcgggatcagctgcaaggtgcggatccacgtcgacgagcccgacgagctcgccgtgcacgtgaagtccgacgacctggacgtcgtggcggccagctccagcctcatggcccgcaagatcgagttcggcaccgactccaccttcaaggccttcagctccatgcccaaggagagcctgtgcttctacatcgtggagcgggacttctgcaagtcctgcgccgcggaggacacgcagaagtgcgtcaaggccaagctggagcagccgcagagcatcctcatcgagcacaaggggaccatcatcggcaagcagaacgacacgtgctccaccaagaccagctgctggctggagtccttcaagagcttcttctacggcctgaagaacatgctctccggggtgttcggcagcgccatcatggggatcctgctgttcctcgcccccttcatcctgctgatcctgttcttcttcttcggctggcgcatcctcttctgcctgcggtgctgccgccggacccgcgggctgttcaagtacaagcacatcaaggacgacgaggaggccggctacaagaagatcatcgagaagctcaacaacaagaagggcgggacctccaagctgctggacggcgagcggctcgcggaccgcaagatcgccgagctgttcagcaccaaggcccacatcggg

SEQ ID NO: 12392 - RNA, 1932 nt, synthetic construct
  misc_feature 1..1932: note = derived and/or modified CDS sequence (opt1) from CCHFV(66019)__AB069669.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccaccgcgaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgacggtgtccgtcatggacctcagccagatgtactcccccgtgttcgagtacctgagcggcgaccgccaggtggaggagtggcccaaggcgacctgcaccggcaactgccccgaccggtgcgggtgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaactcccaggagcggcagtgcagcctcatcgaggccggcacccgcttcaacctgggccccgtcaccatcacgctgtccgagccccggaacatccagcagaagctcccgagcgagatcatcaccctgcacccccgcatcgaggaggggttcttcgacctgatgcacgtgcagaaggtgctctccgccagcaccgtctgcaagctgcagtcctgcacccacggcgtgcccggggacctgcagatctaccacatcggcaacctcctgaagggcgaccgggtgaacgggcacctgatccacaagatcgagccccacttcaacacgagctggatgtcctgggacggctgcgacctcgactactactgcaacatgggggactggccgagctgcacctacaccggcgtcacccagcacaaccacgccgccttcgtgaacctgctgaacatcgagacggactacaccaagaacttccacttccactccaagcgcgtgaccgcgcacggggacacgccccagctcgacctgaaggcccggcccacctacggcgccggcgagatcaccgtcctggtggaggtcgccgacatggagctccacaccaagaagatcgccatcagcgggctgaagttcgcgtccctgacctgcacgggctgctacgcctgcagctccgggatcagctgcaaggtgcgcatccacgtggacgagcccgacgagctcaccgtccacgtgaagtccgaggacccggacatcgtggccgccagcagctccctgatggcccggaagctggagttcggcaccgacagcaccttcaaggcgttctccgccatgcccaagacgagcctctgcttctacatcgtcgagcgcgagtactgcgagtcctgcagcaaggaggacacccagaagtgcgtgaacaccaagctggagcagccccagtccatcctgatcgagcacaaggggaccatcatcggcaagcagaacgacacgtgcaccgccaaggccagctgctggctcgagtccgtcaagagcttcttctacggcctgaagaacatgctgtccgggatcttcggcaacgtgttcatcgggatcttcctcttcctggcccccttcatcctgctcatcctgttcttcatgttcggctggcggatcctgttctgcttcaagtgctgccgccggacccgcgggctgttcaagtaccggtacctcaaggacgacgaggagagcggctaccgccgcatcatcgagcggctgaacaacaagaagggcaagaacaagctgctcgacggggagcgcctggcggaccggcgcatcgccgagctgttctccaccaagacccacatcggc

SEQ ID NO: 12393 - RNA, 1932 nt, synthetic construct
  misc_feature 1..1932: note = derived and/or modified CDS sequence (opt1) from CCHFV(7001)__AB069670.1__Gc
  source 1..1932: mol_type = other RNA
ttcctggacaacatcgccaagggcatgaagtccctcctgaacagcaccagcctggagacctccctcagcatcgaggccccctggggcgcgatcaacgtgcagtccacgttcaagccgaccgtcagcgccgccaacatcgccctgtcctggagctccgtggagcaccgcgggaacaagatcctggtgagcgggcggtccgagagcatcatgaagctcgaggagcgcaccggcgtctcctggaacctgggggtggaggacgccagcgagtccaagaccctgacggtgagcgtcatggacctctcccagatgtacagccccgtgttcgagtacctgtccggcgaccgccaggtggaggagtggcccaaggcgacctgcaccggcgactgccccgagcggtgcgggtgcaccagcagcacgtgcctgcacaaggagtggccgcactcccggaactggcgctgcaaccccacctggtgctggggcgtcgggaccggctgcacgtgctgcgggctcgacgtgaaggacttcttcaccgactacatgctggtgaagtggaaggtcgagtacatcaagaccgaggccatcgtgtgcgtggagctgaccagccaggagcggcagtgctccctcatcgaggccggcacccgcttcaacctgggccccgtcacgatcaccctgagcgagccccggaacgtgcagcagcgcctcccgcccgagatcgtgaccctgcaccccaagatcgaggaggggttcttcgacctgatgcacgtccagaagatcctctccgccagcaccgtgtgcaagctgcagtcctgcacgcacggcgtgcccggggacttccaggtctaccacgtgggcaacctgctccggggcgacaaggtgaacgggcacagcatccacaagatcgagccgcacttcaacacctcctggatgagctgggacggctgcgacctggactacttctgcaacatgggggactggccctcctgcacctacaccggcgtcacgcagcacaaccgcgcggccttcatcaacatgctgaacatcgagaccgactacaccaagaccttccacttccacagcaagcgggtgacggcccacggggacacgccccagctcgacctgaaggcccgccccgcctacggcgcgggcgaggtcaccgtgctggtggaggtcgccgacctcgagctgcacaccaagaagctggaggtgtccgggctcaagatcgccagcctgacctgctccggctgctacgcctgcagctccgggatcagctgcaaggtgcggatccacgtcaacgagccggacgagttcaccgtgcacgtgcgctccagcgaccccgacgtcgtggccgcgggcagctccctgatggcccggaagatcgagttcggggccgacagcaccttcaaggccttctccagcatgcccaaggactccctctgcttctacatcgtggagaaggactactgcagctcctgcaccgacgacgacacgcagaagtgcgtcaacaccaagctggaccacccccagagcatcctgatcgagcacaagggcaccatcatcggcaagcagaacgacacgtgctccaccaagaccagctgctggctcgagtccgtgaaggggttcttctacggcctgaagaacatgctgagcgggatcttcggcaacgtgttcctcgggatcttcctgttcctggccccgttcgtcctcctgatcttcttcttcttcttcggctggcgcctcctgttctgcctgaagtgctgccggcgcacccggggcctgctgaagtacaagcacctcaaggacgaggaggaggcggggtacaagaagatcatcgagcgcctgaacggcaagaaggggaagtcccagctgttcgacggcgagcgcctcgccgaccggaagatcgccgagctgttcagcaccaagatccacatcggc

SEQ ID NO: 12394 - RNA, 1932 nt, synthetic construct
  misc_feature 1..1932: note = derived and/or modified CDS sequence (opt1) from CCHFV(75024)__AB069671.1__Gc
  source 1..1932: mol_type = other RNA
ttcctggacagcatcgtgcgcggcatgaagaaccagctcaactccaccagcctggagacctccctgagcatcgaggccccctggggggccatcaacgtccagtccacgtacaagccgaccgtgagcaccgcgaacatcgccctctcctggagctccgtggagcaccggggcaacaagatcctggtcagcgggcgctccgagagcatcatgaagctggaggagcggaccggcatctcctgggacctcggggtggaggacgccagcgagtccaagctgctgacggtgagcgtcatggacctctcccagatgtacagccccgtgttcgagtacctgtccggcgaccgccaggtggaggagtggcccaaggccacctgcaccggcgactgccccgagcggtgcgggtgcaccacgagcacctgcctgcacaaggagtggccgcacagccgcaactggcggtgcaaccccacctggtgctggggcgtcgggaccggctgcacgtgctgcgggctcgacgtgaaggacctgttcaccgactacatgatcgtgaagtggaaggtcgagtacatcaagaccgaggccatcgtgtgcgtggagctgacctcccaggagcgccagtgcagcctcatcgaggcgggcacgcggttcaacctgggctccgtcaccatcaccctgagcgagccccgcaacatccagcagaagctccccccggagatcatcaccctgcacccccggatcgaggaggggttcttcgacctgatgcacgtgcagaaggtgctctccgccagcacggtctgcaagctgcagtcctgcacccacggcgtgcccggggacctgcaggtgtaccacgtcggcaacctcctgaagggcgacaaggtgaacgggcacctgatccacaagatcgagccccacctcaacaccagctggatgtcctgggacggctgcgacctggactactactgcaacatgggggactggccgagctgcacctacacgggcgtgacccagcacaaccacgcctccttcgtcaacctgctcaacatcgagaccgactacaccaagagcttccacttccactccaagcgcgtgacggcccacggggacaccccccagctggacctgaaggcgcggcccacctacggcgccggcgagatcaccgtcctcgtggaggtggccgacatggagttcacgcccaagaagatcgagatcagcgggctgaagttcgcctccctgacctgcaccggctgctacgcctgcagctccgggatcagctgcaaggtccgcatccacgtggacgagccggacgagctcaccgtgcacgtcaagtccgacgaccccgacgtggtggcggccagcagctccctgatggcccggaagctggagttcggcacggacagcaccttcaaggccttctccgccatgcccaagaccagcctctgcttctacatcgtcgagcgcgagtactgcaagtcctgcagcaaggaggacacccagaagtgcgtgaacaccaagctggagcagccccagtccatcctgatcgagcacaaggggacgatcatcggcaagcagaacaacacctgcaccgcgaaggccagctgctggctcgagtccgtgaagagcttcttctacggcctgaagaacatgctgtccgggatcttcggcaacctcttcatggggatcttcctgttcctggccccgttcatcctcctgatcctgttcttcatgttcggctggcggatcctgttctgcttcaagtgctgccgccggacccgcgggctcttcaagtaccggcacctgaaggacgacgaggagacgggctaccgccgcatcatcgagcggctgaacaacaagaagggcaagaacaagctcctggacggggagcgcctggccgaccggcgcatcgccgagctcttcagcaccaagacccacatcggc

SEQ ID NO: 12395 - RNA, 1932 nt, synthetic construct
  misc_feature 1..1932: note = derived and/or modified CDS sequence (opt1) from CCHFV(7803)__AB069672.1__Gc
  source 1..1932: mol_type = other RNA
ttcctggacagcatcgtgcgcggcatgaagaaccccctcaactccaccagcctggagacctccctgagcatcgaggccccgtggggggccatcaacgtccagtccacgtacaagcccaccgtgagcaccgcgaacatcgccctctcctggagctccgtggagcaccggggcaacaagatcctggtcagcgggcgctccgagagcatcatgaagctggaggagcggaccggcatctcctgggacctcggggtggaggacgccagcgagtccaagctgctgacggtgagcgtcatggacctctcccagatgtacagccccgtgttcgagtacctgtccggcgaccgccaggtggaggagtggcccaaggccacctgcaccggcgactgcccggagcggtgcgggtgcaccacgagcacctgcctgcacaaggagtggccccacagccgcaactggcggtgcaaccccacctggtgctggggcgtcgggaccggctgcacgtgctgcgggctcgacgtgaaggacctgttcaccgactacatgatcgtgaagtggaaggtcgagtacatcaagacccgcggcatcgtgtgcgtggagctgacctcccaggagcggcagtgcagcctcatcgaggccggcacgcgcttcaacctggggtccgtcaccatcaccctgagcgagccccggaacatccagcagaagctcccgcccgagatcatcaccctgcacccccgcatcgaggagggcttcttcgacctgatgcacgtgcagaaggtgctctccgcgagcacggtctgcaagctgcagtcctgcacccacggggtgcccggcgacctgcaggtgtaccacgtcggcaacctcctgaagggggacaaggtgaacggccacctgatccacaagatcgagccgcacctcaacaccagctggatgtcctgggacgggtgcgacctggactactactgcaacatgggcgactggcccagctgcacctacacgggggtgacccagcacaaccacgcctccttcgtcaacctgctcaacatcgagaccgactacaccaagagcttccacttccactccaagcgggtgacggcccacggcgacaccccccagctggacctgaaggcccgccccacctacggcgcgggggagatcaccgtcctcgtggaggtggccgacatggagttcacgccgaagaagatcgagatcagcggcctgaagttcgcctccctgacctgcaccgggtgctacgcctgcagctccggcatcagctgcaaggtccggatccacgtggacgagcccgacgagctcaccgtgcacgtcaagtccgacgaccccgacgtggtggccgcgagcagctccctgatggcccgcaagctggagttcgggacggacagcaccttcaaggccttctccgccatgcccaagaccagcctctgcttctacatcgtcgagcgggagtactgcaagtcctgcagcaaggaggacacccagaagtgcgtgaacaccaagctggagcagccgcagtccatcctgatcgagcacaagggcacgatcatcggcaagcagaacaacacctgcaccgccaaggcgagctgctggctcgagtccgtgaagagcttcttctacgggctgaagaacatgctgtccggcatcttcgggaacttcttcatgggcatcttcctcttcctggcccccttcatcctgctcatcctgttcttcatgttcgggtggcgcatcctgttctgcttcaagtgctgccggcgcacccggggcctgttcaagtaccgccacctcaaggacgacgaggagacgggctaccgccggatcatcgagcgcctgaacaacaagaaggggaagaacaagctgctcgacggcgagcggctggccgaccgccggatcgccgagctgttcagcaccaagacccacatcggg

SEQ ID NO: 12396 - RNA, 1932 nt, synthetic construct
  misc_feature 1..1932: note = derived and/or modified CDS sequence (opt1) from CCHFV(79121)__AB069673.1__Gc
  source 1..1932: mol_type = other RNA
ttcctggacagcaccgccaagggcatgaagtccctcctgaacagcacctccctggagacgagcctctccatcgaggccccctggggggcgatcaacgtgcagagcaccttcaagccgaccgtctccgccgccaacatcgccctgagctggtccagcgtggagcaccgcggcaacaagatcctggtgtccgggcggagcgagtccatcatgaagctcgaggagcgcaccggcgtcagctggaacctgggggtggaggacgcctccgagagcaagacgctgaccgtgtccgtcatggacctcagccagatgtactcccccgtgttcgagtacctgagcggcgaccggcaggtggaggagtggcccaaggcgacctgcaccggcgactgccccgagcgctgcgggtgcacgagctccacctgcctgcacaaggagtggccgcacagccggaactggcgctgcaaccccacctggtgctggggcgtcgggaccggctgcacgtgctgcgggctcgacgtgaaggacttcttcaccgactacatgctggtgaagtggaaggtcgagtacatcaagaccgaggccatcgtgtgcgtggagctgacctcccaggagcggcagtgcagcctcatcgaggccggcacgcgcttcaacctgggccccgtcaccatcaccctgtccgagccccggaacgtgcagcagcgcctcccgcccgagatcgtgaccctgcaccccaagatcgaggaggggttcttcgacctgatgcacgtccagaagatcctcagcgcctccacggtgtgcaagctgcagagctgcacccacggcgtgcccggggacttccagatctaccacgtcggcaacctgctccggggcgacaaggtgaacgggcactccatccacaagatcgagccgcacttcaacaccagctggatgtcctgggacggctgcgacctggactacttctgcaacatgggggactggcccagctgcacctacacgggcgtgacccagcacaaccgcgcggccttcatcaacatgctgaacatcgagaccgactacaccaagacgttccacttccactccaagcgggtcaccgcccacggggacaccccccagctcgacctgaaggcccgccccgcctacggcgcgggcgaggtgaccgtcctggtggaggtggccgacctcgagctgcacacgaagaacctggaggtcagcgggctcaagatcgcctccctgacctgcagcggctgctacgcctgctccagcgggatctcctgcaaggtgcggatccacgtgaacgagccggacgagttcaccgtccacgtgcgcagcagcgaccccgacgtggtcgccgcgggctccagcctgatggcccggaagatcgagttcggggccgactccaccttcaaggccttcagctccatgcccaaggacagcctctgcttctacatcgtggagaaggactactgctccagctgcacggacgacgacacccagaagtgcgtgaacaccaagctggaccacccccagtccatcctgatcgagcacaagggcaccatcatcggcaagcagaacgacacctgcagcacgaagacctcctgctggctcgagagcgtcaaggggttcttctacggcctgaagaacatgctgtccgggatcttcggcaacgtgttcctcgggatcttcctgttcctggccccgttcgtgctcctgatcttcttcttcttcttcggctggcgcctgctcttctgcctgaagtgctgccggcgcacccggggcctgctgaagtacaagcacctcaaggacgaggaggaggcggggtacaagaagatcatcgagcgcctgaacggcaagaaggggaagagccagctgttcgacggcgagcgcctcgccgaccggaagatcgccgagctgttctccaccaagatccacatcggc

SEQ ID NO: 12397 - RNA, 1932 nt, synthetic construct
  misc_feature 1..1932: note = derived and/or modified CDS sequence (opt1) from CCHFV(8402)__AB069674.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccgcggccaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgaccgtgtccgtcatggacctcagccagatgtactcccccgtgttcgagtacctgagcggcgaccgccaggtggaggagtggcccaaggccacgtgcaccggcgactgccccgagcggtgcgggtgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcatcaagtggaaggtggagtacatcaagaccgaggcgatcgtctgcgtggagctgacctcccaggagcggcagtgcaccctcatcgaggccggcacccgcttcaacctgggccccgtgacgatcaccctgagcgagccccggaacatccagcagaagctcccgcccgagatcgtcaccctgcacccccgcatcgaggaggggttcttcgacctgatgcacgtgcagaaggtgctctccgccagcaccgtctgcaagctgcagtcctgcacgcacggcgtgcccggggacctccaggtgtaccacatcggcaacctcctgaagggcgacaaggtcaacgggcacctgatccacaagatcgagccgcacttcaacaccagctggatgtcctgggacggctgcgacctcgactactactgcaacatgggggactggcccagctgcacctacaccggcgtgacgcagcacaaccacgccgcgttcgtgaacatgctgaacatcgagaccgactacaccaagaacttccacttccactccaagcgggtcaccgcccacggggacacgccccagctggacctcaaggcccgccccacctacggcgccggcgagatcaccgtgctggtcgaggtggccgacatggagctgcacaccaagaagatcgagatcagcgggctcaagttcgcgtccctgacgtgcaccggctgctacgcctgcagctccgggatcagctgcaaggtgcggatccacgtcgacgagccggacgagctgaccgtgcacgtgaagtccgaggaccccgacatcgtcgccgccagctccagcctcatggcccgcaagctggagttcggcaccgacagcacgttcaaggcgttctccgccatgcccaagaccagcctgtgcttctacatcgtggagcgggagtactgcaagtcctgcagcaaggaggacacccagaagtgcgtgaacaccaagctcgagcagccccagtccatcctgatcgagcacaaggggaccatcatcggcaagcagagcaacacgtgcaccgccaaggcctcctgctggctggagagcgtcaagtccttcttctacggcctcaagaacatgctgagcgggatcttcggcaacgtgttcatcggggtgttcctgttcttcgccccgttcatcctcctgatcctgttcttcatgttcggctggcgcatcctcttctgcttcaagtgctgccggcgcacccgggggctgttcaagtaccgccacctgaaggacgacgaggagaccggctaccggaagatcatcgagcgcctgaacaacaagaagggcaagaacaagctcctggacggggagcgcctggcggaccggaagatcgccgagctgttctccacgaagacccacatcggc

SEQ ID NO: 12398 - RNA, 1932 nt, synthetic construct
  misc_feature 1..1932: note = derived and/or modified CDS sequence (opt1) from CCHFV(88166)__AB069675.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccatgtccgcggccaacatcgccctcagctggtccagcgtggagcaccgcgggaacaagatcctggtgtccgggcggagcgagtccatcatgaagctggaggagcgcaccggcatcagctggaacctcggggtcgaggacgcctccgagagcaagctgctgaccgtgtccgtgatggacctcagccagatgtactcccccgtcttcgagtacctgagcggcgaccgccaggtggaggagtggcccaaggccacgtgcaccggcgactgccccgagcggtgcgggtgcaccagctccacgtgcctgcacaaggagtggccgcacagccggaactggcgctgcaaccccacctggtgctggggcgtggggaccggctgcacgtgctgcgggctcgacgtcaaggacctgttcaccgactacatgttcatcaagtggaaggtggagtacatcaagaccgaggcgatcgtgtgcgtcgagctgacctcccaggagcggcagtgcaccctcatcgaggccggcacccgcttcaacctgggccccgtgacgatcaccctgagcgagccccggaacatccagcagaagctcccgcccgagatcgtgaccctgcacccccgcatcgaggaggggttcttcgacctgatgcacgtccagaaggtgctctccgccagcaccgtgtgcaagctgcagtcctgcacgcacggcgtccccggggacctccaggtgtaccacatcggcaacctgctgaagggcgacaaggtgaacgggcacctgatccacaagatcgagccgcacttcaacaccagctggatgtcctgggacggctgcgacctcgactactactgcaacatgggggactggcccagctgcacctacaccggcgtcacgcagcacaaccacgccgcgttcgtgaacatgctgaacatcgagaccgactacaccaagaacttccacttccactccaagcgggtgaccgcccacggggacacgccccagctggacctcaaggcccgccccacctacggcgccggcgagatcaccgtcctggtggaggtcgccgacatggagctgcacaccaagaagatcgagatcagcgggctcaagttcgcgtccctgacgtgcaccggctgctacgcctgcagctccgggatcagctgcaaggtgcggatccacgtggacgagccggacgagctgaccgtccacgtgaagtccgaggaccccgacctcgtggccgccagctccagcctgatggcccgcaagctggagttcggcaccgacagcacgttcaaggcgttctccgccatgcccaagaccagcctctgcttctacatcgtcgagcgggagtactgcaagtcctgcagcaaggaggacacccagaagtgcgtgaacaccaagctggagcagccccagtccatcctgatcgagcacaaggggaccatcatcggcaagcagaacaacacgtgcaccgccaaggccagctgctggctcgagtccgtcaagagcttcttctacggcctgaagaacatgctgtccgggatcttcggcaacgtgttcatcggggtgttcctcttcttcgccccgttcatcctgctgatcctcttcttcatgttcggctggcgcatcctgttctgcttcaagtgctgccggcgcacccgggggctgttcaagtaccgccacctgaaggacgacgaggagaccggctaccggaagatcatcgagcgcctcaacaacaagaagggcaagaacaagctgctggacggggagcgcctcgcggaccggaagatcgccgagctgttcagcacgaagacccacatcggc

SEQ ID NO: 12399 - RNA, 1932 nt, synthetic construct
  misc_feature 1..1932: note = derived and/or modified CDS sequence (opt1) from CCHFV(BA88166)__AF338470.1__Gc
  source 1..1932: mol_type = other RNA
tacctggacagcatcgtgaagggcatgaagaacctcctgaactccaccagcctggagacctccctcagcatcgaggccccctggggcgccatcaacgtccagtccacgttcaagccgaccatgagcgcggccaacatcgccctgtcctggagctccgtggagcaccgcgggaacaagatcctggtgagcgggcggtccgagagcatcatgaagctcgaggagcgcaccggcatctcctggaacctgggggtcgaggacgccagcgagtccaagctgctcaccgtgagcgtgatggacctgtcccagatgtacagccccgtcttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtggggaccggctgcacgtgctgcgggctggacgtcaaggacctgttcaccgactacatgttcatcaagtggaaggtggagtacatcaagaccgaggcgatcgtgtgcgtcgagctcaccagccaggagcggcagtgcaccctgatcgaggccggcacccgcttcaacctgggccccgtgatcatcacgctctccgagccccggaacatccagcagaagctgccgcccgagatcgtgaccctgcacccccgcatcgaggaggggttcttcgacctcatgcacgtccagaaggtgctgagcgcctccaccgtgtgcaagctgcagagctgcacccacggcgtccccggggacctccaggtgtaccacatcggcaacctgctgaagggcgacaaggtgaacgggcacctcatccacaagatcgagccgcacttcaacacgtcctggatgagctgggacggctgcgacctggactactactgcaacatgggggactggccctcctgcacctacaccggcgtcacccagcacaaccacgccgcgttcgtgaacatgctgaacatcgagacggactacaccaagaacttccacttccacagcaagcgggtgaccgcccacggggacacgccccagctcgacctgaaggcccgccccacctacggcgccggcgagatcaccgtcctggtggaggtcgccgacatggagctccacaccaagaagatcgagatctccgggctgaagttcgcgagcctgacctgcacgggctgctacgcctgctccagcgggatctcctgcaaggtgcggatccacgtggacgagccggacgagctcaccgtccacgtcaagagcgaggaccccgacatcgtggccgcctccagctccctgatggcccgcaagctggagttcggcaccgacagcaccttcaaggcgttcagcgccatgcccaagacgtccctctgcttctacatcgtggagcgggagtactgcaagagctgctccaaggaggacacccagaagtgcgtgaacaccaagctggagcagccccagagcatcctgatcgagcacaaggggaccatcatcggcaagcagaacaacacgtgcaccgccaaggcctcctgctggctcgagagcgtgaagtccttcttctacggcctgaagaacatgctgagcgggatcttcggcaacgtcttcatcggggtgttcctcttcttcgccccgttcatcctgctgatcctcttcttcatgttcggctggcgcatcctgttctgcttcaagtgctgccggcgcacccgggggctgttcaagtaccgccacctgaaggacgacgaggagaccggctaccggaagatcatcgagcgcctcaacaacaagaagggcaagaacaagctgctggacggggagcgcctcgcggaccggaagatcgccgagctgttctccaccaagacgcacatcggc

SEQ ID NO: 12400 - RNA, 1932 nt, synthetic construct
  misc_feature 1..1932: note = derived and/or modified CDS sequence (opt1) from CCHFV(BA66019)__AF350448.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccaccgcgaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgacggtgtccgtcatggacctcagccagatgtactcccccgtgttcgagtacctgagcggcgaccgccaggtggaggagtggcccaaggcgacctgcaccggcgactgccccgaccggtgcgggtgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaactcccaggagcggcagtgcagcctcatcgaggccggcacccgcttcaacctgggccccgtcaccatcacgctgtccgagccccggaacatccagcagaagctcccgcccgagatcatcaccctgcacccccgcatcgaggaggggttcttcgacctgatgcacgtgcagaaggtgctcagcgcctccaccgtctgcaagctgcagagctgcacccacggcgtgcccggggacctgcagatctaccacatcggcaacctcctgaagggcgaccgggtgaacgggcacctgatccacaagatcgagccgcacttcaacacgtcctggatgagctgggacggctgcgacctcgactactactgcaacatgggggactggccctcctgcacctacaccggcgtcacccagcacaaccacgccgccttcgtgaacctgctgaacatcgagacggactacaccaagaacttccacttccacagcaagcgcgtgaccgcgcacggggacacgccccagctcgacctgaaggcccggcccacctacggcgccggcgagatcaccgtcctggtggaggtcgccgacatggagctccacaccaagaagatcgccatctccgggctgaagttcgcgagcctgacctgcacgggctgctacgcctgctccagcgggatctcctgcaaggtgcgcatccacgtggacgagccggacgagctcaccgtccacgtcaagagcgaggaccccgacatcgtggccgcctccagcagcctgatggcccggaagctggagttcggcaccgactccaccttcaaggcgttcagcgccatgcccaagacgtccctctgcttctacatcgtggagcgcgagtactgcgagagctgctccaaggaggacacccagaagtgcgtgaacaccaagctggagcagccccagagcatcctgatcgagcacaaggggaccatcatcggcaagcagaacgacacgtgcaccgccaaggcctcctgctggctcgagagcgtgaagtccttcttctacggcctgaagaacatgctgagcgggatcttcggcaacgtcttcatcgggatcttcctcttcctggccccgttcatcctgctcatcctgttcttcatgttcggctggcggatcctgttctgcttcaagtgctgccgccggacccgcgggctgttcaagtaccggtacctcaaggacgacgaggagtccggctaccgccgcatcatcgagcggctgaacaacaagaagggcaagaacaagctgctcgacggggagcgcctggcggaccggcgcatcgccgagctgttcagcaccaagacccacatcggc

SEQ ID NO: 12401 - RNA, 1932 nt, synthetic construct
  misc_feature 1..1932: note = derived and/or modified CDS sequence (opt1) from CCHFV(BA8402)__AF350449.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccgcggccaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgaccgtgtccgtcatggacctcagccagatgtactcccccgtgttcgagtacctgagcggcgaccgccaggtggaggagtggcccaaggccacgtgcaccggcgactgccccgagcggtgcgggtgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcatcaagtggaaggtggagtacatcaagaccgaggcgatcgtctgcgtggagctgacctcccaggagcggcagtgcaccctcatcgaggccggcacccgcttcaacctgggccccgtgacgatcaccctgagcgagccccggaacatccagcagaagctcccgcccgagatcgtcaccctgcacccccgcatcgaggaggggttcttcgacctgatgcacgtgcagaaggtgctctccgccagcaccgtctgcaagctgcagtcctgcacgcacggcgtgcccggggacctccaggtgtaccacatcggcaacctcctgaagggcgacaaggtcaacgggcacctgatccacaagatcgagccgcacttcaacaccagctggatgtcctgggacggctgcgacctccactactactgcaacatgggggactggcccagctgcacctacaccggcgtgacgcagcacaaccacgccgcgttcgtgaacatgctgaacatcgagaccgactacaccaagaacttccacttccactccaagcgggtcaccgcccacggggacacgccccagctggacctcaaggcccgccccacctacggcgccggcgagatcaccgtgctggtcgaggtggccgacatggagctgcacaccaagaagatcgagatcagcgggctcaagttcgcgtccctgacgtgcaccggctgctacgcctgcagctccgggatcagctgcaaggtgcggatccacgtcgacgagccggacgagctgaccgtgcacgtgaagtccgaggaccccgacatcgtcgccgccagctccagcctcatggcccgcaagctggagttcggcaccgacagcacgttcaaggcgttctccgccatgcccaagaccagcctgtgcttctacatcgtggagcgggagtactgcgagtcctgcagcaaggaggacacccagaagtgcgtgaacaccaagctcgagcagccccagtccatcctgatcgagcacaaggggaccatcatcggcaagcagagcaacacgtgcaccgccaaggcctcctgctggctggagagcgtcaagtccttcttctacggcctcaagaacatgctgagcgggatcttcggcaacgtgttcatcggggtgttcctgttcttcgccccgttcatcctcctgatcctgttcttcatgttcggctggcgcatcctcttctgcttcaagtgctgccggcgcacccgggggctgttcaagtaccgccacctgaaggacgacgaggagaccggctaccggaagatcatcgagcgcctgaacaacaagaagggcaagaacaagctcctggacggggagcgcctggcggaccggaagatcgccgagctgttctccacgaagacccacatcggc

SEQ ID NO: 12402 - RNA, 1932 nt, synthetic construct
  misc_feature 1..1932: note = derived and/or modified CDS sequence (opt1) from CCHFV(Matin)__AF467769.2__Gc
  source 1..1932: mol_type = other RNA
ttcctggacagcatcatcaagggcatgaagaacctcctgaactccaccagcctggagacctccctcagcatcgaggccccctggggcgccatcaacgtgcagtccacgttcaagccgaccatgagcgcggccaacatcgccctgtcctggagctccgtcgagcaccgcgggaacaagatcctggtgagcgggcggtccgagagcatcatgaagctcgaggagcgcaccggcatctcctgggacctgggggtggaggacgccagcgagtccaagctgctcaccgtcagcgtgatggacctgtcccagatgtacagccccgtgttcgagtacctgtccggcgaccggcaggtcgaggagtggcccaaggccacgtgcaccggcgactgccccgagcgctgcgggtgcaccagcagcacgtgcctccacaaggagtggccgcactcccggaactggcgctgcaaccccacctggtgctggggcgtggggaccggctgcacgtgctgcgggctggacgtgaaggacctgttcaccgactacatgttcgtcaagtggaaggtggagtacatcaagaccgaggtgatcgtctgcgtggagctcaccagccaggagcggcagtgctccctgatcgaggcgggcacccgcttcaacctgggccccgtgaccatcacgctcagcgagccccggaacatccagcagaagctgccgcccgagatcgtcaccctgcacccccgcatcgaggaggggttcttcgacctcatgcacgtgcagaaggtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccgcacttcaacacgagctggatgtcctgggacggctgcgacctggactactactgcaacatgggggactggcccagctgctcctacaccggcgtgacccagcacaaccacgccgccttcgtgaacatgctgagcatcgagaccgactacacgaagaacttccacttccactccaagcgggtcaccgcgcacggggacacgccccagctcgacctgaaggcccgccccacctacggcgccggcgagatcaccgtgctggtcgaggtggccgacatggagctccacaccaagaagatcgagatcagcgggctgaagttcgcctccctgacctgcaccggctgctacgcgtgcagctccgggatcagctgcaaggtgcggatccacgtcgacgagccggacgagctcacggtgcacgtgaagtccgaggaccccgacatcgtcgccgccagcagctccctgatggcccgcaagctggagttcggcaccgacagcaccttcaaggccttctccgcgatgcccaagaccagcctctgcttctacatcgtggagcgggagtactgcaagtcctgcagcaaggaggacacgcagaagtgcgtgaacaccaagctggagcagccccagtccatcctgatcgagcacaaggggaccatcatcggcaagcagaacgacacgtgcaccgccaaggccagctgctggctcgagtccgtcaagagcttcttctacggcctgaagaacatgctgtccgggatcttcggcaacgtgttcatcgggatcttcctcttcctggccccgttcgccctgctcatcctgttcttcatgttcggctggcgcatcctgttctgcttcaagtgctgccggcgcacccgggggctgttcaagtaccgccacctcaaggacgacgaggagaccggctaccggaagatcatcgagcgcctgaacaacaagaagggcaagaacaagctgctcgacggggagcgcctggcggaccggaagatcgccgagctgttcagcaccaagacccacgtgggc

SEQ ID NO: 12403 - RNA, 1932 nt, synthetic construct
  misc_feature 1..1932: note = derived and/or modified CDS sequence (opt1) from CCHFV(Baghdad 12)__AJ538197.2__Gc
  source 1..1932: mol_type = other RNA
ttcctcgacagcatcgtgaagggcaccaagaacctcctgaactccaccagcctggagacgtccctcagcatcgaggccccctggggcgccatcaacgtgcagtccacctacaagccgaccgtgagcaccgcgaacatcgccctgtcctggagctccgtggagcaccgcgggaacaagatcctggtcagcgggcggtccgagagcatcatgaagctcgaggagcgcacgggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggcgacctgcaccggcgactgccccgagcggtgcgggtgcacgaccagcacgtgcctccacaaggagtggccgcacagccggaactggcgctgcaaccccacctggtgctggggcgtcgggacgggctgcacgtgctgcgggctggacgtgaaggacctgttcaccgactacatgttcgtgaagtggaaggtcgagtacatcaagaccgacgccatcgtgtgcgtggagctcacctcccaggagcggcagtgcagcctgatcgaggccggcacccgcttcaacctgggctccgtcaccatcaccctcagcgagccccggaacatccagcagaagctgcccccggagatcatcacgctgcacccccgcatcgaggaggggttcttcgacctcatgcacgtgcagaaggtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccccacttcaacaccagctggatgtcctgggacggctgcgacctggactactactgcaacatgggggactggccgagctgcacgtacaccggcgtgacccagcacaaccacgcctccttcgtgaacctgctcaacatcgagaccgactacaccaagagcttccacttccactccaagcgggtcaccgcccacggggacacgccccagctggacctgaaggtgcgccccacctacggcgcgggcgagatcaccgtcctcgtggaggtggccgacatggagctgcacaccaagaagatcgagatcagcgggctgaagttcgcctccctgacctgcaccggctgctacgcctgcagctccgggatcagctgcaaggtccggatccacgtggacgagcccgacgagctcacggtgcacgtcaagtccgacgacccggacgtggtggccgcgagcagctccctgatggcccgcaagctcgagttcggcaccgacagcaccttcaaggccttctccgccatgcccaagaccagcctgtgcttctacatcgtcgagcgggagtactgcaagtcctgcagcaaggaggacacccagaagtgcgtgaacacgaagctggagcagccccagtccatcctcatcgagcacaaggggaccatcatcggcaagcagaacaacacgtgcaccgccaagaccagctgctggctggagtccgtcaagagcttcttctacggcctgaagaacatgctctccgggatcttcggcaacttcttcatggggatcttcctgttcctggcgcccttcatcctcctgatcctgttcttcatgttcggctggcgcatcctgttctgcttcaagtgctgccggcgcacccggggcctcttcaagtaccgccacctgaaggacgacgaggagaccgggtaccggcgcatcatcgagcgcctgaacaacaagaagggcaagaacaagctcctggacggggagcggctggccgaccgccggatcgccgagctgttcagcaccaagacgcacatcggc

SEQ ID NO: 12404 - RNA, 1932 nt, synthetic construct
  misc_feature 1..1932: note = derived and/or modified CDS sequence (opt1) from CCHFV(VLG/TI29414)__AY179961.1__Gc
  source 1..1932: mol_type = other RNA
ttcctggacagcatcgtgaagggcatgaagaacctcctgaactccaccaacctggagaccagcctctccatcgaggccccctggggggccatcaacgtccagagcacgttcaagccgaccgtgtccaccgcgaacatcgccctgagctggtccagcgtggagcaccgcggcaacaagatcctggtcaccgggcggtccgagagcatcatgaagctcgaggagcgcacgggcgtgtcctgggacctgggggtggaggacgccagcgagtccaagctgctcaccgtcagcatcatggacctgtcccagatgtacagccccgtgttcgagtacctgtccggcgaccggcaggtggaggagtggcccaaggccacctgcaccggcgactgccccgagcgctgcgggtgcacgagctccacctgcctccacaaggagtggccgcacagccggaactggcgctgcaaccccacctggtgctgggaggtcggcaccgggtgcacgtgctgcggctggaacgtgaaggacctgttcaccgaccacatgttcgtgaagtggaaggtcgagtacatcaagaccgaggccatcgtgtgcgtggagctgaccagccaggagcggcagtgctccctcatcgaggcggggacgcgcttcaacctgggccccgtcaccatcaccctgagcgagccccggaacatccagcagaagctcccgcccgagatcatcaccctgcaccccaaggtggaggagggcttcttcgacctgatgcacgtgcagaaggtcctctccgccagcacggtgtgcaagctgcagtcctgcacccacgggatccccggcgacctgcaggtgtaccacatcgggaacctcctgaagggcgaccgcgtcaacggccacctgatccacaagatcgagccgcacttcaacaccagctggatgtcctgggacgggtgcgacctcgactactactgcaacatgggcgactggcccagctgcacctacacggggatgacccagcacaaccacgccgccttcgtgaacctgctgaacatcgagaccgactacaccaagacgttccacttccactccaagcgggtgaccgcgcacggcgacaccccccagctcgacctgaaggcccgccccacctacggggccggcgagatcacggtcctggtggaggtcgccgacatggagctccacaccaagaaggtggagatcagcggcctgaagttcgcctccctggcgtgcaccgggtgctacgcctgcagctccggcatcagctgcaaggtgcggatccacgtcgacgagccggacgagctcaccgtgcacgtgaagtccaacgaccccgacgtcatcgccgccagcacgtccctgatggcccgcaagctggagttcgggaccgacagcaccttcaaggcgttctccgccatgcccaagaccagcctctgcttctacatcgccgagcgggagtactgcaagagctgctccgaggaggacacccagaagtgcgtggacacgaagctggagcagccccagagcatcctgatcgagcacaagggcaccatcatcgggaagcagaacgacacctgcaccgccaaggcctcctgctggctcgagagcgtgaagtccttcttctacggcctgaagaacatgctgggcagcgtcttcgggaacttcttcatcggcatcctcctgttcctggcgccgttcgtgctcctggtgctgttcttcatgttcgggtggaagatcctgttctgcttcaagtgctgccgccggacgcgcggcctcctgaagtaccggctgctcaaggacgacgaggagaccgggtaccgccggatcatcgagcgcctgaacaacaagaagggcaagaaccgcctgctcgacggcgagcggctggccgaccgcaagatcgccgagctgttctccaccaagacccacatcggg

SEQ ID NO: 12405 - RNA, 1932 nt, synthetic construct
  misc_feature 1..1932: note = derived and/or modified CDS sequence (opt1) from CCHFV(TADJ/HU8966)__AY179962.1__Gc
  source 1..1932: mol_type = other RNA
ttcctggacagcatcgtgaagggcatgaagaaccccctcaactccaccagcctggagacctccctgagcatcgaggccccgtggggcgccatcaacgtccagtccacgtacaagcccaccgtgagcaccgcgaacatcgccctctcctggagctccatcgagcaccgcgggaacaacatcctggtgagcgggcggtccgagagcatcatgaagctggaggagcgcaccggcatctccggggacctcggcgtcgaggacgccagcgagtccaagctgctgacggtgagcgtgatggacctctcccagatgtacagccccgtcttcgagtacctgtccggcgaccgccaggtggaggagtggcccaaggcgacctgcaccggggactgcccggagcggtgcggctgcaccagcagcacgtgcctgcacaaggagtggccccactcccggaactggcgctgcaaccccacctggtgctggggcgtggggaccgggtgcacgtgctgcggcctcgacgtcaaggacctgttcatcgactacatgttcgtgaagtggaaggtggactacatcaagaccgaggccatcgtctgcgtggagctgaccagccaggagcggcagtgctccctcgtggaggccggcacccgcttcaacctggggcccgtcaccatcacgctgagcgagccgcggaacatccagcagaagctcccgcccgagatcatcaccctgcacccccgcatcgaggagggcttcttcgacctgatgcacgtgcagaaggtgctctccgccagcaccgtctgcaagctgcagtcctgcacccacggggtgcccggcgacctccaggtgtaccacatcggcaacctcctgaagggggacaaggagaacggccacctgatccacaagatcgagccccacttcaacacgagctggatgtcctgggacgggtgcgacctcgactactactgcaacatgggcgactggcccagctgcacctacaccggggtcacccagcacaaccacgcctccttcgtgaacctgctgaacatcgagacggactacaccaagagcttccacttccactccaagcgggtgaccgcccacggcgacacgccccagctcgacctgaaggcgcgcccgacctacggcgccggggagatcaccgtcctggtggaggtcgccgacatggagctccacaccaagaagatcgagatcaccggcctgaagttcgccagcctgacgtgcaccgggtgctacgcctgctccagcggcatctcctgcaaggtgcggatccacgtggacgagcccgacgagctcaccgtccacgtcaagagcgacgaccccgacgtggtggcggcctccagcagcctgatggcccgcaagctggagttcgggaccgactccacgttcaaggccttcagcgccatgcccaagacctccctctgcttctacatcgtggagcgggagtaccgcaagagctgctccaaggaggacacccagaagtgcgtgaacaccaagctggagcagccgcagagcatcctgatcgagcacaagggcaccatcatcggcaagcagaacaacacgtgcaccgcgaaggcctcctgctggctcgagagcgtcaagtccttcttctacgggctgaagaacatgctgagcggcatcttcgggaacgtgttcgtgggcatcttcctcttcctggcccccttcatcctgctcatcctgttcttcatgttcgggtggcggatcctgtcctgcttcaagtgctgccgccggacccgcggcctgctcaagcaccggcacctgaaggacgacgaggagaccggctaccgccgcatcatcgagcggctgaacaacaagaaggggaagaacaagctcctggacggcgagcgcctggccgaccggcgcatcgccgagctgttcagcacgaagacccacatcggg

SEQ ID NO: 12406 - RNA, 1932 nt, synthetic construct
  misc_feature 1..1932: note = derived and/or modified CDS sequence (opt1) from CCHFV(Hodzha)__AY223476.1__Gc
  source 1..1932: mol_type = other RNA
ttcctggacagcatcgtgaagggcaccaagaacctcctgaactccaccagcctggagacgtccctcagcatcgaggccccctggggggccatcaacgtccagtccacctacaagccgaccgtgagcaccgcgaacatcgccctgtcctggagctccgtggagcaccgcggcaacaagatcctggtcagcgggcggtccgagagcatcatgaagctcgaggagcgcacgggcatctcctgggacctgggggtggaggacgccagcgagtccaagctgctcaccgtgagcgtcatggacctgtcccagatgtacagccccgtgttcgagtacctgtccggcgaccggcaggtggaggagtggcccaaggccacctgcaccggcgactgccccgagcgctgcgggtgcacgagcagcacctgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggccatcgtgtgcgtggagctcaccagccaggagcggcagtgctccctggtcgaggcgggcacgcgcttcaacctgggccccgtgaccatcaccctcagcgagccccggaacatccagcagaagctgccgcccgagatcatcaccctgcacccccgcatcgaggaggggttcttcgacctcatgcacgtgcagaaggtcctgtccgccagcacggtgtgcaagctgcagtcctgcacccacggcgtgcccggggacctccaggtctaccacatcggcaacctgctgaagggcgacaaggtgaacgggcacctcatccacaagatcgagccgcacttcaacaccagctggatgtcctgggacggctgcgacctggactactactgcaacatgggggactggcccagctgcacctacacgggcgtgacccagcacaaccacgcctccttcgtcaacctgctcaacatcgagaccgactacaccaagagcttccacttccactccaagcgggtgacggcccacggggacaccccccagctggacctgaaggcgcgccccacctacggcgccggcgagatcaccgtcctcgtggaggtggccgacatggagctgcacacgaagaagatcgagatcaccgggctgaagttcgccagcctcacctgcaccggctgctacgcctgctccagcgggatctcctgcaaggtccggatccacgtggacgagccggacgagctgacggtgcacgtcaagagcgacgaccccgacgtggtggcggcctccagcagcctgatggcccgcaagctcgagttcggcaccgactccaccttcaaggccttcagcgccatgcccaagacctccctgtgcttctacatcgtcgagcgggagtactgcaagagctgctccaaggaggacacccagaagtgcgtgaacacgaagctggagcagccccagagcatcctcatcgagcgcaaggggaccatcatcggcaagcagaacaacacctgcaccgcgaaggcctcctgctggctggagagcgtgaagtccttcttctacggcctgaagaacatgctcagcgggatcttcggcaacgtcttcgtggggatcttcctgttcctggccccgttcatcctcctgatcctgttcttcatgttcggctggcggatcctgttctgcttcaagtgctgccgccggacgcgcgggctcttcaagtacaagcacctgaaggacgacgaggagaccggctaccggcgcatcatcgagcgcctgaacaacaagaagggcaagaacaagctcctggacggggagcggctggccgaccgccggatcgccgagctcttctccaccaagacccacatcggc

SEQ ID NO: 12407 - RNA, 1932 nt, synthetic construct
  misc_feature 1..1932: note = derived and/or modified CDS sequence (opt1) from CCHFV(Kosovo/9553/2001)__AY675511.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaagatcgaggaggggttcttcgacctgatgcacgtgcagaaggtcctcagcgcctccacggtgtgcaagctgcagagctgcacccacggcatccccggggacctgcaggtgtaccacatcggcaacctcctgaagggcgaccgcgtcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcaccgtgcacgtcaagagctccgaccccgacgtggtggccgccagcacgtccctgatggcccgcaagctggagttcggcaccgacagcaccttcaaggcgttcagcgccatgcccaagacctccctctgcttctacatcgtcgagaaggagtactgcaagagctgctccgaggacgacaccaagaagtgcgtggacacgaagctggagcagccccagagcatcctgatcgagcaccgggggaccatcatcggcaagccgaacgacacctgccccgccaagacctcctgctggctcgagagcgtgaagtccttcttctacggcctgaagaacatgctggggagcgtcttcggcaacttcttcatcgggatcctcctgttcctggcccccttcttcctctggatgctgtccttcatgttcggctggaagatcctgttctgcttcaagtgctgccgccggacgcgcgggctgttcaagtaccggcacctcaaggacgacgaggagaccggctaccgccggatcatcgagcgcctgaacaacaagaagggcaagaaccgcctgctcgacggggagcggctggccgaccgcaagatcgcggagctgttcagcaccaagacccacatcggc

SEQ ID NO: 12408 - RNA, 1932 nt, synthetic construct
  misc_feature 1..1932: note = derived and/or modified CDS sequence (opt1) from CCHFV(SPU41/84)__AY900142.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcggcagtgctccctgatcgaggccggcacccgcttcaacctgggccccgtcacgatcaccctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcgtgcacaagatcgagccgcacttcaacaccagctggatgtcctgggacggctgcgacctggactactactgcaacatgggggactggcccagctgcacctacaccggcgtgacgcagcacaaccacgcctccttcgtcaacatgctgaacatcgagaccgactacaccaagaacttccacttccacagcaagcgggtgaccgcccacggggacacgccccagctcgacctgaaggcgcgccccacctacggcgccggcgagatcaccgtcctggtggaggtggccgacatggagctccacaccaagaagatcgagatctccgggctgaagttcacgagcctgacctgcaccggctgctacgcctgctccagcgggatctcctgcaaggtccggatccacgtggacgagccggacgagctcaccgtgcacgtcaagagcgaggaccccgacgtggtggccgcgtccagcagcctgatggcccgcaagctggagttcggcacggactccaccttcaaggccttcagcgccatgcccaagacctccctctgcttctacatcgtcgagcgggagtactgcaagagctgctccgaggaggacacccagaagtgcgtgaacaccaagctggagcagccccagagcatcctgatcgagcgcaaggggacgatcatcggcaagcagaacaacacgtgcaaggccaaggcgggctgctggctcgagtccgtcaagagcttcttctacgggctgaagaacatgctgtccggcatcttcgggaacgtgttcatcggcatcttcctcttcctggccccgttcatcctgctcatcctgttcttcatgttcgggtggcggatcctgttctgcttcaagtgctgccgccggacccgcggcctgttcaagtaccggcacctcaaggacgacgaggagaccggctaccgcaagatcatcgagcgcctgaacaacaagaaggggaagaacaagctgctcgacggcgagcggctggccgaccgccggatcgccgagctgttcagcaccaagacccacatcggg

SEQ ID NO: 12409 - RNA, 1932 nt, synthetic construct
  misc_feature 1..1932: note = derived and/or modified CDS sequence (opt1) from CCHFV(UG3010)__AY900143.1__Gc
  source 1..1932: mol_type = other RNA
tacctggacagcatcgccaagggcatgaagtccctcctgaacagcaccaacctggagacctccctcagcatcgaggccccctggggcgcgatcaacgtgcagtccacgttcaagccgaccgtcagcgccgccaacatcgccctgtcctggagctccgtggagcaccgcgggaacaagatcctggtgagcgggcggtccgagagcatcatgaagctcgaggagcgcaccggcatctcctggagcctgggggtcgaggacgcctccgagagcaagaccctgacggtgtccgtgatggacctcagccagatgtactcccccgtcttcgagtacctgagcggcgaccgccaggtggaggagtggcccaaggcgacctgcaccggcgactgccaggagcggtgcgggtgcaccagctccacgtgcctgcacaaggagtggccccacagccggaactggcgctgcaacccgacctggtgctggggcgtggggaccggctgcacgtgctgcgggctcgacgtccgggacctgttcaccgactacatgatggtgaagtggaaggtggagtacgtcaagaccgaggccatcatgtgcgtggagctgacctcccaggagcgccagtgcagcctcatcgaggccggcacccggttcaacctgggccccgtgacgatcaccctgtccgagccccgcaacatccagcagcggctccccagcgagatcgtcaccctgcacccgaagatcgaggaggggttcttcgacctgatgcacgtgcagaaggtgctctccgccagcaccgtctgcaagctgcagtcctgcacgcacggcgtgcccggggacctccaggtgtaccacgtcggcaacctcctgaagggcgacaaggtgaacgggcacagcatccacaagatcgagtcccacttcaacaccagctggatgtcctgggacggctgcgacctggactacttctgcaacatgggggactggcccagctgcacctacaccggcgtgacgcagcacaaccgcgcggccttcatcaacatgctcaacatcgagaccgactacaccaagaccttccacttccactccaagcgggtcacggcccacggggacacgccccagctggacctgaaggcccgcccgacctacggcgccggcgaggtgaccgtcctcgtggaggtggcggacctggagctgcacaccaagaagatcgaggtcagcgggctcaagttcgcctccctgacctgcagcggctgctacgcctgctccagcgggatcagctgcaaggtgcggatccacgtgaacgagcccgacgagttcaccgtccacgtgaagtccagcgaccccgacgtggtcgccgccggctccagcctgatggcgcgcaagatcgagttcggggccgactccaccttcaaggccttcagctccatgcccaagaacagcctctgcttctacatcgtggagcgggactactgctccagctgcacgaacgacgacacccagaagtgcgtggacaccaagctggagcacccgcagtccatcctgatcgagcacaagggcaccatcatcggcaagcagaacgacacgtgcagcaccaagacctcctgctggctcgagagcgtcaagtccttcttctacgggctgaagaacatgctgggcgggatcttcggcaacgtgttcctcgggatcttcctgttcctggcccccttcgccctcctgatcttcttcttcttcttcggctggcgcctgctgttctgcctgaagtgctgccggcgcacccggggcctgctgaagtacaagcagctcaaggacgaggaggaggcggggtacaagaagatcatcgagcgcctgaacgacaagaagggcaagagccgcctgttcgacggggagcggctcgccgaccgcaagatcgccgagctgttctccaccaagacgcacatcggc

SEQ ID NO: 12410 - RNA, 1932 nt, synthetic construct
  misc_feature 1..1932: note = derived and/or modified CDS sequence (opt1) from CCHFV(Hy13)__AY900145.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccgcggccaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgaccgtgtccatcatggacctcagccagatgtactcccccgtcttcgagtacctgagcggcgaccgccaggtggaggagtggcccaaggccacgtgcaccggcgactgccccgagcggtgcgggtgcaccagctccacgtgcctgcacaaggagtggccgcacagccggaactggcgctgcaaccccacctggtgctggggcgtggggaccggctgcacgtgctgcgggctcgacgtcaaggacctgttcaccgaccacatgttcgtgaagtggaaggtggagtacatcaagaccgaggcgatcgtctgcgtggagctgacctcccaggagcggcagtgcagcctcatcgaggccggcacccgcttcaacctgggccccgtgaccatcacgctgtccgagccccggaacatccagcagaagctcccgcccgagatcgtcaccctgcacccccgcatcgaggaggggttcttcgacctgatgcacgtgaagaaggtgctcagcgcctccaccgtctgcaagctgcagagctgcacccacggcgtgcccggggacctccaggtgtaccacatcggcaacctgctgaagggcgacaaggtcaacgggcacctgatccacaagatcgagccgcacttcaacacgtcctggatgagctgggacggctgcgacctcgactactactgcaacatgggggactggccctcctgcagctacaccggcgtgacccagcacaaccacgccgcgttcgtgaacatgctgaacatcgagaccgactacacgaagatcttccacttccactccaagcgggtcaccgcccacggggacacgccccagctggacctcaaggcccgccccacctacggcgccggcgagatcaccgtgctggtcgaggtggccgacatggagctgcacaccaagaagatcgagatcagcgggctcaagttcgcgtccctgacctgcaccggctgctacgcctgcagctccgggatcagctgcaaggtgcggatccacgtcgacgagccggacgagctgacggtgcacgtgaagtccgaggaccccgacatcgtcgccgccagcagctccctcatggcccgcaagctggagttcggcaccgacagcaccttcaaggcgttctccgccatgcccaagaccagcctgtgcttctacatcgtggagcgggagtactgcaagtcctgcagcaaggaggacacgcagaagtgcgtgaacaccaagctcgagcagccccagtccatcctgatcgagcacaaggggaccatcatcggcaagcagaacgacacgtgcaccagcaaggccggctgctggctggagtccgtcaagagcttcttctacgggctcaagaacatgctgtccggcatcttcgggaacgtgttcatcggcatcttcctgttcctcgccccgttcatcctgctgatcctcttcttcatgttcgggtggcgcatcctgttctgcttcaagtgctgccggcgcacccggggcctgttcaagtaccgccacctgaaggacgacgaggagaccggctaccggaagatcatcgagcgcctcaacaacaagaaggggaagaacaagctgctggacggcgagcgcctcgccgaccggaagatcgcggagctgttcagcaccaagacccacatcggg

SEQ ID NO: 12411 - RNA, 1932 nt, synthetic construct
  misc_feature 1..1932: note = derived and/or modified CDS sequence (opt1) from CCHFV(Semunya)__DQ094832.1__Gc
  source 1..1932: mol_type = other RNA
ttcctggacagcatcgccaagggcaagaagtccctcctgaacagcaccaacctggagacctccctcagcatcgaggccccctggggcgcgatcaacgtgcagtccacgttcaagccgaccgtgagcgccgccaacatcgccctgtcctggagctccgtggagcaccgcgggaacaagatcctggtgagcgggcggtccgagagcatcatgaagctcgaggagcgcaccggcatctcctggagcctgggggtcgaggacgcctccgagagcaagaccctgacggtgtccgtgatggacctcagccagatgtactcccccgtcttcgagtacctgagcggcgaccgccaggtggaggagtggcccaaggcgacctgcaccggcgactgccccgagcggtgcgggtgcaccagctccacgtgcctgcacaaggagtggccgcacagccggaactggcgctgcaaccccacctggtgctggggcgtggggaccggctgcacgtgctgcgggctcgacgtccgggacctgttcaccgactacatgatggtgaagtggaaggtggagtacgtcaagaccgaggccatcatgtgcgtggagctgacctcccaggagcgccagtgcagcctcatcgaggccggcacccggttcaacctgggccccgtgacgatcaccctgtccgagccccgcaacgtccagcagcggctcccgagcgagatcgtgaccctgcaccccaagatcgaggaggggttcttcgacctgatgcacgtgcagaaggtcctcttctgcaagtactccctgcaggccaccagctgcacgcacggcgtgcccggggacctccaggtgtaccacgtcggcaacctgctgaagggcgacaaggtgaacgggcactccatccacaagatcgagagccacttcaacacctcctggatgagctgggacggctgcgacctggactacttctgcaacatgggggactggccctcctgcacctacaccggcgtgacgcagcacaaccgcgcggccttcgtcaacatgctcaacatcgagaccgactacaccaagaccttccacttccacagcaagcgggtgacggcccacggggacaccccgcagctggacctgaaggcccgccccacctacggcgccggcgaggtcaccgtgctcgtggaggtcgcggacctggagctgcacacgaagaagatcgaggtgtccgggctcaagttcgccagcctgacctgctccggctgctacgcctgcagctccgggatcagctgcaaggtgcggatccacgtcaacgagcccgacgagttcaccgtgcacgtcaagagcaacgaccccgacgtggtggccgccggctccagcctgatggcgcgcaagatcgagttcggggccgactccaccttcaaggccttcagctccatgccgaagaacagcctctgcttctacatcgtggagcgggactactgctccagctgcacggacgacgacacccagaagtgcgtcaacatcaagctggagcacccccagtccatcctgatcgagcacaagggcaccatcatcggcaagcagaacgacacgtgccccaccaagaccagctgctggctcgagtccgtcaagagcttcttctacgggctgaagaacatgctgggcgggatcttcggcaacgtgttcctcgggatcttcctgttcctggcccccttcgccctcctgatcctgttcttcttcttcggctggcgcctcctgttctgcctgaagtgctgccggcgcacccggggcctgctcaagtacaagcagctgaaggacgaggaggaggcggggtacaagaagatcatcgagcgcctgaacgacaagaagggcaagtcccgcctcttcgacggggagcggctggccgaccgcaagatcgccaagctgttcagcaccaagacccacatcggc

SEQ ID NO: 12412 - RNA, 1932 nt, synthetic construct
  misc_feature 1..1932: note = derived and/or modified CDS sequence (opt1) from CCHFV(SPU128/81/7)__DQ157174.1__Gc
  source 1..1932: mol_type = other RNA
ttcctggacagcatcgtgaagggcatgaagaacctcctgaactccaccagcctggagacctccctcagcatcgaggccccctggggcgccatcaacgtgcagtccacgtacaagccgaccgtgagcaccgcgaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcggcagtgctccctgatcgaggccggcacccgcttcaacctgggccccgtcacgatcaccctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaagatcgagccgcacttcaacaccagctggatgtcctgggacggctgcgacctggactactactgcaacatgggggactggcccagctgcacctacaccggcgtgacgcagcacaaccacgcctccttcgtgaacctgctcaacatcgagaccgactacaccaagaacttccacttccacagcaagcgggtcaccgcccacggggacacgccccagctggacctgaaggcgcgccccacctacggcgccggcgagatcaccgtgctcgtcgaggtggccgacatggagctgcacaccaagaagatcgagatctccgggctgaagttcgccagcctcacgtgcaccggctgctacgcctgctccagcgggatctcctgcaaggtgcggatccacgtcgacgagccggacgagctgaccgtgcacgtcaagagcgacgaccccgacgtggtggcggcctccagcagcctgatggcccgcaagctcgagttcggcaccgactccacgttcaaggccttcagcgccatgcccaagacctccctgtgcttctacatcgtggagcgggagcactgcaagagctgctccgaggaggacaccaagaagtgcgtcaacaccaagctggagcagccccagagcatcctcatcgagcacaaggggaccatcatcggcaagcagaactccacgtgcaccgcgaaggccagctgctggctggagtccgtcaagagcttcttctacggcctgaagaacatgctctccgggatcttcggcaacgtgttcatcgggatcttcctgttcctgggcccgttcatcctcctgatcctgttcttcatgttcgggtggcgcatcctgttctgcttcaagtgctgccggcgcacccggggcctcctgaagtaccgccacctgaaggaggacgaggagaccggctaccggcgcatcatcgagcgcctcaacaacaagaaggggaagaacaagctgctggacggcgagcggctcgccgaccgccggatcgccgagctgttcagcacgaagacccacatcggg

SEQ ID NO: 12413 - RNA, 1932 nt, synthetic construct
  misc_feature 1..1932: note = derived and/or modified CDS sequence (opt1) from CCHFV(ROS/HUVLV-100)__DQ206448.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagcgggagtactgcaagagctgctccgaggaggacacccagaagtgcgtggacacgaagctggagcagccccagagcatcctgatcgagcacaaggggaccatcatcggcaagcagaacgacacctgcaccgccaaggcctcctgctggctcgagagcgtcaagtccttcttctacggcctgaagaacatgctggggagcgtgttcggcaacttcttcatcgggatcctcctgttcctggccccgttcgtgctcctggtcctgttcttcatgttcggctggaagatcctgttctgcttcaagtgctgccgccggacgcgcgggctcctgaagtaccggctgctcaaggacgacgaggagaccggctaccgccggatcatcgagcgcctgaacaacaagaagggcaagaaccgcctgctcgacggggagcggctggcggaccgcaagatcgccgagctgttctccaccaagacccacatcggc

SEQ ID NO: 12414 - RNA, 1932 nt, synthetic construct
  misc_feature 1..1932: note = derived and/or modified CDS sequence (opt1) from CCHFV(AP92)__DQ211625.1__Gc
  source 1..1932: mol_type = other RNA
ttcctggacagcatcgccaagggcgtgaagaacctcctgaactccaccagcctggagacctccctcagcatcgaggccccctggggggcgatcaacgcccagtccacgtacaagccgaccgccagctccgccaacatcgccctgacctggagctccgtcgagcaccgcggcaacaagatcctggtgagcgggcggtccgagagcatcatgaagctcgaggagcgcaccggcatctcctggaacctgggggtggaggacgcgagcgagtcccggacgctgaccatcagcgtcatggacctctcccagatgtacagccccgtgttcgagtacctgtccggcgaccgccaggtggaggagtggcccaaggccacctgcaccggcaactgccccgagcggtgcgggtgcacgagcagcacctgcctgtacaaggagtggccgcactcccgcaactggcggtgcaaccccacctggtgctggggcgtcgggaccggctgcacgtgctgcgggctcgacgtgaaggagctgttcaccgaccacatgctggtgaagtggaaggtcgagtacatcaagaccgaggccatcgtgtgcgtggagctcaccagccaggagcgccagtgctccctgatcgaggccggcacgcggttcagcctgggccccgtcaccatcaccctctccgagccccgcaacatccagcagaagctgccgcccgagctgatcaccctccaccccaagatcgaggacgggtacttcgacctgatgcacgtgcagaaggtgatgagcgcgtccacggtctgcaagctgcagagctgcacccacggcgtgcccggggacctccagatctaccacgtgggcaacctgctgaagggcgaccgggtcaacgggcacctcatccacaaggtggagccgcacctgaacacctcctggatgagctgggacggctgcgacctggactacttctgcaacatgggggactggccctcctgcacctacacgggcgtgacccagcacaaccacgccgccttcgccaacctcctgaacatcgagaccgactacaccaagacgttccacttccacagcaagcgcgtcaccgcccacggggacaccccccagctggacctcaaggcgcggccccgctacggcgccggcgagatcaccgtgctggtggaggtcgccgacatggagctgcacacgaagaaggtggaggtcaccgggctcaagttcgcctccctgacctgcagcggctgctacgcctgctccagcgggatctcctgcaaggtgcggatccacgtggacgagccggacgagctgaccgtccacgtgaagagctccgaccccgacatcgtggcggccagcagctccctcatggcccgcaagatcgagttcggcgtcgacagcacgttcaaggccttctccagcatgcccaaggactccctgtgcttctacatcgtggagcgggactactgcaacagctgcaagaacgaggagacccagcgctgcgtgaacgccaagctggagcagccccagtccatcctcatcgagcacaccgggaccatcatcggcaagcagaacgacacctgcggcagccggacgtcctgctggctggacagcttcaagtccttcttctacgggctgaagagcatgctctccggcatcttcgggaacgtcttcctgggcatcttcctgttcctcgcgccgttcgccctgctgctgttcttcttcttcttcgggtggcgcatcctcttctgcttcaagtgctgccggcgcacccgcggcctgttcaagtaccggcacatcaaggacgacgaggaggtgggctacaagaagatcatcgagcgcctgaacaacaagaaggggaagcaccggctcctggacggcgagcgcctggccgaccggaagatcgccgagctcttcagcaccaagacccacatcggg

SEQ ID NO: 12415 - RNA, 1932 nt, synthetic construct
  misc_feature 1..1932: note = derived and/or modified CDS sequence (opt1) from CCHFV(ArD8194)__DQ211626.1__Gc
  source 1..1932: mol_type = other RNA
ttcctggaccgcatcgccaagggcatgaagtccctcctgaacagcaccagcctggagacctccctcagcatcgaggccccctggggcgcgatcaacgtgcagtccacgttcaagccgaccgtcagcgccgccaacatcgccctgtcctggagctccgtggagcacaaggggaacaagatcctggtgagcgggcggtccgagagcatcatgaagctcgaggagcgcaccggcatctcctggtgcctgggggtcgaggacgccagcgagtccaagaccctgacggtgagcgtgatggacctctcccagatgtacagccccgtcttcgagtacctgtccggcgaccgccaggtggaggagtggcccaaggcgacctgcaccggcgactgccccgagcggtgcgggtgcaccagcagcacgtgcctgcacaaggagtggccgcactcccggaactggcgctgcaaccccacctggtgctggggcgtggggaccggctgcacgtgctgcgggctcgacgtcaaggacctgttcaccgactacatgctggtgaagtggaaggtggagtacatcaagaccgaggccatcatctgcgtcgagctcaccagccaggagcggcagtgctccctgatcgaggccggcacccgcttcaacctgggccccgtgacgatcaccctcagcgagccccggaacgtgcagcagcgcctgccgcccgagatcatcaccctgcaccccaagatcgaggaggggttcttcgacctcatgcacgtccagaaggtgatgtccgccagcaccgtgtgcaagctgcagtcctgcacgcacggcgtccccggggacctccaggtgtaccacgtgggcaacctcctgaagggcgacaaggtcaacgggcacagcatccacaagatcgagtcccacctgaacaccagctggatgtcctgggacggctgcgacctcgactacttctgcaacatgggggactggccgagctgcacctacaccggcgtgacgcagcacaaccacgcggccttcatcaacatgctgaacatcgagaccgactacaccaagaccttccacttccactccaagcgggtgacggcccacggggacacgccccagctggacctcaaggcccgccccgcctacggcgcgggcgagatcaccgtcctggtggaggtcgccgacctggagctccacaccaagaagatcgaggtgagcgggctgaagttcgcctccctgagctgctccggctgctacgcctgcagctccgggatcagctgcaaggtgcggatccacgtcaacgagcccgacgagttcaccgtgcacgtcaagagcaacgacccggacgtggtggccgcgggctccagcctcatggcccgcaagatcgagtccggggccgacagcaccttcaaggccttctccagcatgcccaagaactccctgtgcttctacatcgtggagcgggactactgcagctcctgcaccgacgacgacacccagaagtgcgtcgacatcaagctggagcacccccagagcatcctcatcgagcacaagggcacgatcatcggcaagcagaacgacacgtgccccaccaagacctcctgctggctggagagcatcaagtccttcttctacgggctgaagaacatgctcagcggcatcttcgggaacgtgttcctgggcatgctgctgttcctggccccgttcatcctgctcatcctgttcttcttcttcgggtggcgcctgctgttctgcctcaagtgctgccggcgcacccggaagctgctgaagtacaagcacctccgcgacgaggaggagtccggctacaagaagatcatcgagcggctgaacgacaagaagggcaagagccgcctgttcgacggggagcgcctcgcggaccggaagatcgccgagctgttctccaccaagacccacatcggc

SEQ ID NO: 12416 - RNA, 1932 nt, synthetic construct
  misc_feature 1..1932: note = derived and/or modified CDS sequence (opt1) from CCHFV(ArD15786)__DQ211627.1__Gc
  source 1..1932: mol_type = other RNA
agcctggactccatcgccaagggcatgaagtccctcctgaacagcaccagcctggagacctccctcagcatcgaggccccctggggcgcgatcaacgtgcagtccacgttcaagccgaccatcagcgccgccaacatcgccctgtcctggagctccgtcgagcacaaggggaacaagatcctggtgagcgggcgctccgagagcatcatgaagctcgaggagcggaccggcatctcctggtgcctgggggtggaggacgccagcgagtccaagaccctgacggtcagcgtgatggacctctcccagatgtacagccccgtgttcgagtacctgagcggcgaccgccaggtcgaggagtggcccaaggcgacctgcaccggcgactgccccgagcggtgcgggtgcacctccagcacgtgcctgcacaaggagtggccgcactcccgcaactggcggtgcaaccccacctggtgctggggcgtggggaccggctgcacgtgctgcgggctcgacgtgaaggacctgttcaccgactacatgctggtcaagtggaaggtggagtacatcaagaccgaggccatcatctgcgtggagctcaccagccaggagcgccagtgctccctgatcgaggccggcacccggttcaacctgggccccgtcacgatcaccctcagcgagccccgcaacgtgcagcagcggctgccgcccgagatcatcaccctgcaccccaagatcgaggaggggttcttcgacctcatgcacgtgcagaaggtcatgtccgccagcaccgtgtgcaagctgcagtcctgcacgcacggcgtgcccggggacctgcaggtctaccacgtgggcaacctcctgaagggcgacaaggtgaacgggcacagcatccacaagatcgagtcccacctgaacaccagctggatgtcctgggacggctgcgacctcgactacttctgcaacatgggggactggccgagctgcacctacaccggcgtcacgcagcacaaccgcgcggccttcatcaacatgctgaacatcgagaccgactacaccaagaccttccacttccactccaagcgggtgacggcccacggggacacgccccagctggacctcaaggcccgccccacctacggcgccggcgagatcaccgtgctggtcgaggtggcggacctggagctccacaccaagaagatcgaggtcagcgggctgaagttcgcctccctgacctgcagcggctgctacgcctgctccagcgggatcagctgcaaggtgcggatccacgtgaacgagcccgacgagttcaccgtccacgtgaagtccaacgacccggacgtggtcgccgccggcagctccctcatggcgcgcaagatcgagagcggggccgactccaccttcaaggccttcagctccatgcccaagaacagcctgtgcttctacatcgtggagcgggactactgctccagctgcacggacgacgacacccagaagtgcgtggacatcaagctggagcacccccagtccatcctcatcgagcacaagggcaccatcatcggcaagcagaacgacacgtgccccaccaagaccagctgctggctggagtccatcaagagcttcttctacgggctgaagaacatgctctccggcatcttcgggaacatcttcctgggcatgctcctgttcctggccccgttcgtcctgctcatcctgttcttcttcttcgggtggcgcctgctgttctgcctcaagtgctgccggcgcacccggaagctgctgaagtacaagcacctccgcgacgaggaggagagcggctacaagaagatcatcgagcggctgaacgacaagaagggcaagtcccgcctgttcgacggggagcgcctcgccgaccggaagatcgcggagctgttcagcaccaagacccacgtgggc

SEQ ID NO: 12417 - RNA, 1932 nt, synthetic construct
  misc_feature 1..1932: note = derived and/or modified CDS sequence (opt1) from CCHFV(ArD39554)__DQ211628.1__Gc
  source 1..1932: mol_type = other RNA
ttcctggacagcaccgccaagtccatgaagtccctcctgaacagcaccagcctggagacgtccctcagcatcgaggccccctggggcgcgatcaacgtgcagtccaccttcaagccgaccgccagcaccgccaacatcgccctgtcctggagctccgtcgagcaccgcgggaacaagatcctggtgacgggccggagcgagtccatcatgaagctcgaggagcgcaccgggatcagctggaacctgggcgtggaggacgcctccgagagcaagaccctgaccgtctccgtgatggacctcagccagatgtactccacggtgttcgagtacctgagcggggaccggcaggtcgaggagtggcccaaggcgacctgcaccggcgactgccccgagcgctgcggctgcaccagctccacgtgcctgcacaaggcctggccccacagccggaactggcgctgcaacccgacctggtgctggggcgtggggaccgggtgcacgtgctgcggcctcgacgtgaagaacctgttcaccgactacatgctgatcaagtggaaggtcgagttcatcaagaccgaggccatcgtgtgcgtggagctcacctcccaggagcggcagtgcagcctgatcgaggccgggacccgcttcaacctgggccccgtcacgatcaccctctccgagccccggaacatccagcagaagctgcccccggagctggtgaccctccacccccgcgtggaggagggcttcttcgacctgatgcacgtccagaaggtgctgagcgcgtccaccgtgtgcaagctccagagctgcacgcacggggtccccggcgacctccaggtgtaccacgtggggaacctgctcaagggcgacaagatcaacggcaactccttccacaagatcgagcccaacctgaacaccagctggatgtcctgggacgggtgcgacctggactactactgcaacatgggcgactggccgagctgcacctacaccggggtcacgcagcacaaccacgccgccttcgtgaacctcctgaacatcgagaccgactacaccaagaacttccacttccactccaagcgggtgaccgcccacggcgagacgccccagctggacctcaaggcccgccccaagtacggggcgggcgaggtcaccgtgctggtcgaggtggccgacatggagctgcacaccaagaagatcgagatcagcggcctcaagttcgcctccctgacctgcacggggtgctacgcctgcagctccggcatcagctgcaaggtgcggctgcacgtcgacgagcccgacgagctcaccgtgcacgtgaagtccgacgacccggacgtcgtggccgcgagcagctccctgatggcccgcaagatcgagttcgggaccgacagcaccttcaaggccttctccagcatgcccaaggacaagctgtgcttctacatcgtggagcgggactactgctccagctgctccaaggaggacacccagaagtgcgtcaacgccaagctcgagcagccccagagcatcctgatcgagcacaagggcacgatcatcgggaagcagaacgacacgtgcaccgtgaaggcctcctgctggctggagagcgtgaagtccttcttctacggcctcaagaacatgctgggcgggatcttcggcaacgtcatcctggggatcatcatgttcctcgcgcccttcgccctgctgctcctgttcttcctgttcggctggcgcatcctgttctgcctccggtgctgccgccggacccgcgggctgttcaagtacaagcacatcaaggacgacgaggagagcggctacaagcggatcatcgagcgcctgaacaacaagaagggcaagaacaagctgttcgacggggagcgcctggccgacaagaagatcgccgagctgttctccaccaagacccacatcggc

SEQ ID NO: 12418 - RNA, 1932 nt, synthetic construct
  misc_feature 1..1932: note = derived and/or modified CDS sequence (opt1) from CCHFV(C-68031)__DQ211629.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccgcggccaacatcgccctcagctggtccagcgtggagcaccgcgggaacaagatcctggtctccgggcggagcgagtccatcatgaagctggaggagcgcaccggcatcagctgggacctcggggtggaggacgcctccgagagcaagctgctgaccgtgtccatcatggacctcagccagatgtactcccccgtcttcgagtacctgagcggcgaccgccaggtggaggagtggcccaaggccacgtgcaccggcgactgccccgagcggtgcgggtgcaccagctccacgtgcctgcacaaggagtggccgcacagccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggcgatcgtctgcgtggagctgacctcccaggagcggcagtgcagcctcatcgaggccggcacccgcttcaacctgggccccgtgaccatcacgctgtccgagccccggaacatccagcagaagctcccgcccgagatcgtcaccctgcacccccgcatcgaggaggggttcttcgacctgatgcacgtgaagaaggtgctcagcgcctccaccgtctgcaagctgcagagctgcacccacggcgtgcccggggacctccaggtgtaccacatcggcaacctgctgaagggcgacaaggtcaacgggcacctgatccacaagatcgagccgcacttcaacacgtcctggatgagctgggacggctgcgacctcgactactactgcaacatgggggactggccctcctgcagctacaccggcgtgacccagcacaaccacgccgcgttcgtgaacatgctgaacatcgagaccgactacacgaagatcttccacttccactccaagcgggtcaccgcccacggggacacgccccagctggacctcaaggcccgccccacctacggcgccggcgagatcaccgtgctggtcgaggtggccgacatggagctgcacaccaagaagatcgagatcagcgggctcaagttcgcgtccctgacctgcaccggctgctacgcctgcagctccgggatcagctgcaaggtgcggatccacgtcgacgagccggacgagctgacggtgcacgtgaagtccgaggaccccgacatcgtcgccgccagcagctccctcatggcccgcaagctggagttcggcaccgacagcaccttcaaggcgttctccgccatgcccaagaccagcctgtgcttctacatcgtggagcgggagtactgcaagtcctgcagcaaggaggacacgcagaagtgcgtgaacaccaagctcgagcagccccagtccatcctgatcgagcacaaggggaccatcatcggcaagcagaacgacacgtgcaccagcaaggccggctgctggctggagtccgtcaagagcttcttctacgggctcaagaacatgctgtccggcatcttcgggaacgtgttcatcggcatcttcctgttcctcgccccgttcatcctgctgatcctcttcttcatgttcgggtggcgcatcctgttctgcttcaagtgctgccggcgcacccggggcctgttcaagtaccgccacctgaaggacgacgaggagaccggctaccggaagatcatcgagcgcctcaacaacaagaaggggaagaacaagctgctggacggcgagcgcctcgccgaccggaagatcgcggagctgttcagcaccaagacccacatcggg

SEQ ID NO: 12419 - RNA, 1932 nt, synthetic construct
  misc_feature 1..1932: note = derived and/or modified CDS sequence (opt1) from CCHFV(Drosdov)__DQ211630.1__Gc
  source 1..1932: mol_type = other RNA
ttcctcgacagcaccgtgaagggcatgaagaacctcctgaactccaccagcctggagacgtccctcagcatcgaggccccctggggcgccatcaacgtccagtccaccttcaagccgaccgtgagcaccgcgaacatcgccctgtcctggagctccgtggagcaccgcgggaacaagatcctggtcacggggcggagcgagtccatcatgaagctcgaggagcgcaccggcgtgagctgggacctgggggtggaggacgcctccgagagcaagctgctcaccgtctccatcatggacctgagccagatgtactcccccgtgttcgagtacctgagcggcgaccgccaggtggaggagtggcccaaggcgacctgcacgggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatgaagaccgaggccatcgtgtgcgtcgagctgacctcccaggagcggcagtgcagcctcatcgaggccggcacccgcttcaacctgggccccgtgaccatcaccctgtccgagccccggaacatccagcagaagctcccgcccgagatcatcacgctgcaccccaagatcgaggaggggttcttcgacctgatgcacgtgcagaaggtcctcagcgcctccaccgtgtgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatggggaactggccctcctgcacgtacaccggcgtcacccagcacaaccacgccgccttcgtgaacctgctgaacatcgagaccgactacacgaagaccttccacttccacagcaagcgggtgaccgcgcacggggacacgccccagctcgacctgaaggcccgccccacctacggcgccggcgagatcaccgtcctggtggaggtcgccgacatggagctccacaccaagaaggtggagatctccgggctgaagttcgccagcctggtgtgcaccggctgctacgcgtgctccagcgggatctcctgcaaggtccggatccacgtggacgagccggacgagctcacggtgcacgtcaagagctccgaccccgacgtggtggccgccagcacctccctgatggcccgcaagctggagttcggcaccgacagcatcttcaaggccttcagcgcgatgcccaagacctccctctgcttctacatcgtcgagcgggagtactgcaagagctgctccgaggacgacaccaagaagtgcgtggacacgaagctggagcagccccagagcatcctgatcgagcacaaggggaccatcatcggcaagcagaacgacacgtgcaccgccaaggcctcctgctggctcgagagcgtgaagtccttcttctacggcctgaagaacatgctggggagcgtcttcggcaacttcttcgtggggatcctcctgttcctggccccgttcgtgctcctggtcctgttcttcatgttcggctggaagatcctgttctgcttcaagtgctgccgccggacccgcggcctcttcaagtaccggcacctgaaggacgacgaggagaccgggtaccgccggatcatcgagcgcctgaactccaagaagggcaagaaccgcctcctggacggggagcggctggccgaccgcaagatcgcggagctgttcagcaccaagacccacatcggc

SEQ ID NO: 12420 - RNA, 1932 nt, synthetic construct
  misc_feature 1..1932: note = derived and/or modified CDS sequence (opt1) from CCHFV(Kashmanov)__DQ211631.1__Gc
  source 1..1932: mol_type = other RNA
ttcctggacagcatcgtgaagggcatgaagaactccctcaacagcacctccctggagaccagcctgtccatcgaggccccctggggggccatcaacgtccagagcacgttcaagccgaccgtgtccaccgcgaacatcgccctcagctggtccagcgtggagcaccgcggcaacaagatcctggtcaccgggcggtccgagagcatcatgaagctggaggagcgcacgggcgtgtcctgggacctcggggtggaggacgccagcgagtccaagctgctgaccgtcagcatcatggacctctcccagatgtacagccccgtgttcgagtacctgtccggcgaccggcaggtggaggagtggcccaaggccacctgcaccggcgactgccccgagcgctgcgggtgcacgagcagcacctgcctgcacaaggagtggccgcactcccggaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgaccagccaggagcggcagtgctccctgatcgaggcgggcacgcgcttcaacctcggccccgtgaccatcaccctgagcgagccccggaacatccagcagaagctgccgcccgagatcatcaccctccaccccaaggtggaggaggggttcttcgacctgatgcacgtccagaaggtgctgtccgccagcacggtgtgcaagctccagtcctgcacccacggcatccccggggacctgcaggtctaccacatcggcaacctgctcaagggcgaccgcatcaacgggcacctgatccacaagatcgagccgcacttcaacaccagctggatgtcctgggacggctgcgacctggactactactgcaacatgggggactggcccagctgcacctacacgggcgtgacccagcacaaccacgccgccttcgtgaacctcctgaacatcgagaccgactacaccaagacgttccacttccactccaagcgggtcaccgcgcacggggacaccccccagctggacctcaaggcccgccccacctacggcgccggcgagatcacggtgctggtcgaggtggccgacatggagctgcacaccaagaaggtggagatcagcgggctcaagttcgcctccctggcgtgcaccggctgctacgcctgcagctccgggatcagctgcaaggtccggatccacgtggacgagccggacgagctgaccgtgcacgtcaagtccagcgaccccgacgtggtggccgcctccacgagcctcatggcccgcaagctggagttcggcaccgacagcaccttcaaggcgttctccgccatgcccaagaccagcctgtgcttctacatcgtcgagcgggagtactgcaagtcctgcagcgaggaggacacccagaagtgcgtggacacgaagctcgagcagccccagtccatcctgatcgagcacaaggggaccatcatcggcaagcagaacgacacctgcaccgccaaggccagctgctggctggagtccgtgaagagcttcttctacggcctcaagaacatgctggggtccgtcttcggcaacttcttcatcgggatcctgctcttcctggccccgttcgtgctgctcgtgctgttcttcatgttcggctggaagatcctgttctgcttcaagtgctgccgccggacgcgcgggctgctcaagtaccggcacctgaaggacgacgaggagaccggctaccgccggatcatcgagcgcctgaacaacaagaagggcaagaaccgcctcctggacggggagcggctggcggaccgcaagatcgccgagctcttcagcaccaagacccacatcggc

SEQ ID NO: 12421 - RNA, 1932 nt, synthetic construct
  misc_feature 1..1932: note = derived and/or modified CDS sequence (opt1) from CCHFV(Oman)__DQ211632.1__Gc
  source 1..1932: mol_type = other RNA
ttcctcgacagcatcgccaagggcatgaagaacctcctgaactccaccagcctggagacctccctcagcatcgaggccccctggggcgcgatcaacgtgcagtccacgttcaagccgaccgtcagcaccgccaacatcgccctgtcctggagctccgtggagcaccgcgggaacaagatcctggtgagcgggcggtccgagagcatcatgaagctcgaggagcgcaccggcatctcctgggacctgggggtcgaggacgccagcgagtccaagctgctcacggtgagcgtgatggacctgtcccagatgtacagccccgtcttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtggggaccggctgcacgtgctgcgggctggacgtcaaggacctgttcaccgactacatgttcgtgaagtggaaggtggagtacatcaagaccgaggccatcgtctgcgtggagctcaccagccaggagcggcagtgctccctgatcgaggccggcacccgcttcaacctgggccccgtgacgatcaccctcagcgagccccggaacatccagcagaagctgccgcccgagatcgtcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaaggtggagccgcacttcaacaccagctggatgtcctgggacggctgcgacctggactactactgcaacatgggggactggcccagctgcacctacaccggcgtgacgcagcacaaccacgccgcgttcgtcaacctgctcaacatcgagaccgactacaccaagaacttccacttccactccaagcgggtgaccgcccacggggacacgccccagctggacctgaaggcccgccccaactacggcgccggcgaggtcaccgtgctcgtggaggtcgccgacatggagctgcacaccaagaagatcgagatcagcgggctgaagttcgcgtccctgacctgcacgggctgctacgcctgcagctccgggatcagctgcaaggtgcggatccacgtggacgagccggacgagctcaccgtccacgtgaagtccgaggaccccgacatcgtggccgccagctccagcctgatggcccgcaagctcgagttcggcaccgacagcaccttcaaggcgttctccgccatgcccaagacgagcctgtgcttctacatcgtcgagcgggagtactgcaagtcctgcagcaaggaggacacccagaagtgcgtgaacgccaagctggagcgcccccagtccatcctcatcgagcacaaggggaccatcatcggcaagcagaacgacacgtgcaccgccaaggccagctgctggctggagtccgtcaagagcttcttctacggcctgaagaacatgctctccgggatcttcggcaacgtgttcatcgggatcttcctgttcctggcgccgttcatcctcctgatcctgttcttcatgttcggctggcggatcctgttctgcttcaagtgctgccgccggacccgcggcctcttcaagtaccggcacctgaaggacgacgaggagaccgggtaccgcaagatcatcgagcgcctgaacaacaagaagggcaagaacaagctcctggacggggagcggctggccgaccgcaagatcgccgagctgttcagcaccaagacccacatcggc

SEQ ID NO: 12422 - RNA, 1932 nt, synthetic construct
  misc_feature 1..1932: note = derived and/or modified CDS sequence (opt1) from CCHFV(SPU97/85)__DQ211633.1__Gc
  source 1..1932: mol_type = other RNA
ttcctggacagcatcgtgaagggcaagaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccgcacttcaacacgagctggatgtcctgggacggctgcgacctggactactactgcaacatgggggactggcccagctgcacctacaccggcgtgacccagcacaaccacgccgcgttcgtgaacctgctcaacatcgagacggactacaccaagaacttccacttccactccaagcgggtcaccgcccacggggacacgccccagctggacctgaaggcccgccccacctacggcgccggcgaggtgaccgtcctcgtggaggtggccgacatggagctgcacaccaagaagatcgagatcagcgggctgaagttcgcgtccctcagctgcaccggctgctacgcctgctccagcgggatctcctgcaaggtccggatccacgtggacgagccggacgagctgacggtgcacgtcaagagcgaggaccccgacatcgtggccgccggctccagcctgatggcccgcaagctcgagttcggggcggacagcaccttcaaggccttctccgccatgcccaagaccagcctgtgcttctacatcgtggagcgggagtactgcaagtcctgcagccgcgaggacacccagaagtgcgtcaacacgaagctggagcggccccagtccatcctcatcgagcacaagggcaccatcatcggcaagcagaacgacacgtgcaccgccaaggccagctgctggctggagtccgtcaagagcttcttctacgggctgaagtccatgctcagcggcatcttcgggaacgtgttcatcggcatcttcctgttcatcgcgccgttcgtgctgctcatcctgttcttcatgttcgggtggcgcatcctgttctgcttcaagtgctgccggcgcacccggggcctgttcaagtaccgccacctcaaggacgacgaggagaccggctaccgcaagatcatcgagcggctgaacaacaagaaggggaagaacaagctgctcgacggcgagcgcctggccgaccggaagatcgccgagctgttctccaccaagagccacatcggg

SEQ ID NO: 12423 - RNA, 1932 nt, synthetic construct
  misc_feature 1..1932: note = derived and/or modified CDS sequence (opt1) from CCHFV(SPU103/87)__DQ211634.1__Gc
  source 1..1932: mol_type = other RNA
ttcctcgacaacatcgtgaagggcatgaagaacctcctgaacagcacctccctggagaccagcctctccatcgaggccccctggggcgccatcaacgtgcagagcacgtacaagccgaccgtgtccaccgcgaacatcgccctgagctggtccagcgtggagcaccgcgggaacaagatcctggtctccgggcggagcgagtccatcatgaagctcgaggagcgcaccggcatcagctgggacctgggggtggaggacgcctccgagagcaagctgctcacggtgtccgtcatggacctgagccagatgtactcccccgtgttcgagtacctgagcggcgaccgccaggtggaggagtggcccaaggcgacctgcaccggcgactgccccgagcggtgcgggtgcacctccagcacgtgcctccacaaggagtggccgcacagccggaactggcgctgcaaccccacctggtgctggggcgtcgggaccggctgcacgtgctgcgggctggacgtgaaggacctgttcaccgactacatgttcgtgaagtggaagatcgagtacatcaagaccgaggccatcgtctgcgtggagctcacctcccaggagcggcagtgcagcctgatcgaggccggcacccgcttcaacctgggccccgtgacgatcaccctctccgagccccggaacatccagcagaagctgccgagcgagatcatcaccctgcacccccgcatcgaggaggggttcttcgacctcatgcacgtccagaaggtgctgtccgccagcaccgtgtgcaagctgcagtcctgcacgcacggcgtccccggggacctccaggtgtaccacatcggcaacctgctgaagggcgacaaggtgaacgggcacctcgtccacaagatcgagccccacttcaacaccagctggatgtcctgggacggctgcgacctggactactactgcaacatgggggactggccgagctgcacctacaccggcgtgacgcagcacaaccacgcctccttcgtgaacctgctcaacatcgagaccgactacaccaagaacttccacttccacagcaagcgggtcaccgcccacggggacacgccccagctggacctgaaggcgcgccccacctacggcgccggcgagatcaccgtgctcgtcgaggtggccgacatggagctgcacaccaagaagatcgagatctccgggctgaagttcacgagcctgacctgcaccggctgctacgcctgctccagcgggatctcctgcaaggtgcggatccacgtcgacgagcccgacgagctcaccgtgcacgtcaagagcgacgacccggacgtggtggccgcgtccagcagcctgatggcccgcaagctcgagttcggcacggactccaccttcaaggccttcagcgccatgcccaagacctccctgtgcttctacatcgtggagcgggagtactgcaagagctgctccgaggaggacacccagaagtgcgtcaacaccaagctggagcagccccagagcatcctcatcgagcacaaggggacgatcatcggcaagcagaacaacacgtgcaaggcccgcgcgggctgctggctggagtccgtcaagagcttcttctacgggctgaagaacatgctctccggcatcttcgggaacgtgttcatcggcatcttcctgttcctggcccccttcatcctcctgatcctgttcttcatgttcgggtggcggatcctgttctgcttcaagtgctgccgccggacccgcggcctcttcaagtaccggcacctgaaggacgacgaggagaccggctaccgcaagatcatcgagcgcctgaacaacaagaaggggaagaacaagctcctggacggcgagcggctggccgaccgccggatcgccgagctgttcagcaccaagacccacatcggg

SEQ ID NO: 12424 - RNA, 1932 nt, synthetic construct
  misc_feature 1..1932: note = derived and/or modified CDS sequence (opt1) from CCHFV(SPU415/85)__DQ211635.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcatcaccctgcacccccgcatcgaggaggggttcttcgacctcatgcacgtgcagcgggtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccgcacttcaacacgagctggatgtcctgggacggctgcgacctggactactactgcaacatgggggactggcccagctgcacctacaccggcgtgacccagcacaaccacgccgcgttcgtgaacctgctcaacatcgagacggactacaccaagaacttccacttccactccaagcgcgtcaccgcccacggggacacgccccagctggacctgaaggcccggcccacctacggcgccggcgaggtgaccgtcctcgtggaggtggccgacatggagctgcacaccaagaagatcgagatcagcgggctgaagttcgcgtccctgacctgcacgggctgctacgcctgcagctccgggatcagctgcaaggtcaagatccacgtggacgagccggacgagctcaccgtgcacgtcaagtccgaggaccccgacatcgtggccgccggcagctccctgatggcccgcaagctcgagttcggggcggacagcaccttcaaggccttcagcgccatgcccaagacctccctgtgcttctacatcgtggagcgggagtactgcaagagctgctcccgcgaggacacgcggaagtgcgtcaacaccaagctggaccgcccccagagcatcctcatcgagcacaagggcaccatcatcggcaagcagaacaacacgtgcaccgccaaggcctcctgctggctggagagcgtgaagtccttcttctacgggctgaagaacatgctcagcggcatcttcgggaacgtgttcatcggcatcttcctgttcatcgcgccgttcgtcctgctcatcctgttcttcatgttcgggtggcggatcctgttctgcttcaagtgctgccgccggacccgcggcctgttcaagtaccgccacctcaaggacgacgaggagaccggctaccggaagatcatcgagcgcctgaacaacaagaaggggaagaacaagctgctcgacggcgagcggctggccgaccgcaagatcgccgagctgttctccaccaagagccacatcggg

SEQ ID NO: 12425 - RNA, 1932 nt, synthetic construct
  misc_feature 1..1932: note = derived and/or modified CDS sequence (opt1) from CCHFV(Turkey200310849)__DQ211636.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgttcaagccggcggtgagcaccgccaacatcgccctgtcctggagctccgtggagcaccgcgggaacaagatcctggtcaccgggcggagcgagtccatcatgaagctcgaggagcgcaccggcgtgagctgggacctgggggtggaggacgcctccgagagcaagctgctcacggtctccatcatggacctgagccagatgtactcccccgtgttcgagtacctgagcggcgaccgccaggtggaggagtggcccaaggcgacctgcaccggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggccggcacccgcttcaacctgggccccgtgacgatcaccctgtccgagccccggaacatccagcagaagctcccgcccgagatcatcaccctgcaccccaagatcgaggaggggttcttcgacctgatgcacgtgcagaaggtcctcagcgcctccaccgtgtgcaagctgcagagctgcacgcacggcatccccggggacctccaggtgtaccacatcggcaacctgctgaagggcgaccgcgtcaacgggcacctgatccacaagatcgagtcccacttcaacaccagctggatgtcctgggacggctgcgacctcgactactactgcaacatgggggactggccgagctgcacctacaccggcgtgacgcagcacaaccacgccgcgttcgtgaacctgctgaacatcgagaccgactacaccaagaccttccacttccactccaagcgggtcacggcccacggggacacgccccagctcgacctgaaggcccgccccacctacggcgccggcgagatcaccgtgctggtcgaggtggccgacatggagctccacaccaagaaggtggagatcagcgggctgaagttcgcgtccctggcctgcaccggctgctacgcctgcagctccgggatcagctgcaaggtccggatccacgtggacgagcccgacgagctcaccgtgcacgtcaagtccagcgacccggacgtggtggccgcctccaccagcctgatggcgcgcaagctggagttcggcacggacagcaccttcaaggccttctccgccatgcccaagaccagcctctgcttctacatcgtcgagcgggagtactgcaagtcctgcagcgaggacgacacccagaagtgcgtggacacccgcctggagcagccccagtccatcctgatcgagcacaaggggacgatcatcggcaagcagaacgacacgtgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtgctgttcttcatgttcggctggaagatcctcttctgcttcaagtgctgccggcgcacccgggggctgttcaagtaccgccacctgaaggacgacgaggagaccggctaccggcgcatcatcgagcgcctcaacagcaagaagggcaagaaccggctgctggacggggaccgcctcgccgaccggaagatcgccgagctgttctccaccaagacccacatcggc

SEQ ID NO: 12426 - RNA, 1932 nt, synthetic construct
  misc_feature 1..1932: note = derived and/or modified CDS sequence (opt1) from CCHFV(Iran-52)__DQ446215.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaaggtcctggtgagcgggcggtccgagagcatcatgaagctcgaggagcgcaccggcatctcctgggacctgggggtggaggacgccagcgagtccaagctgctcacggtcagcgtgatggacctgtcccagatgtacagccccgtgttcgagtacctgtccggcgaccggcaggtcgaggagtggcccaaggcgacctgcaccggcgactgccccgagcgctgcgggtgcaccagcagcacgtgcctccacaaggagtggccgcactcccggaactggcgctgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcaccagccaggagcggcagtgctccctgatcgaggccggcacccgcttcaacctgggcagcgtgacgatcaccctctccgagccccggaacatccagcagaagctgcccccggagatcatcaccctgcaccccaagatcgaggaggggttcttcgacctcatgcacgtgcagaaggtcctgagcgcctccaccgtgtgcaagctgcagagctgcacgcacggcgtgcccggggacctccaggtctaccacatcggcaacctgctgaagggcgaccgcgtgaacgggcacctcatccacaagatcgagcagcacttcaacacctcctggatgagctgggacggctgcgacctggactactactgcaacatgggggactggccctcctgcacctacaccggcgtgacgcagcacaaccacgccagcttcgtcaacctgctcaacatcgagaccgactacaccaagaccttccacttccactccaagcgggtgacggcccacggggacaccccgcagctggacctgaaggcgcgccccacctacggcgccggcgagatcaccgtcctcgtggaggtggccgacatggagctgcacacgaagaagatcgagatcagcgggctgaagttcgccggcctgacctgcaccgggtgctacgcctgctccagcggcatctcctgcaaggtccggatccacgtggaggagcccgacgagctcaccgtgcacgtcaagagcgacgaccccgacgtggtggcggcctccagcagcctgatggcccgcaagctcgagttcgggacggactccaccttcaaggccttcagcgccatgccgaagacctccctgtgcttctacatcgtcgagcgggagtactgcaagagctgctccaaggaggacacccagaagtgcgtgaacaccaagctggagcagccccagagcatcctcatcgagcacaagggcacgatcatcggcaagcagaacaacacgtgcaccgcgaaggcctcctgctggctggagagcgtgaagtccttcttctacgggctgaagaacatgctcggcgggatcttcggcaacgtcttcatcgggatcttcaccttcctgacccccttcatcctgctcatcctgttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaaccgcctgctcgacggggagcggctggccgaccgcaagatcgccgagctgttcagcaccaagacgcacatcggc

SEQ ID NO: 12427 - RNA, 1932 nt, synthetic construct
  misc_feature 1..1932: note = derived and/or modified CDS sequence (opt1) from CCHFV(Iran-53)__DQ446216.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaaggtcctggtgagcgggcggtccgagagcatcatgaagctcgaggagcgcaccggcatctcctgggacctgggggtggaggacgccagcgagtccaagctgctcacggtcagcgtgatggacctgtcccagatgtacagccccgtgttcgagtacctgtccggcgaccggcaggtcgaggagtggcccaaggcgacctgcaccggcgactgccccgagcgctgcgggtgcaccagcagcacgtgcctccacaaggagtggccgcactcccggaactggcgctgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcaccagccaggagcggcagtgctccctgatcgaggccggcacccgcttcaacctgggcagcgtgacgatcaccctctccgagccccggaacatccagcagaagctgcccccggagatcatcaccctgcaccccaagatcgaggaggggttcttcgacctcatgcacgtgcagaaggtcctgagcgcctccaccgtgtgcaagctgcagagctgcacgcacggcgtgcccggggacctccaggtctaccacatcggcaacctgctgaagggcgaccgcgtgaacgggcacctcatccacaagatcgagcagcacttcaacacctcctggatgagctgggacggctgcgacctggactactactgcaacatgggggactggccctcctgcacctacaccggcgtgacgcagcacaaccacgccagcttcgtcaacctgctcaacatcgagaccgactacaccaagaccttccacttccactccaagcgggtgacggcccacggggacaccccgcagctggacctgaaggcgcgccccacctacggcgccggcgaggtcaccgtgctcgtggaggtcgccgacatggagctgcacacgaagaagatcgagatcagcgggctgaagttcgccggcctgacctgcaccgggtgctacgcctgctccagcggcatctcctgcaaggtgcggatccacgtggacgagcccgacgagctcaccgtccacgtcaagagcgacgaccccgacgtggtggcggcctccagcagcctgatggcccgcaagctcgagttcgggacggactccaccttcaaggccttcagcgccatgccgaagacctccctgtgcttctacatcgtggagcgggagtactgcaagagctgctccaaggaggacacccagaagtgcgtgaacaccaagctggagcagccccagagcatcctcatcgagcacaagggcacgatcatcggcaagcagaacaacacgtgcaccgcgaaggcctcctgctggctggagagcgtcaagtccttcttctacgggctgaagaacatgctcggcgggatcttcggcaacgtgttcatcgggatcttcaccttcctgacccccttcatcctgctcatcctgttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaaccgcctgctcgacggggagcggctggccgaccgcaagatcgccgagctgttcagcaccaagacgcacatcggc

SEQ ID NO: 12428 - RNA, 1932 nt, synthetic construct
  misc_feature 1..1932: note = derived and/or modified CDS sequence (opt1) from CCHFV(Kosova Hoti)__EU037902.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcatcagctgggacctgggggtggaggacgcctccgagagcaagctgctcaccgtgtccatcatggacctgagccagatgtactcccccgtcttcgagtacctgagcggcgaccggcaggtggaggagtggcccaaggccacctgcaccggcgactgcccccagcgctgcgggtgcacgtccagcacctgcctccacaaggagtggccgcacagccggaactggcgctgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcaggtgtaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtcacccagcacaaccacgccgccttcgtgaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtcgccgacatggagctccacaccaagaaggtggagatctccgggctgaagttcgccagcctggcgtgcaccggctgctacgcctgctccagcgggatctcctgcaaggtgcggatccacgtcgacgagccggacgagctcaccgtgcacgtgaagagctccgaccccgacgtcgtggccgccggcacgagcctgatggcccgcaagctggagttcgggaccgactccaccttcaaggcgttcagcgccatgcccaagaccagcctctgcttctacatcgtggagaaggagtactgcaagtcctgcagcgaggacgacaccaagaagtgcgtcgacacgaagctggagcagccccagtccatcctgatcgagcaccggggcaccatcatcggcaagcagaacgacacctgcaccgccaaggccagctgctggctcgagtccgtgaagagcttcttctacgggctgaagaacatgctgggctccgtgttcgggaacttcttcatcggcatcctcctgttcctggccccgttcgtcctcctggtgctgttcttcatgttcgggtggaagatcctgttctgcttcaagtgctgccgccggacgcgcggcctcttcaagtaccggcacctgaaggacgacgaggagaccggctaccgccggatcatcgagcgcctgaacaacaagaaggggaagaaccgcctcctggacggcgagcggctggcggaccgcaagatcgccgagctcttcagcaccaagacccacatcggg

SEQ ID NO: 12429 - RNA, 1932 nt, synthetic construct
  misc_feature 1..1932: note = derived and/or modified CDS sequence (opt1) from CCHFV(YL04057)__FJ562094.1__Gc
  source 1..1932: mol_type = other RNA
ttcctggacagcatcgccaagggcaagaagtccctcctgaacagcacctccctggagaccagcctctccatcgaggccccctggggcgcgatcaacgtgcagagcacgttcaagccgaccgtctccgccgccaacatcgccctgagctggtccagcgtggagcaccgcgggaacaagatcctggtgtccgggcggagcgagtccatcatgaagctcgaggagcgcaccggcgtcagctggaacctgggggtggaggacgcctccgagagcaagaccctgacggtgtccgtcatggacctcagccagatgtactcccccgtgttcgagtacctgagcggcgaccgccaggtggaggagtggcccaaggcgacctgcaccggcgactgccccgagcggtgcgggtgcaccagctccacgtgcctgcacaaggagtggccgcacagccggaactggcgctgctcccccacctggtgctggggcgtcgggaccggctgcacgtgctgcgggctcgacgtgaaggacttcttcaccgactacatgctggtgaagtggaaggtcgagtacatcaagaccgaggccatcgtgtgcgtggagctgaccagccaggagcggcagtgctccctcatcgaggccggcacccgcttcaacctgggccccgtcacgatcaccctgagcgagccccggaacgtgcagcagcgcctcccgcccgagatcgtgaccctgcaccccaagatcgaggaggggttcttcgacctgatgcacgtccagaagatcctctccgccagcaccgtgtgcaagctgcagtcctgcacgcacggcgtgcccggggacttccaggtctaccacgtgggcaacctgctccggggcgacaaggtgaacgggcacagcatccacaagatcgagccgcacttcaacacctcctggatgagctgggacggctgcgacctggactacttctgcaacatgggggactggccctcctgcacctacaccggcgtcacgcagcacaaccgcgcggccttcatcaacatgctgaacatcgagaccgactacaccaagaccttccacttccacagcaagcgggtgacggcccacggggacacgccccagctcgacctgaaggcccgccccgcctacggcgcgggcgaggtcaccgtgctggtggaggtcgccgacctcgagctgcacaccaagaagctggaggtgtccgggctcaagatcgccagcctgacctgctccggctgctacgcctgcagctccgggatcagctgcaaggtgcggatccacgtcaacgagccggacgagttcaccgtgcacgtgcgcagctccgaccccgacgtcgtggccgcgggcagctccctgatggcccggaagatcgagttcggggccgacagcaccttcaaggccttctccagcatgcccaaggactccctctgcttctacatcgtggagaaggactactgcagctcctgcaccgacgacgacacgcagaagtgcgtcaacaccaagctggaccacccccagagcatcctgatcgagcacaagggcaccatcatcggcaagcagaacgacacgtgctccaccaagaccagctgctggctcgagtccgtgaaggggttcttctacggcctgaagaacatgctgagcgggatcttcggcaacgtgttcctcgggatcctgctgttcctcgccccgttcgtcctgctgatcttcttcttcttcttcggctggcgcctcctgttctgcctgaagtgctgccggcgcacccggggcctgctcaagtacaagcacctgaaggacgaggaggaggcggggtacaagaagatcatcgagcgcctgaacggcaagaaggggaagtcccagctgttcgacggcgagcgcctcgccgaccggaagatcgccgagctgttcagcaccaagatccacatcggc

SEQ ID NO: 12430 - RNA, 1932 nt, synthetic construct
  misc_feature 1..1932: note = derived and/or modified CDS sequence (opt1) from CCHFV(V42/81)__GU477490.1__Gc
  source 1..1932: mol_type = other RNA
ttcctggacagcatcgtgaagggcaagaagaacctcctgaactccaccagcctggagacctccctcagcatcgaggccccctggggcgccatcaacatccagtccacgttcaagccgaccgtcagcgcggccaacatcgccctgtcctggagctccgtggagcaccgcgggaacaagatcctggtgagcgggcggtccgagagcatcatgaagctcgaggagcgcaccggcgtctcctggaacctgggggtggaggacgccagcgagtccaagctgctcaccgtgagcatcatggacctgtcccagatgtacagccccgtcttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtggggaccggctgcacgtgctgcggggtcgacgtgaaggacctgttcatcgaccacatgttcgtgaagtggaaggtcgagtacatcaagaccgaggcgatcgtgtgcgtggagctgaccagccaggagcggcagtgctccctcatcgaggccggcacccgcttcaacctgggccccgtcaccatcaccctgagcgagccccggaacatccagcagaagctcccgcccgagatcatcacgctgcaccccaagatcgaggaggggttcttcgacctgatgcacgtgcagaaggtgctctccgccagcaccgtctgcaagctgcagtcctgcacccacggcatccccggggacctccaggtgtaccacatcggcaacctcctgaagggcgaccgcgtgaacgggcacctgatccacaagatcgagccgcacttcaacaccagctggatgtcctgggacggctgcgacctcgactactactgcaacatgggggactggcccagctgcacgtacaccggcgtcacccagcacaaccacgccgcgttcgtgaacctgctgaacatcgagaccgactacacgaagaccttccacttccactccaagcgggtgaccgcccacggggagacgccccagctcgacctgaaggcccgccccgcctacggcgccggcgagatcaccgtcctggtggaggtcgcggacatggagctccacaccaagaaggtggagatcagcgggctgaagttcgcctccctggcctgcaccggctgctacgcctgcagctccgggatcagctgcaaggtgcggatccacgtcgacgagccggacgagctcaccgtgcacgtgaagtccaacgaccccgacgtcgtggccgcgagcacgtccctgatggcccgcaagctggagagcggcaccgacagcaccttcaaggccttctccgccatgcccaagaccagcctctgcttctacatcgtggagcgggagtactgcaagtcctgcagcgaggacgacacgcagaagtgcgtcgagaccaagctggagcagccccagtccatcctgatcgagcacaaggggaccatcatcggcaagcagaacgacacgtgcaccgccaaggcgagctgctggctcgagtccgtcaagagcttcttctacggcctgaagaacatgctggggtccgtgttcggcaacttcttcatcgggatcctcctgttcctggccccgttcgtgctcctggtgctgttcttcatgttcggctggaagatcctgttctgcttcaagtgctgccgccggacccgcggcctcttcaagtaccggcacctgaaggaggacgaggagaccgggtaccgccggatcatcgagcgcctgaacagcaagaagggcaagaaccgcctcctggacggggagcggctggccgaccgcaagatcgccgagctgttctccaccaagacccacatcggc

SEQ ID NO: 12431 - RNA, 1932 nt, synthetic construct
  misc_feature 1..1932: note = derived and/or modified CDS sequence (opt1) from CCHFV(79121M18)__GU477493.1__Gc
  source 1..1932: mol_type = other RNA
ttcctggacagcaccgccaagggcatgaagtccctcctgaacagcacctccctggagacgagcctctccatcgaggccccctggggggcgatcaacgtgcagagcaccttcaagccgaccgtctccgccgccaacatcgccctgagctggtccagcgtggagcaccgcggcaacaagatcctggtgtccgggcggagcgagtccatcatgaagctcgaggagcgcaccggcgtcagctggaacctgggggtggaggacgcctccgagagcaagacgctgaccgtgtccgtcatggacctcagccagatgtactcccccgtgttcgagtacctgagcggcgaccggcaggtggaggagtggcccaaggcgacctgcaccggcgactgccccgagcgctgcgggtgcacgagctccacctgcctgcacaaggagtggccgcacagccggaactggcgctgcaaccccacctggtgctggggcgtcgggaccggctgcacgtgctgcgggctcgacgtgaaggacttcttcaccgactacatgctggtgaagtggaaggtcgagtacatcaagaccgaggccatcgtgtgcgtggagctgacctcccaggagcggcagtgcagcctcatcgaggccggcacgcgcttcaacctgggccccgtcaccatcaccctgtccgagccccggaacgtgcagcagcgcctcccgcccgagatcgtgaccctgcaccccaagatcgaggaggggttcttcgacctgatgcacgtccagaagatcctcagcgcctccacggtgtgcaagctgcagagctgcacccacggcgtgcccggggacttccagatctaccacgtcggcaacctgctccggggcgacaaggtgaacgggcactccatccacaagatcgagccgcacttcaacaccagctggatgtcctgggacggctgcgacctggactacttctgcaacatgggggactggcccagctgcacctacacgggcgtgacccagcacaaccgcgcggccttcatcaacatgctgaacatcgagaccgactacaccaagacgttccacttccactccaagcgggtcaccgcccacggggacaccccccagctcgacctgaaggcccgccccgcctacggcgcgggcgaggtgaccgtcctggtggaggtggccgacctcgagctgcacacgaagaagctggaggtcagcgggctcaagatcgcctccctgacctgcagcggctgctacgcctgctccagcgggatctcctgcaaggtgcggatccacgtgaacgagccggacgagttcaccgtccacgtgcgcagcagcgaccccgacgtggtcgccgcgggctccagcctgatggcccggaagatcgagttcggggccgactccaccttcaaggccttcagctccatgcccaaggacagcctctgcttctacatcgtggagaaggactactgctccagctgcacggacgacgacacccagaagtgcgtgaacaccaagctggaccacccccagtccatcctgatcgagcacaagggcaccatcatcggcaagcagaacgacacctgcagcacgaagacctcctgctggctcgagagcgtcaaggggttcttctacggcctgaagaacatgctgtccgggatcttcggcaacgtgttcctcgggatcttcctgttcctggccccgttcgtgctcctgatcttcttcttcttcttcggctggcgcctgctcttctgcctgaagtgctgccggcgcacccggggcctgctgaagtacaagcacctcaaggacgaggaggaggcggggtacaagaagatcatcgagcgcctgaacggcaagaaggggaagagccagctgttcgacggcgagcgcctcgccgaccggaagatcgccgagctgttctccaccaagatccacatcggc

SEQ ID NO: 12432 - RNA, 1932 nt, synthetic construct
  misc_feature 1..1932: note = derived and/or modified CDS sequence (opt1) from CCHFV(Afg09-2990)__HM452306.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaaggtcctggtgagcgggcggtccgagagcatcatgaagctcgaggagcgcaccggcatctcctgggacctgggggtggaggacgccagcgagtccaagctgctcacggtcagcgtgatggacctgtcccagatgtacagccccgtgttcgagtacctgtccggcgaccggcaggtcgaggagtggcccaaggcgacctgcaccggcgactgccccgagcgctgcgggtgcaccagcagcacgtgcctccacaaggagtggccgcactcccggaactggcgctgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcaccagccaggagcggcagtgctccctgatcgaggccggcacccgcttcaacctgggcagcgtgacgatcaccctctccgagccccggaacatccagcagaagctgcccccggagatcatcaccctgcaccccaagatcgaggaggggttcttcgacctcatgcacgtgcagaaggtcctgagcgcctccaccgtgtgcaagctgcagagctgcacgcacggcgtgcccggggacctccaggtctaccacatcggcaacctgctgaagggcgaccgcgtgaacgggcacctcatccacaagatcgagcagcacttcaacacctcctggatgagctgggacggctgcgacctggactactactgcaacatgggggactggccctcctgcacctacaccggcgtgacgcagcacaaccacgccagcttcgtcaacctgctcaacatcgagaccgactacaccaagaccttccacttccactccaagcgggtgacggcccacggggacaccccgcagctggacctgaaggcgcgccccacctacggcgccggcgagatcaccgtcctcgtggaggtggccgacatggagctgcacacgaagaagatcgagatcagcgggctgaagttcgccggcctgacctgcaccgggtgctacgcctgctccagcggcatctcctgcaaggtccggatccacgtggacgagcccgacgagctcaccgtgcacgtcaagagcgacgaccccgacgtggtggcggcctccagcagcctgatggcccgcaagctcgagttcgggacggactccaccttcaaggccttcagcgccatgccgaagacctccctgtgcttctacatcgtcgagcgggagtactgcaagagctgctccaaggaggacacccagaagtgcgtgaacaccaagctggagcagccccagagcatcctcatcgagcacaagggcacgatcatcggcaagcagaacaacacgtgcaccgcgaaggcctcctgctggctggagagcgtgaagtccttcttctacgggctgaagaacatgctcggcgggatcttcggcaacgtcttcatcgggatcttcaccttcctgacccccttcatcctgctcatcctgttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaaccgcctgctcgacggggagcggctggccgaccgcaagatcgccgagctgttcagcaccaagacgcacatcggc

SEQ ID NO: 12433 - RNA, 1932 nt, synthetic construct
  misc_feature 1..1932: note = derived and/or modified CDS sequence (opt1) from CCHFV(Sudan Al-Fulah 3-2008)__HQ378184.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcggcagtgctccctgatcgaggccggcacccgcttcaacctgggccccgtcacgatcaccctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaagatcgagccgcacttcaacaccagctggatgtcctgggacggctgcgacctggactactactgcaacatgggggactggcccagctgcacctacaccggcgtgacgcagcacaaccacgcctccttcgtgaacctgctcaacatcgagaccgactacaccaagaacttccacttccacagcaagcgggtcaccgcccacggggacacgccccagctggacctgaaggcgcgccccacctacggcgccggcgagatcaccgtgctcgtcgaggtggccgacatggagctgcacaccaagaagatcgagatctccgggctgaagttcgccagcctcacgtgcaccggctgctacgcctgctccagcgggatctcctgcaaggtgcggatccacgtcgacgagccggacgagctgaccgtgcacgtcaagagcgacgaccccgacgtggtggcggcctccagcagcctgatggcccgcaagctcgagttcggcaccgactccacgttcaaggccttcagcgccatgcccaagacctccctgtgcttctacatcgtggagaaggagtactgcaagagctgctccgaggaggacaccaagaagtgcgtcaacaccaagctggagcagccccagagcatcctcatcgagcacaaggggaccatcatcggcaagcagaactccacgtgcaccgcgaaggtgagctgctggctggagtccgccaagagcttcttctacggcctgaaggacatgctctccgggatcttcggcaacgtgttcatcgggatcttcctgttcctggccccgttcgtcctcctggtgctgttcttcatgttcggctggcggatcctgctctgcttccgctgctgccggcgcacccgggggctgttcaagtaccgccacctgaaggacgacgaggagaccggctaccggcgcatcatcgagcgcctcaacaacaagaagggcaagaacaagctgctggacggggagcggctcgccgaccgcaagatcgccgagctgttcagcacgaagacccacatcggc

SEQ ID NO: 12434 - RNA, 1932 nt, synthetic construct
  misc_feature 1..1932: note = derived and/or modified CDS sequence (opt1) from CCHFV(Sudan AB1-2009)__HQ378187.1__Gc
  source 1..1932: mol_type = other RNA
ttcctcgacagcatcgccaagggcatgaagaacctcctgaactccaccagcctggagacctccctcagcatcgaggccccctggggcgcgatcaacgtgcagtccacgtacaagccgaccgtcagcaccgccaacatcgccctgtcctggagctccgtggagcaccgcgggaacaagatcctggtgagcgggcggtccgagagcatcatgaagctcgaggagcgcaccggcatctcctgggacctgggggtcgaggacgccagcgagtccaagctgctcacggtgagcgtgatggacctgtcccagatgtacagccccgtcttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtggggaccggctgcacgtgctgcgggctggacgtcaaggacctgttcaccgactacatgttcgtgaagtggaaggtggagtacatcaagaccgaggccatcgtctgcgtggagctcaccagccaggagcggcagtgctccctgatcgaggccggcacccgcttcaacctgggccccgtgacgatcaccctcagcgagccccggaacatccagcagaagctgccgcccgagatcatcaccctgcacccccgcatcgaggaggggttcttcgacctcatgcacgtccagaaggtgctgtccgccagcaccgtgtgcaagctgcagtcctgcacgcacggcgtccccggggacctccaggtgtaccacatcggcaacctgctgaagggcgacaaggtgaacgggcacctcatccacaagatcgagccgcacttcaacaccagctggatgtcctgggacggctgcgacctggactactactgcaacatgggggactggcccagctgcacctacaccggcgtcacgcagcacaaccacgcctccttcgtgaacctgctcaacatcgagaccgactacaccaagaacttccacttccacagcaagcgggtgaccgcgcacggggacacgccccagctggacctgaaggcccgccccacctacggcgccggcgagatcaccgtcctcgtggaggtcgccgacatggagctgcacaccaagaagatcgagatctccgggctgaagttcgccagcctcacgtgcaccggctgctacgcgtgctccagcgggatctcctgcaaggtgcggatccacgtggacgagccggacgagctgaccgtccacgtcaagagcgacgaccccgacgtggtggccgcctccagcagcctgatggcccgcaagctcgagttcggcaccgactccacgttcaaggccttcagcgcgatgcccaagacctccctgtgcttctacatcgtggagcgggagcactgcaagagctgcaacgaggaggacaccaagaagtgcgtgaacaccaagctggagcagccccagtccatcctcatcgagcacaaggggaccatcatcggcaagcagaacagcacgtgcaccgcccgcgcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcggatcctgttctgcttcaagtgctgccgccggacccgcggcctcttcaagtaccggcacctgaaggacgacgaggagaccgggtaccgccgcatcatcgagcggctgaacaacaagaagggcaagaacaagctcctggacggggagcgcctggccgaccggcgcatcgcggagctgttctccacgaagacccacatcggc

SEQ ID NO: 12435 - RNA, 1932 nt, synthetic construct
  misc_feature 1..1932: note = derived and/or modified CDS sequence (opt1) from CCHFV(NIVA 118595)__JN572083.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcggcagtgctccctgatcgaggccggcacccgcttcaacctgggcagcgtcaccatcacgctctccgagccccggaacatccagcagaagctgcccccggagatcatcaccctgcacccccgcatcgaggaggggttcttcgacctcatgcacgtgcagaaggtgctgagcgcctccaccgtctgcaagctgcagagctgcacccacggcgtgcccggggacctccaggtgtaccacatcggcaacctgctgaagggcgaccgggtcaacgggcacctcatccacaagatcgagcagcacctgaacacgtcctggatgagctgggacggctgcgacctggactactactgcaacatgggggactggccctcctgcacctacaccggcgtgacccagcacaaccacgccagcttcgtgaacctcctgaacatcgagacggactacaccaagaccttccacttccactccaagcgcgtcaccgcgcacggggacacgccgcagctggacctcaaggcccggcccacctacggcgccggcgagatcaccgtgctggtcgaggtggccgacatggagctgcacaccaagaagatcgagatcagcgggctcaagttcgcctccctgagctgcacgggctgctacgcgtgctccagcgggatctcctgcaaggtgcgcatccacgtcgacgagcccgacgagctgaccgtgcacgtcaagagcgacgaccccgacgtggtggccgccagctccagcctcatggcccggaagctggagtccggcaccgacagcaccttcaaggccttctccgcgatgccgaagacgagcctgtgcttctacatcgtggagcgcgagtactgcaaggggtgctccaaggaggacacccagaagtgcgtcaacaccaagctcgagcagccccagagcatcctgatcgagcacaagggcaccatcatcggcaagcagaacaacacgtgcaccgccaaggcctcctgctggctggagagcgtgaagtccttcttctacgggctcaagaacatgctgagcggcatcttcgggaacgtgttcctgggcatcttctccttcctcgcccccttcgtcctgctgatcctgttcttcatgttcgggtggcggatcctcttctgcttcaagtgctgccgccggacccgcggcctgttcaagtaccggcacctgaaggacgacgaggagaccggctaccgcaagatcatcgagcgcctcaacaacaagaaggggaagaacaagctgctggacggcgagcggctcgccgaccgcaagatcgcggagctgttcagcaccaagacgcacatcggg

SEQ ID NO: 12436 - RNA, 1932 nt, synthetic construct
  misc_feature 1..1932: note = derived and/or modified CDS sequence (opt1) from CCHFV(NIV 112143)__JN572085.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcggcagtgctccctgatcgaggccggcacccgcttcaacctgggcagcgtcaccatcacgctctccgagccccggaacatccagcagaagctgcccccggagatcatcaccctgcacccccgcatcgaggaggggttcttcgacctcatgcacgtgcagaaggtgctgagcgcctccaccgtctgcaagctgcagagctgcacccacggcgtgcccggggacctccaggtgtaccacatcggcaacctgctgaagggcgaccgggtcaacgggcacctcatccacaagatcgagcagcacctgaacacgtcctggatgagctgggacggctgcgacctggactactactgcaacatgggggactggccctcctgcacctacaccggcgtgacccagcacaaccacgccagcttcgtgaacctcctgaacatcgagacggactacaccaagaccttccacttccactccaagcgcgtcaccgcgcacggggacacgccgcagctggacctcaaggcccggcccacctacggcgccggcgagatcaccgtgctggtcgaggtggccgacatggagctgcacaccaagaagatcgagatcagcgggctcaagttcgcctccctgagctgcacgggctgctacgcgtgctccagcgggatctcctgcaaggtgcgcatccacgtcgacgagcccgacgagctgaccgtgcacgtcaagagcgacgaccccgacgtggtggccgccagctccagcctcatggcccggaagctggagttcggcaccgactccaccttcaaggccttcagcgcgatgccgaagacgtccctgtgcttctacatcgtggagcgcgagtactgcaaggggtgcagcaaggaggacacccagaagtgcgtcaacaccaagctcgagcagccccagtccatcctgatcgagcacaagggcaccatcatcggcaagcagaacaacacgtgcaccgccaaggccagctgctggctggagtccgtcaagagcttcttctacgggctcaagaacatgctgtccggcatcttcgggaacgtgttcctgggcatcttcagcttcctcgcccccttcgtgctgctgatcctgttcttcatgttcgggtggcggatcctcttctgcttcaagtgctgccgccggacccgcggcctgttcaagtaccggcacctgaaggacgacgaggagaccggctaccgcaagatcatcgagcgcctcaacaacaagaaggggaagaacaagctgctggacggcgagcggctcgccgaccgcaagatcgcggagctgttctccaccaagacgcacatcggg

SEQ ID NO: 12437 - RNA, 1932 nt, synthetic construct
  misc_feature 1..1932: note = derived and/or modified CDS sequence (opt1) from CCHFV(SCT ex Afghanistan)__KC344856.1__Gc
  source 1..1932: mol_type = other RNA
ttcctgaacagcatcgtgaagggcatgaagaacctcctgaactccaccaacctggagaccagcctctccatcgaggccccctggggcgccatcaacgtccagagcacgttcaagccgaccgtgtccaccgcgaacatcgccctgagctggtccagcgtggagcaccgcgggaacaagatcctggtctccgggcggagcgagtccatcatgaagctcgaggagcgcaccggcatcagctgggacctgggggtggaggacgcctccgagagcaagtccctgacggtgagcgtcatggacctctcccagatgtacagccccgtgttcgagtacctgtccggcgaccgccaggtggaggagtggcccaaggcgacctgcaccggcgactgccccgagcggtgcgggtgcaccagcagcacgtgcctgcacaaggagtggccgcactcccggaactggcgctgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcggcagtgctccctcatcgaggccggcacccgcttcaacctgggccccgtcacgatcaccctgagcgagccccggaacatccagcagaagctcccgcccgagatcatcaccctgcacccccgcatcgaggaggggttcttcgacctgatgcacgtgcagaaggtgctctccgccagcaccgtctgcaagctgcagtcctgcacgcacggcgtgcccggggacctccaggtgtaccacatcggcaacctcctgaagggcgacaagctgaacgggcacatgatccacaagatcgagccgcacttcaacaccagctggatgtcctgggacggctgcgacctcgactactactgcaacatgggggactggcccagctgcacctacaccggcgtcacgcagcacaaccacgccgccttcgtgaacctgctgaacatcgagaccgactacaccaagaacttccacttccactccaagcgggtgaccgcgcacggggacacgccccagctcgacctgaaggcccgccccacctacggcgccggcgagatcaccgtcctggtggaggtcgccgacatggagctccacaccaagaagatcgacatcagcgggctgaagttcgcctccctgacgtgcgcgggctgctacgcctgcagctccgggatcagctgcaaggtgcggatccacgtggacgagccggacgagctcaccgtccacgtgaagtccgaggaccccgacatcgtggccgccagcacctccctgatcgcccgcaagctggagctcggcaccgacagcacgttcaaggcgttcagcgccatgcccaagacctccctgtgcttctacatcgtcgagcgggagtactgcaagagctgctccaaggaggacacccagaagtgcgtgaacaccaagctggagcacccccaggggatcctcatcgagcacaagggcaccatcatcggcaagcagaacgacacgtgcaccgccaaggccgggtgctggctggagagcgtgaagtccttcttctacggcctgaagaacatgctcagcgggatcttcggcaacgtcttcatcgggatcttcctgttcctggccccgttcgtgctcctgatcctgttcttcatgttcggctggcgcctgctgttctgcttcaagtgctgccggcgcacccggggcctgttcaagtaccgccacctgaaggaggacgaggagtccgggtaccggcgcatcatcgagcgcctcaacaacaagaagggcaagaacaagctgctggacggggagcggctcgcggaccgccggatcgccgagctgttcagcaccaagacgcacatcggc

SEQ ID NO: 12438 - RNA, 1932 nt, synthetic construct
  misc_feature 1..1932: note = derived and/or modified CDS sequence (opt1) from CCHFV(Zahedan 2007)__KC867273.1__Gc
  source 1..1932: mol_type = other RNA
ttcctggacagcatcgtgaaggacatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaaggtcctggtgagcggccggtccgagagcatcatgaagctcgaggagcgcaccgggatctcctgggacctgggcgtggaggacgccagcgagtccaagctgctcacggtcagcgtgatggacctgtcccagatgtacagccccgtgttcgagtacctgtccggggaccggcaggtcgaggagtggcccaaggcgacctgcaccggcgactgccccgagcgctgcggctgcaccagcagcacgtgcctccacaaggagtggccgcactcccggaactggcgctgcaaccccacctggtgctggggcgtggggaccgggtgcacgtgctgcggcctggacgtgaaggacctgttcaccgactacatgttcgtcaagtggaaggtggagtacatcaagaccgaggccatcgtgtgcgtcgagctcaccagccaggagcggcagtgctccctgatcgaggccgggacccgcttcaacctgggcagcgtgacgatcaccctctccgagccccggaacatccagcagaagctgcccccggagatcatcaccctgcaccccaagatcgaggagggcttcttcgacctcatgcacgtgcagaaggtcctgagcgcctccaccgtgtgcaagctgcagagctgcacgcacggggtgcccggcgacctccaggtctaccacatcgggaacctgctgaagggcgaccgcgtgaacggccacctcatccacaagatcgagcagcacttcaacacctcctggatgagctgggacgggtgcgacctggactactactgcaacatgggcgactggccctcctgcacctacaccggggtgacgcagcacaaccacgccagcttcgtcaacctgctcaacatcgagaccgactacaccaagaccttccacttccactccaagcgggtgacggcccacggcgacaccccgcagctggacctgaaggcgcgccccacctacggggccggcgagatcaccgtcctcgtggaggtggccgacatggagctgcacacgaagaagatcgagatcagcggcctgaagttcgccgggctgacctgcaccggctgctacgcctgctccagcgggatctcctgcaaggtccggatccacgtggacgagcccgacgagctcaccgtgcacgtcaagagcgacgaccccgacgtggtggcggcctccagcagcctgatggcccgcaagctcgagttcggcacggactccaccttcaaggccttcagcgccatgccgaagacctccctgtgcttctacatcgtcgagcgggagtactgcaagagctgctccaaggaggacacccagaagtgcgtgaacaccaagctggagcagccccagagcatcctcatcgagcacaaggggacgatcatcggcaagcagaacaacacgtgcaccgcgaaggcctcctgctggctggagagcgtgaagtccttcttctacggcctgaagaacatgctcgggggcatcttcgggaacgtcttcatcggcatcttcaccttcctgacccccttcatcctgctcatcttcttcttcatgttcgggtggcgcatcctgttctgcttcaagtgctgccggcgcacccggggcctgttcaagtaccgccacctgaaggacgacgaggagaccggctaccggaagatcatcgagcgcctcaacaacaagaaggggaagaaccgcctgctggacggcgagcggctcgccgaccgcaagatcgccgagctgttcagcaccaagacgcacatcggg

SEQ ID NO: 12439 - RNA, 1932 nt, synthetic construct
  misc_feature 1..1932: note = derived and/or modified CDS sequence (opt1) from CCHFV(SPU 44/08)__KJ682805.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcgtgaccctgcacccccgcatcgaggaggggttcttcgacctcatgcacatccagaaggtgctgtccgccagcaccgtctgcaagctgcagtcctgcacccacggcgtgcccggggacctccagatctaccacatcggcaacctgctgaagggcgacaaggtgaacgggcacctcatccacaagatcgagccgcacttcaacacgagctggatgtcctgggacggctgcgacctggactactactgcaacatgggggactggcccagctgctcctacaccggcgtcacccagcacaaccacgccgcgttcgtgaacatgctgaacatcgagaccgactacacgaagaacttccacttccacagcaagcgggtgaccgcccacggggacacgccccagctcgacctgaaggcccgccccacctacggcgccggcgagatcaccgtcctggtggaggtcgccgacatggagctccacaccaagaagatcgagatctccgggctgaagttcgcgagcctgacctgcaccggctgctacgcctgctccagcgggatctcctgcaaggtgcggatccacgtggacgagccggacgagctcacggtccacgtcaagagcgaggaccccgacatcgtggccgcctccagcagcctgatggcccgcaagctggagttcggcaccgactccaccttcaaggcgttcagcgccatgcccaagacctccctctgcttctacatcgtggagcgggagtactgcaagagctgctccaaggaggacacgcagaagtgcgtgaacaccaagctggagcagccccagagcatcctgatcgagcacaaggggaccatcatcggcaagcagaacgacacgtgcaccgccaaggcctcctgctggctcgagagcatcaagtccttcttctacggcctgaagaacatgctgagcgggatcttcggcaacgtgttcatcgggatcttcctcttcctggccccgttcatcatgctgatcctcttcttcatgttcggctggcgcatcctgttctgcttcaagtgctgccggcgcacccgggggctgttcaagtaccgccacctgaaggacgacgaggagatcggctaccggaagatcatcgagcgcctcaacaacaagaagggcaagaacaagctgctggacggggagcgcctcgcggaccggaagatcgccgagctgttctccaccaagacccacatcggc

SEQ ID NO: 12440 - RNA, 1932 nt, synthetic construct
  misc_feature 1..1932: note = derived and/or modified CDS sequence (opt1) from CCHFV(SPU 383/87)__KJ682806.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcgtgaccctgcacccccgcatcgaggaggggttcttcgacctcatgcacatccagaaggtgctgtccgccagcaccgtctgcaagctgcagtcctgcacccacggcgtgcccggggacctccagatctaccacatcggcaacctgctgaagggcgacaaggtgaacgggcacctcatccacaagatcgagccgcacttcaacacgagctggatgtcctgggacggctgcgacctggactactactgcaacatgggggactggcccagctgctcctacaccggcgtcacccagcacaaccacgccgcgttcgtgaacatgctgaacatcgagaccgactacacgaagaacttccacttccacagcaagcgggtgaccgcccacggggacacgccccagctcgacctgaaggcccgccccacctacggcgccggcgagatcaccgtcctggtggaggtcgccgacatggagctccacaccaagaagatcgagatctccgggctgaagttcgcgagcctgacctgcaccggctgctacgcctgctccagcgggatctcctgcaaggtgcggatccacgtggacgagccggacgagctcacggtccacgtcaagagcgaggaccccgacatcgtggccgcctccagcagcctgatggcccgcaagctggagttcggcaccgactccaccttcaaggcgttcagcgccatgcccaagacctccctctgcttctacatcgtggagcgggagtactgcaagagctgctccaaggaggacacgcagaagtgcgtgaacaccaagctggagcagccccagagcatcctgatcgagcacaaggggaccatcttcggcaagcagaacgacacgtgcaccgccaaggcctcctgctggctcgagagcgtgaagtccttcttctacggcctgaagaacatgctgagcgggatcttcggcaacgtcttcatcggggtgttcctcttcctggccccgttcatcatgctgatcctcttcttcatgttcggctggcgcatcctgttctgcttcaagtgctgccggcgcacccgggggctgttcaagtaccgccacctgaaggacgacgaggagatcggctaccggaagatcatcgagcgcctcaacaacaagaagggcaagaacaagctgctggacggggagcgcctcgcggaccggaagatcgccgagctgttctccaccaagacccacatcggc

SEQ ID NO: 12441 - RNA, 1932 nt, synthetic construct
  misc_feature 1..1932: note = derived and/or modified CDS sequence (opt1) from CCHFV(SPU 130/89)__KJ682807.1__Gc
  source 1..1932: mol_type = other RNA
agcctggactccatcgtgaagggcatgaagaacctcctgaacagcacctccctggagaccagcctctccatcgaggccccctggggcgccatcaacgtccagagcacgttcaagccgaccgtgtccgcggccaacatcgccctgagctggtccagcgtggagcaccgcgggaacaagatcctggtctccgggcggagcgagtccatcatgaagctcgaggagcgcaccggcatcagctgggacctgggggtggaggacgcctccgagagcaagctgctcaccgtgtccgtcatggacctgagccagatgtactcccccgtgttcgagtacctgagcggcgaccgccaggtggaggagtggcccaaggccacgtgcaccggcgactgccccgagcggtgcgggtgcaccagctccacgtgcctccacaaggagtggccgcacagccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcacctcccaggagcggcagtgcagcctgatcgaggccggcacccgcttcaacctgggccccgtcaccatcacgctctccgagccccggaacatccagcagaagctgccgcccgagatcgtgaccctgcacccccgcatcgaggaggggttcttcgacctcatgcacatccagaaggtgctgagcgcctccaccgtctgcaagctgcagagctgcacccacggcgtgcccggggacctccagatctaccacatcggcaacctgctgaagggcgacaaggtgaacgggcacctcatccacaagatcgagccgcacttcaacacgtcctggatgagctgggacggctgcgacctggactactactgcaacatgggggactggccctcctgcagctacaccggcgtcacccagcacaaccacgccgcgttcgtgaacatgctgaacatcgagaccgactacacgaagaacttccacttccactccaagcgggtgaccgcccacggggacacgccccagctcgacctgaaggcccgccccacctacggcgccggcgagatcaccgtcctggtggaggtcgccgacatggagctccacaccaagaaggtggagatcagcgggctgaagttcgcgtccctgacctgcaccggctgctacgcctgcagctccgggatcagctgcaaggtgcggatccacgtcgacgagccggacgagctcacggtgcacgtgaagtccgaggaccccgacatcgtcgccgccagcagctccctgatggcccgcaagctggagttcggcaccgacagcaccttcaaggcgttctccgccatgcccaagaccagcctctgcttctacatcgtggagcgggagcactgcaagtcctgcagcaaggaggacacgcagcgctgcgtgaacaccaagctggagcagccccagtccatcctgatcgagcacaaggggaccatcatcggcaagcagaacgacacgtgcaccgccaaggccagctgctggctcgagtccatcaagagcttcttctacggcctgaagaacatgctgtccgggatcttcggcaacgtcttcatcggggtgttcctcttcctggccccgttcatcatcctgatcctcttcttcatgttcggctggcggatcctgttctgcttcaagtgctgccgccggacccgcgggctgctgaagtaccggcacctcaaggacgacgaggagatcggctaccgcaagatcatcgagcgcctgaacaacaagaagggcaagaacaagctgctcgacggggagcggctggcggaccgcaagatcgccgagctgttcagcaccaagacccacatcggc

SEQ ID NO: 12442 - RNA, 1932 nt, synthetic construct
  misc_feature 1..1932: note = derived and/or modified CDS sequence (opt1) from CCHFV(SPU 497/88)__KJ682808.1__Gc
  source 1..1932: mol_type = other RNA
ttcctcgacagcatcgtgaagggcatgcgcaacctcctgaactccaccagcctggagacctccctcagcatcgaggccccctggggcgccatcaacgtccagtccacgttcaagccgaccgtgagcgcggccaacatcgccctgtcctggagctccgtggagcaccgggggaacaagatcctggtcagcgggcgctccgagagcatcatgaagctcgaggagcggaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccgcaactggcggtgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcaccagccaggagcgccagtgctccctgatcgaggccggcacccggttcaacctgggccccgtcaccatcacgctcagcgagccccgcaacatccagcagaagctgccgcccgagatcgtgaccctgcacccccggatcgaggaggggttcttcgacctcatgcacatccagaaggtgctgtccgccagcaccgtctgcaagctgcagtcctgcacccacggcgtgcccggggacctccagatctaccacatcggcaacctgctgaagggcgacaaggtgaacgggcacctcatccacaagatcgagccgcacttcaacacgagctggatgtcctgggacggctgcgacctggactactactgcaacatgggggactggcccagctgctcctacaccggcgtcacccagcacaaccacgccgcgttcgtgaacatgctgaacatcgagaccgactacacgaagaacttccacttccacagcaagcgcgtgaccgcccacggggacacgccccagctcgacctgaaggcccggcccacctacggcgccggcgagatcaccgtcctggtggaggtcgccgacatggagctccacaccaagaagatcgagatctccgggctgaagttcgcgagcctgacctgcaccggctgctacgcctgctccagcgggatctcctgcaaggtgcgcatccacgtggacgagccggacgagctcacggtccacgtcaagagcgaggaccccgacatcgtggccgcctccagcagcctgatggcccggaagctggagttcggcaccgactccaccttcaaggcgttcagcgccatgcccaagacctccctctgcttctacatcgtggagcgcgagtactgcaagagctgctccaaggaggacacgcagaagtgcgtgaacaccaagctggagcagccccagagcatcctgatcgagcacaaggggaccatcatcggcaagcagaacgacacgtgcaccgcccgggcctcctgctggctcgagagcatcaagtccttcttctacggcctgaagaacatgctgagcgggatcttcggcaacgtgttcatcgggatcttcctcttcttcgccccgttcatcatgctgatcctgttcttcatgttcggctggcgcatcctcttctgcttcaagtgctgccggcgcacccgggggctgttcaagtaccgccacctgaaggacgacgaggaggtcggctaccgcaagatcatcgagcggctgaacaacaagaagggcaagaacaagctcctggacggggagcgcctggcggaccggaagatcgccgagctgttctccaccaagacccacatcggc

SEQ ID NO: 12443 - RNA, 1932 nt, synthetic construct
  misc_feature 1..1932: note = derived and/or modified CDS sequence (opt1) from CCHFV(SPU 18/88)__KJ682810.1__Gc
  source 1..1932: mol_type = other RNA
ttcctggacagcatcgtgaagggcaagaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcgtgaccctgcacccccgcatcgaggaggggttcttcgacctcatgcacatccagaaggtgctgtccgccagcaccgtctgcaagctgcagtcctgcacccacggcgtgcccggggacctccagatctaccacatcggcaacctgctgaagggcgacaaggtgaacgggcacctcatccacaagatcgagccgcacttcaacacgagctggatgtcctgggacggctgcgacctggactactactgcaacatgggggactggcccagctgctcctacaccggcgtcacccagcacaaccacgccgcgttcgtgaacatgctgaacatcgagaccgactacacgaagaacttccacttccacagcaagcgggtgaccgcccacggggacacgccccagctcgacctgaaggcccgccccacctacggcgccggcgagatcaccgtcctggtggaggtcgccgacatggagctccacaccaagaagatcgagatctccgggctgaagttcgcgagcctgacctgcaccggctgctacgcctgctccagcgggatctcctgcaaggtgcggatccacgtggacgagccggacgagctcacggtccacgtcaagagcgaggaccccgacatcgtggccgcctccagcagcctgatggcccgcaagctggagttcggcaccgactccaccttcaaggcgttcagcgccatgcccaagacctccctctgcttctacatcgtggagcgggagtactgcaagagctgctccaaggaggacacgcagaagtgcgtgaacaccaagctggagcagccccagagcatcctgatcgagcacaaggggaccatcatcggcaagcagaacgacacgtgcaccggcaaggccgggtgctggctcgagtccatcaagagcttcttctacggcctgaagaacatgctgtccgggatcttcggcaacgtgttcatcgggatcttcctcttcctggccccgttcatcatgctgatcctcttcttcatgttcggctggcgcatcctgttctgcttcaagtgctgccggcgcacccggggcctgttcaagtaccgccacctgaaggacgacgaggagatcgggtaccggaagatcatcgagcgcctcaagaacaagaagggcaagaacaagctgctggacggggagcgcctcgccgaccggaagatcgcggagctgttcagcaccaagacccacatcggc

SEQ ID NO: 12444 - RNA, 1932 nt, synthetic construct
  misc_feature 1..1932: note = derived and/or modified CDS sequence (opt1) from CCHFV(SPU 431/85)__KJ682812.1__Gc
  source 1..1932: mol_type = other RNA
ttcctggacagcatcgtgaagggccgcaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgggggaacaagatcctggtcagcgggcgctccgagagcatcatgaagctcgaggagcggaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcgccagtgctccctgatcgaggccggcacccggttcaacctgggccccgtcaccatcacgctcagcgagccccgcaacatccagcagaagctgccgcccgagatcatcaccctgcacccccggatcgaggaggggttcttcgacctcatgcacgtgcagcgcgtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccgcacttcaacacgagctggatgtcctgggacggctgcgacctggactactactgcaacatgggggactggcccagctgcacctacaccggcgtgacccagcacaaccacgccgcgttcgtgaacctgctcaacatcgagacggactacaccaagaacttccacttccactccaagcgggtcaccgcccacggggacacgccccagctggacctgaaggcccgccccacctacggcgccggcgaggtgaccgtcctcgtggaggtggccgacatggagctgcacaccaagaagatcgagatcagcgggctgaagttcgcgtccctgacctgcacgggctgctacgcctgcagctccgggatcagctgcaaggtcaagatccacgtggacgagccggacgagctcaccgtgcacgtcaagtccgaggaccccgacatcgtggccgccggcagctccctgatggcccggaagctcgagttcggggcggacagcaccttcaaggccttcagcgccatgcccaagacctccctgtgcttctacatcgtggagcgcgagtactgcaagagctgctcccgggaggacacgcgcaagtgcgtcaacaccaagctggaccggccccagagcatcctcatcgagcacaagggcaccatcatcggcaagcagaacaacacgtgcaccgccaaggcctcctgctggctggagagcgtgaagtccttcttctacgggctgaagaacatgctcagcggcatcttcgggaacgtgttcatcggcatcttcctgttcatcgcgccgttcgtcctgctcatcctgttcttcatgttcgggtggcgcatcctgttctgcttcaagtgctgccggcgcacccgcggcctgttcaagtaccggcacctcaaggacgacgaggagaccggctaccgcaagatcatcgagcggctgaacaacaagaaggggaagaacaagctgctcgacggcgagcgcctggccgaccggaagatcgccgagctgttctccaccaagagccacatcggg

SEQ ID NO: 12445 - RNA, 1932 nt, synthetic construct
  misc_feature 1..1932: note = derived and/or modified CDS sequence (opt1) from CCHFV(SPU 48/90)__KJ682813.1__Gc
  source 1..1932: mol_type = other RNA
ttccgcgacagcatcgtgaagggcatgaagaacctgctcaactccaccagcctggagacctccctgagcatcgaggccccctggggcgccatcaacgtccagtccacgtacaagccgaccgtgagcaccgcgaacatcgccctctcctggagctccgtggagcaccgggggaacaagatcctggtcagcgggcgctccgagagcatcatgaagctggaggagcggaccggcatctcctgggacctcggggtggaggacgccagcgagtccaagctgctgacggtgagcgtcatggacctctcccagatgtacagccccgtgttcgagtacctgtccggcgaccgccaggtggaggagtggcccaaggcgacctgcaccggcgactgccccgagcggtgcgggtgcaccagcagcacgtgcctgcacaaggagtggccgcactcccgcaactggcggtgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgaccagccaggagcgccagtgctccctcatcgaggccggcacccggttcaacctgggccccgtcacgatcaccctgagcgagccccgcaacatccagcagaagctcccgcccgagatcatcaccctgcacccccggatcgaggaggggttcttcgacctgatgcacgtgcagaaggtgctctccgccagcaccgtctgcaagctgcagtcctgcacgcacggcgtgcccggggacctccaggtgtaccacatcggcaacctcctgaagggcgacaaggtcaacgggcacctgatccacaagatcgagccgcacttcaacaccagctggatgtcctgggacggctgcgacctcgactactactgcaacatgggggactggcccagctgcacctacaccggcgtgacgcagcacaaccgcgcctccttcgtgaacctgctgaacatcgagaccgactacaccaagaacttccacttccacagcaagcgggtcaccgcccacggggacacgccccagctcgacctgaaggcgcgccccacctacggcgccggcgagatcaccgtgctggtcgaggtggccgacatggagctccacaccaagaagatcgagatctccgggctgaagttcgccagcctgacgtgcaccggctgctacgcctgctccagcgggatctcctgcaaggtgcggatccacgtcgacgagccggacgagctcaccgtgcacgtcaagagcgacgaccccgacgtggtggcggcctccagcagcctgatggcccgcaagctggagttcggcaccgactccacgttcaaggccttcagcgccatgcccaagacctccctctgcttctacatcgtggagaaggagtactgcaagagctgctccgaggaggacaccaagaagtgcgtcaacaccaagctggagcagccccagagcatcctgatcgagcacaaggggaccatcatcggcaagcagaactccacgtgcaccgcgaaggtgagctgctggctcgagtccgccaagagcttcttctacggcctgaaggacatgctgtccgggatcttcggcaacgtgttcatcgggatcttcctcttcctggccccgttcatcctgctcatcctgttcttcatgttcggctggcggatcctgctgtgcttcaagtgctgccgccggacccgcggcctcttcaagtaccggcacctgaaggacgacgaggagaccgggtaccgccgcatcatcgagcggctgaacaacaagaagggcaagaacaagctcctggacggggagcgcctggccgaccggcgcatcgccgagctgttcagcacgaagacccacatcggc

SEQ ID NO: 12446 - RNA, 1932 nt, synthetic construct
  misc_feature 1..1932: note = derived and/or modified CDS sequence (opt1) from CCHFV(SPU 187/90)__KJ682814.1__Gc
  source 1..1932: mol_type = other RNA
ttcctcgacagcatcgtgaagggcatgaagaacctcctgaactccaccagcctggagacctccctcagcatcgaggccccctggggcgccatcaacgtgcagtccacgtacaagccgaccgtgagcaccgcgaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcggcagtgctccctgatcgaggccggcacccgcttcaacctgggccccgtcacgatcaccctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaagatcgagccgcacttcaacaccagctggatgtcctgggacggctgcgacctggactactactgcaacatgggggactggcccagctgcacctacaccggcgtgacgcagcacaaccacgcctccttcgtgaacctgctcaacatcgagaccgactacaccaagaacttccacttccacagcaagcgggtcaccgcccacggggacacgccccagctggacctgaaggcgcgccccacctacggcgccggcgagatcaccgtgctcgtcgaggtggccgacatggagctgcacaccaagaagatcgagatctccgggctgaagttcgccagcctcacgtgcaccggctgctacgcctgctccagcgggatctcctgcaaggtgcggatccacgtcgacgagccggacgagctgaccgtgcacgtcaagagcgacgaccccgacgtggtggcggcctccagcagcctgatggcccgcaagctcgagttcggcaccgactccatcttcaaggccttcagcgccatgcccaagacgtccctgtgcttctacatcgtggagcgggagcactgcaagagctgctccgaggaggacaccaagaagtgcgtcaacaccaagctggagcagccccagagcatcctcatcgagcacaaggggaccatcatcggcaagcagaactccacgtgcaccgcgaagaccagctgctggctggagtccgtcaagagcttcttctacggcctgaagaacatgctctccgggatcttcggcaacgtgttcatcgggatcttcctgttcctggccccgttcatcctcctgatcctgttcttcatgttcggctggcgcatcctgttctgcttcaagtgctgccggcgcacccggggcctcttcaagtaccgccacctgaaggacgacgaggagaccgggtaccggcgcatcatcgagcgcctgaacaacaagaagggcaagaacaagctcctggacggggagcggctggccgaccgccggatcgccgagctgttcagcacgaagacccacatcggc

SEQ ID NO: 12447 - RNA, 1932 nt, synthetic construct
  misc_feature 1..1932: note = derived and/or modified CDS sequence (opt1) from CCHFV(Haskovo-V46/13)__KR092379.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaagatcgaggaggggttcttcgacctgatgcacgtgcagaaggtcctcagcgcctccacggtgtgcaagctgcagagctgcacccacggcatccccggggacctgcaggtgtaccacatcggcaacctcctgaagggcgaccgcgtcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctgacctgcaccggctgctacgcgtgctccagcgggatctcctgcaaggtccggatccacgtggacgagccggacgagctcacggtgcacgtcaagagctccgaccccgacgtggtggccgccggcaccagcctgatggcccgcaagctggagttcgggaccgactccaccttcaaggccttcagcgcgatgcccaagaccagcctctgcttctacatcgtcgagcgggagtactgcaagtcctgcagcgaggacgacacgcagaagtgcgtggacaccaagctggagcagccccagtccatcctgatcgagcacaagggcaccatcatcggcaagcagaacgacacctgcacggcccgcgccagctgctggctcgagtccgtgaagagcttcttctacgggctgaagaacatgctgggctccgtcttcgggaacttcctcatcggcatcctgctgttcctcgccccgttcgtgctgctggtgctgttcttcatgttcgggtggaagatcctcttctgcttcaagtgctgccggcgcacccggggcctgttcaagtaccgccacctgaaggacgacgaggagaccggctaccggcgcatcatcgagcgcctcaacagcaagaaggggaagaaccggctgctggacggcgagcgcctcgccgaccggaagatcgcggagctgttctccaccaagacgcacatcggg

SEQ ID NO: 12448 - RNA, 1932 nt, synthetic construct
  misc_feature 1..1932: note = derived and/or modified CDS sequence (opt1) from CCHFV(24-R-2012)__KR814856.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagcaacgaccccgacgtggtcgccgcctccacgagcctgatggcccgcaagctggagttcggcaccgactccaccttcaaggcgttcagcgccatgcccaagaccagcctctgcttctacatcgtggagcgggagtactgcaagtcctgcagcgaggaggacacccagaagtgcgtggacacgaagctggagcagccccagtccatcctgatcgagcacaaggggaccatcatcggcaagcagaacgacacctgcaccgccaaggccagctgctggctcgagtccgtcaagagcttcttctacggcctgaagaacatgctggggtccgtgttcggcaacttcttcatcgggatcctcctgttcctggccccgttcgtgctcctggtcctgttcttcatgttcggctggaagatcctgttctgcttcaagtgctgccgccggacgcgcgggctcctgaagtaccggctgctcaaggacgacgaggagaccggctaccgccggatcatcgagcgcctgaacaacaagaagggcaagaaccgcctgctcgacggggagcggctggcggaccgcaagatcgccgagctgttcagcaccaagacccacatcggc

SEQ ID NO: 12449 - RNA, 1932 nt, synthetic construct
  misc_feature 1..1932: note = derived and/or modified CDS sequence (opt1) from CCHFV(36-ST-2014)__KR814857.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagacgttccacttccacagcaagcgggtcaccgcgcacggggacaccccccagctggacctgaaggcccgccccacctacggcgccggcgagatcacggtgctcgtggaggtcgccgacatggagctgcacaccaagaaggtggagatctccgggctgaagttcgccagcctcgcgtgcaccggctgctacgcctgctccagcgggatctcctgcaaggtccggatccacgtggacgagccggacgagctgaccgtgcacgtcaagagctccgaccccgacgtggtggccgccagcacgtccctgatggcccgcaagctcgagttcggcaccgacagcaccttcaaggcgttcagcgccatgcccaagacctccctgtgcttctacatcgtcgagcgggagtactgcaagagctgctccgaggacgacaccaagaagtgcgtggacacgaagctggaccagccccagagcatcctcatcgagcacaaggggaccatcatcggcaagcagaacgacacctgcaccgccaaggcctcctgctggctggagagcgtgaagtccttcttctacggcctgaagaacatgctcgggagcgtcttcggcaacttcttcgtggggatcctgctgttcctcgccccgttcgtgctgctggtcctgttcttcatgtgcggctggaagttcctcttctgcttcaagtgctgccgccggacgcgcgggctgttcaagtaccggcacctgaaggacgacgaggagaccggctaccgccggatcatcgagcgcctcaactccaagaagggcaagaaccgcctgctggacggggagcggctcgcggaccgcaagatcgccgagctgttcagcaccaagtcccacatcggc

SEQ ID NO: 12450 - RNA, 1932 nt, synthetic construct
  misc_feature 1..1932: note = derived and/or modified CDS sequence (opt1) from CCHFV(37-R-2013)__KR814858.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggacgacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagcaacgaccccgacgtggtcgccgcctccacgagcctgatggcccgcaagctggagttcggcaccgactccaccttcaaggcgttcagcgccatgcccaagaccagcctctgcttctacatcgtggagcgggagtactgcaagtcctgcagcgaggaggacacccagaagtgcgtggacacgaagctggagcagccccagtccatcctgatcgagcacaaggggaccatcatcggcaagcagaacgtcacctgcaccgccaaggccagctgctggctcgagtccgtgaagagcttcttctacggcctgaagaacatgctggggtccgtgttcggcaacttcttcatcgggatcctcctgttcctggccccgttcgtcctcctggtgctgttcttcatgttcggctggaagatcctgttctgcttcaagtgctgccgccggacgcgcgggctcctgaagtaccggctgctcaaggacgacgaggagaccggctaccgccggatcatcgagcgcctgaacaacaagaagggcaagaaccgcctgctcgacggggagcggctggcggaccgcaagatcgccgagctgttcagcaccaagacccacatcggc

SEQ ID NO: 12451 - RNA, 1932 nt, synthetic construct
  misc_feature 1..1932: note = derived and/or modified CDS sequence (opt1) from CCHFV(44-ST-2010)__KR814859.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagacgttccacttccacagcaagcgggtcaccgcgcacggggacaccccccagctggacctgaaggcccgccccacctacggcgccggcgagatcacggtgctcgtggaggtcgccgacatggagctgcacaccaagaaggtggagatctccgggctgaagttcgccagcctcgcgtgcaccggctgctacgcctgctccagcgggatctcctgcaaggtccggatccacgtggacgagccggacgagctgaccgtgcacgtcaagagctccgaccccgacgtggtggccgccagcacgtccctgatggcccgcaagctcgagttcggcaccgacagcaccttcaaggcgttcagcgccatgcccaagacctccctgtgcttctacatcgtcgagcgggagtactgcaagagctgctccgaggacgacaccaagaagtgcgtggacacgaagctggaccagccccagagcatcctcatcgagcacaaggggaccatcatcggcaagcagaacgacacctgcaccgccaaggcctcctgctggctggagagcgtgaagtccttcttctacggcctgaagaacatgctcgggagcgtcttcggcaacttcttcgtggggatcctgctgttcctcgccccgttcgtgctgctggtcctgttcttcatgtgcggctggaagatcctcttctgcttcaagtgctgccgccggacgcgcgggctgttcaagtaccggcacctgaaggacgacgaggagaccggctaccgccggatcatcgagcgcctcaactccaagaagggcaagaaccgcctgctggacggggagcggctcgcggaccgcaagatcgccgagctgttcagcaccaagtcccacatcggc

SEQ ID NO: 12452 - RNA, 1932 nt, synthetic construct
  misc_feature 1..1932: note = derived and/or modified CDS sequence (opt1) from CCHFV(46-ST-2012)__KR814860.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcatcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcaccgtgcacgtcaagagctccgaccccgacgtggtggccgccagcacgtccctgatggcccgcaagctggagttcggcaccgacagcaccttcaaggcgttcagcgccatgcccaagacctccctctgcttctacatcgtcgagcgggagtactgcaagagctgctccgaggaggacacccagaagtgcgtggacacgcgcctggagcagccccagagcatcctgatcgagcacaaggggaccatcatcggcaagcagaacgacacctgcaccgccaaggcctcctgctggctcgagagcgtgaagtccttcttctacggcctgaagaacatgctggggagcgtcttcggcaacttcttcatcgggatcctcctgttcctggccccgttcgtgctcctggtgctgttcttcatgttcggctggaagatcctgttctgcttcaagtgctgccggcgcacgcgggggctcctgaagtaccgccacctgaaggacgacgaggagaccggctaccggcgcatcatcgagcgcctcaacaacaagaagggcaagaaccggctgctggacggggagcgcctcgcggaccggaagatcgccgagctgttctccaccaagacccacatcggc

SEQ ID NO: 12453 - RNA, 1932 nt, synthetic construct
  misc_feature 1..1932: note = derived and/or modified CDS sequence (opt1) from CCHFV(47-ST-2013)__KR814861.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgagtgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtgctggtcgaggtggccgacatggagctccacaccaagaaggtcgaggtgtccgggctgaagttcgccagcctggcgtgcaccggctgctacgcctgctccagcgggatctcctgcaaggtgcggatccacgtcgacgagccggacgagctcaccgtgcacgtgaagagctccgaccccgacgtcgtggccgccagcacgtccctgatggcccgcaagctggagttcggcaccgacagcaccttcaaggcgttcagcgccatgcccaagacctccctctgcttctacatcgtggagcgggagtactgcaagagctgctccgaggacgacaccaagaagtgcgtcgacacgaagctggagcagccccagagcatcctgatcgagcacaaggggaccatcatcggcaagcagaacgacacctgcaccgccaaggcctcctgctggctcgagagcgtgaagtccttcttctacggcctgaagaacatgctggggagcgtgttcggcaacttcttcgtcgggatcctcctgttcctggccccgttcgtgctcctggtgctgttcttcatgttcggctggaagatcctgttctgcttcaagtgctgccgccggacgcgcgggctcttcaagtaccggcacctgaaggacgacgaggagaccggctaccgccggatcatcgagcgcctgaactccaagaagggcaagaaccgcctcctggacggggagcggctggcggaccgcaagatcgccgagctcttcagcaccaagacccacatcggc

SEQ ID NO: 12454 - RNA, 1932 nt, synthetic construct
  misc_feature 1..1932: note = derived and/or modified CDS sequence (opt1) from CCHFV(52-R-2014)__KR814862.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggacgacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagcaacgaccccgacgtggtcgccgcctccacgagcctgatggcccgcaagctggagttcggcaccgactccaccttcaaggcgttcagcgccatgcccaagaccagcctctgcttctacatcgtggagcgggagtactgcaagtcctgcagcgaggaggacacccagaagtgcgtggacacgaagctggagcagccccagtccatcctgatcgagcacaaggggaccatcatcggcaagcagaacgacacctgcaccgccaaggccggctgctggctcgagagcgtcaagtccttcttctacgggctgaagaacatgctgggcagcgtgttcgggaacttcttcatcggcatcctcctgttcctggccccgttcgtgctcctggtcctgttcttcatgttcgggtggaagatcctgttctgcttcaagtgctgccgccggacgcgcggcctcctgaagtaccggctgctcaaggacgacgaggagaccggctaccgccggatcatcgagcgcctgaacaacaagaaggggaagaaccgcctgctcgacggcgagcggctggcggaccgcaagatcgccgagctgttctccaccaagacccacatcggg

SEQ ID NO: 12455 - RNA, 1932 nt, synthetic construct
  misc_feature 1..1932: note = derived and/or modified CDS sequence (opt1) from CCHFV(75-R-2012)__KR814863.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagcgggagtactgcaagagctgctccgaggaggacacccagaagtgcgtggacacgaagctggagcagccccagagcatcctgatcgagcacaaggggaccatcatcggcaagcagaacgacacctgcaccgccaaggcctcctgctggctcgagagcgtcaagtccttcctgtacggcctgaagaacatgctcgggagcgtgttcggcaacttcttcatcgggatcctgctgttcctcgccccgttcgtgctgctggtcctgttcttcatgttcggctggaagatcctcttctgcttcaagtgctgccgccggacgcgcgggctgctgaagtaccggctcctgaaggacgacgaggagaccggctaccgccggatcatcgagcgcctgaacaacaagaagggcaagaaccgcctcctggacggggagcggctggcggaccgcaagatcgccgagctcttctccaccaagacccacatcggc

SEQ ID NO: 12456 - RNA, 1932 nt, synthetic construct
  misc_feature 1..1932: note = derived and/or modified CDS sequence (opt1) from CCHFV(75-ST-2010)__KR814864.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagcgggagtactgcaagagctgctccgaggaggacacccagaagtgcgtggacacgaagctggagcagccccagagcatcctgatcgagcacaaggggaccatcatcggcaagcagaacgacacctgcaccgccaaggcctcctgctggctcgagagcgtcaagtccttcttctacggcctgaagaacatgctggggagcgtgttcggcaacttcttcatcgggatcctcctgttcctggccccgttcgtgctcctggtcctgttcttcatgttcggctggaagatcctgttctgcttcaagtgctgccgccgggcgcgcgggctcctgaagtaccggcacctgaaggacgacgaggagacgggctaccgcaagatcatcgagcggctcaacaacaagaagggcaagaaccgcctgctggacggggagcgcctcgccgaccggaagatcgccgagctgttctccaccaagacccacatcggc

SEQ ID NO: 12457 - RNA, 1932 nt, synthetic construct
  misc_feature 1..1932: note = derived and/or modified CDS sequence (opt1) from CCHFV(3756-ST-2007)__KR814866.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtgctggtcgaggtggccgacatggagctccacaccaagaaggtcgagatctccgggctgaagttcgccagcctgacctgcaccggctgctacgcgtgctccagcgggatctcctgcaaggtgcggatccacgtggacgagccggacgagctcacggtccacgtgaagagctccgaccccgacgtggtcgccgccagcacctccctgatggcccgcaagctggagttcggcaccgacagcaccttcaaggccttcagcgcgatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacggcctgaagaacatgctggggagcgtgttcggctccttcttcgtggggatcctcctgttcctgaccccgttcgtcctcctggtgctgttcttcatgttcggctggaagatcctgttctgcttcaagtgctgccgccggacccgcgggctcttcaagtaccggcacctgaaggacgacgaggagaccggctaccgccggatcatcgagcgcctgaacagcaagaagggcaagaaccgcctcctggacggggagcggctggccgaccgcaagatcgccgagctcttctccacgaagacccacatcggc

SEQ ID NO: 12458 - RNA, 1932 nt, synthetic construct
  misc_feature 1..1932: note = derived and/or modified CDS sequence (opt1) from CCHFV(3809-ST-2007)__KR814867.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagaaggagtactgccggagctgctccgaggaggacacccagaagtgcgtggacacgaagctggagcagccccagagcatcctgatcgagcacaaggggaccatcatcggcaagcagaacgacacctgcaccgccaaggcctcctgctggctcgagagcgtcaagtccttcttctacggcctgaagaacatgctggggagcgtgttcggcaacttcttcatcgggatcctcctgttcctgacgccgttcgtgctcctggtcctgttcttcatgttcggctggaagatcctgttctgcttcaagtgctgccgccggacccgcgggctcctgaagtaccggcacctgaaggacgacgaggagaccggctaccgccggatcatcgagcgcctcaacaacaagaagggcaagaaccgcctgctggacggggagcggctcgccgaccgcaagatcgcggagctgttctccaccaagacgcacatcggc

SEQ ID NO: 12459 - RNA, 1932 nt, synthetic construct
  misc_feature 1..1932: note = derived and/or modified CDS sequence (opt1) from CCHFV(3820-ST-2007)__KR814868.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtgctggtcgaggtggccgacatggagctccacaccaagaaggtcgagatctccgggctgaagttcgccagcctgacctgcaccggctgctacgcgtgctccagcgggatctcctgcaaggtgcggatccacgtggacgagccggacgagctcacggtccacgtgaagagctccgaccccgacgtggtcgccgccagcacctccctgatggcccgcaagctggagttcggcaccgacagcaccttcaaggccttcagcgcgatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacggcctgaagaacatgctggggagcgtgttcggctccttcttcgtggggatcctcctgttcctggccccgttcgtcctcctggtgctgttcttcatgttcggctggaagatcctgttctgcttcaagtgctgccgccggacccgcgggctcttcaagtaccggcacctgaaggacgacgaggagaccggctaccgccggatcatcgagcgcctgaacagcaagaagggcaagaaccgcctcctggacggggagcggctggccgaccgcaagatcgcggagctcttctccaccaagacgcacatcggc

SEQ ID NO: 12460 - RNA, 1932 nt, synthetic construct
  misc_feature 1..1932: note = derived and/or modified CDS sequence (opt1) from CCHFV(4495-ST-2008)__KR814869.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcatcagctgggacctgggggtggaggacgcctccgagagcaagctgctcaccgtgtccatcatggacctgagccagatgtactcccccgtcttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaaggtggaggaggggttcttcgacctgatgcacgtgcagaaggtcctcagcgcctccacggtgtgcaagctgcagagctgcacccacggcatccccggggacctgcaggtgtaccacatcggcaacctcctgaagggcgaccgcgtcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcaccgtgcacgtcaagagctccgaccccgacgtggtggccgccagcacgtccctgatggcccgcaagctggagttcggcaccgacagcaccttcaaggcgttcagcgccatgcccaagacctccctctgcttctacatcgtcgagcgggagtactgcaagagctgctccgaggaggacacccagcgctgcgtggacacgaagctggagcagccccagagcatcctgatcgagcacaaggggaccatcatcggcaagcagaacgacacctgcaccgccaaggcctcctgctggctcgagagcgtgaagtccttcttctacggcctgaagaacatgctggggagcgtcttcggcaacttcttcatcgggatcctcctgttcctggccccgttcgtgctcctggtgctgttcttcatgttcggctggaagatcctgttctgcttcaagtgctgccggcgcgcgcgggggctcctgaagtaccgccacctgaaggacgacgaggagacgggctaccggaagatcatcgagcgcctcaacaacaagaagggcaagaaccgcctgctggacggggagcggctcgccgaccgcaagatcgccgagctgttctccaccaagacccacatcggc

SEQ ID NO: 12461 - RNA, 1932 nt, synthetic construct
  misc_feature 1..1932: note = derived and/or modified CDS sequence (opt1) from CCHFV(4691-ST-2009)__KR814871.1__Gc
  source 1..1932: mol_type = other RNA
ttcctcgacagcatcgtgaagggcatgaagaacctcctgaactccaccagcctggagacctccctcagcatcgaggccccctggggcgccatcaacgtccagtccacgttcaagccggcggtgagcaccgccaacatcgccctgtcctggagctccgtggagcaccgcgggaacaagatcctggtcaccgggcggagcgagtccatcatgaagctcgaggagcgcaccggcgtgagctgggacctgggggtggaggacgcctccgagagcaagctgctcacggtctccatcatggacctgagccagatgtactcccccgtgttcgagtacctgagcggcgaccgccaggtggaggagtggcccaaggcgacctgcaccggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggccggcacccgcttcaacctgggccccgtcacgatcaccctgtccgagccccggaacatccagcagaagctcccgcccgagatcatcaccctgcaccccaagatcgaggaggggttcttcgacctgatgcacgtgcagaaggtgctcagcgcctccaccgtctgcaagctgcagagctgcacgcacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacaccggcgtgacgcagcacaaccacgccgcgttcgtcaacctgctgaacatcgagaccgactacaccaagaccttccacttccacagcaagcgggtgacggcccacggggacacgccccagctcgacctgaaggcccgccccacctacggcgccggcgagatcaccgtgctggtcgaggtggccgacatggagctccacaccaagaaggtcgagatctccgggctgaagttcgcgagcctggcctgcaccggctgctacgcctgctccagcgggatctcctgcaaggtgcggatccacgtggacgagccggacgagctcaccgtccacgtcaagagctccgaccccgacgtggtggccgccagcacctccctgatggcgcgcaagctggagttcggcacggacagcaccttcaaggccttcagcgccatgcccaagacctccctctgcttctacatcgtggagcgggagtactgcaagagctgctccgaggacgacaccaagaagtgcgtggacaccaagctggagcagccccagagcatcctgatcgagcacaaggggacgatcatcggcaagcagaacgacacgtgcaccgccaaggcctcctgctggctcgagagcgtcaagtccttcttctacggcctgaagaacatgctggggagcgtgttcggcaacttcttcgtggggatcctcctgttcctggcgccgttcgtcctcctggtgctgttcttcatgttcggctggaagatcctgttctgcttcaagtgctgccgccggacccgcggcctcttcaagtaccggcacctgaaggacgacgaggagaccgggtaccgccggatcatcgagcgcctgaactccaagaagggcaagaaccgcctcctggacggggagcggctggccgaccgcaagatcgccgagctgttcagcaccaagacccacatcggc

SEQ ID NO: 12462 - RNA, 1932 nt, synthetic construct
  misc_feature 1..1932: note = derived and/or modified CDS sequence (opt1) from CCHFV(4701-ST-2009)__KR814872.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtgctggtcgaggtggccgacatggagctccacaccaagaaggtcgagatctccgggctgaagttcgccagcctgacctgcaccggctgctacgcgtgctccagcgggatctcctgcaaggtgcggatccacgtggacgagccggacgagctcacggtccacgtgaagagctccgaccccgacgtggtcgccgccagcacctccctgatggcccgcaagctggagttcggcaccgacagcaccttcaaggccttcagcgcgatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacggcctgaagaacatgctggggagcgtgttcggcgggttcttcgtgggcatcctcctgttcctggccccgttcgtcctcctggtgctgttcttcatgttcgggtggaagatcctgttctgcttcaagtgctgccgccggacccgcggcctcttcaagtaccggcacctgaaggacgacgaggagaccggctaccgccggatcatcgagcgcctgaactccaagaaggggaagaaccgcctcctggacggcgagcggctggccgaccgcaagatcgcggagctcttcagcaccaagacgcacatcggg

SEQ ID NO: 12463 - RNA, 1932 nt, synthetic construct
  misc_feature 1..1932: note = derived and/or modified CDS sequence (opt1) from CCHFV(Oman-199809166)__KR864901.1__Gc
  source 1..1932: mol_type = other RNA
ttcctcgacagcatcgccaagggcatgaagaacctcctgaactccaccagcctggagacctccctcagcatcgaggccccctggggcgcgatcaacgtgcagtccacgttcaagccgaccgtgagcaccgccaacatcgccctgtcctggagctccgtggagcaccgcgggaacaagatcctggtgagcgggcggtccgagagcatcatgaagctcgaggagcgcaccggcatctcctgggacctgggggtcgaggacgccagcgagtccaagctgctcacggtgagcgtgatggacctgtcccagatgtacagccccgtcttcgagtacctgtccggcgaccgccaggtggaggagtggcccaaggcgacctgcaccggcgactgccccgagcggtgcgggtgcaccagcagcacgtgcctccacaaggagtggccgcactcccggaactggcgctgcaaccccacctggtgctggggcgtggggaccggctgcacgtgctgcgggctggacgtcaaggacctgttcaccgactacatgttcgtgaagtggaaggtggagtacatcaagaccgaggccatcgtctgcgtggagctcaccagccaggagcggcagtgctccctgatcgaggccggcacccgcttcaacctgggccccgtgacgatcaccctcagcgagccccggaacatccagcagaagctgccgcccgagatcgtcaccctgcacccccgcatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaaggtggagccgcacttcaacaccagctggatgtcctgggacggctgcgacctggactactactgcaacatgggggactggcccagctgcacctacaccggcgtgacgcagcacaaccacgccgcgttcgtcaacctgctcaacatcgagaccgactacaccaagaacttccacttccactccaagcgggtgaccgcccacggggacacgccccagctggacctgaaggcccgccccaactacggcgccggcgagatcaccgtcctcgtggaggtggccgacatggagctgcacaccaagaagatcgagatcagcgggctgaagttcgcgtccctgacctgcacgggctgctacgcctgcagctccgggatcagctgcaaggtccggatccacgtggacgagccggacgagctcaccgtgcacgtcaagtccgaggaccccgacatcgtggccgccagctccagcctgatggcccgcaagctcgagttcggcaccgacagcaccttcaaggcgttctccgccatgcccaagacgagcctgtgcttctacatcgtggagcgggagtactgcaagtcctgcagcaaggaggacacccagaagtgcgtcaacgccaagctggagcgcccccagtccatcctcatcgagcacaaggggaccatcatcggcaagcagaacgacacgtgcaccgccaaggccagctgctggctggagtccgtcaagagcttcttctacggcctgaagaacatgctctccgggatcttcggcaacgtgttcatcgggatcttcctgttcctggcgccgttcatcctcctgatcctgttcttcatgttcggctggcggatcctgttctgcttcaagtgctgccgccggacccgcggcctcttcaagtaccggcacctgaaggacgacgaggagaccgggtaccgcaagatcatcgagcgcctgaacaacaagaagggcaagaacaagctcctggacggggagcggctggccgaccgcaagatcgccgagctgttcagcaccaagacccacatcggc

SEQ ID NO: 12464 - RNA, 1932 nt, synthetic construct
  misc_feature 1..1932: note = derived and/or modified CDS sequence (opt1) from CCHFV(200406546-Turkey)__KR864902.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccatcgagcaccgcggcaacaagatcctggtgaccgggcggagcgagtccatcatgaagctcgaggagcgcacgggcgtcagctgggacctgggggtggaggacgcctccgagagcaagctgctcaccgtgtccatcatggacctgagccagatgtactcccccgtcttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtggggaccggctgcacgtgctgcggggtcgacgtgaaggacctgttcaccgaccacatgttcgtgaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaaggtggaggaggggttcttcgacctgatgcacgtgcagaaggtcctcagcgcctccacggtgtgcaagctgcagagctgcacccacggcatccccggggacctgcaggtgtaccacatcggcaacctcctgaagggcgaccgcgtcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcaccgtgcacgtcaagagctccgaccccgacgtggtggccgccagcacgtccctgaccgcccgcaagctggagttcggcaccgacagcaccttcaaggcgttcagcgccatgcccaagacctccctctgcttctacatcgtcgagaaggagtactgcaagagctgcaacgaggacgacacgcagaagtgcgtggacaccaagctggagcagccccagtccatcctgatcgagcacaaggggaccatcatcggcaagcagaacgacacctgcacggccaaggccagctgctggctcgagtccgtgaagagcttcttctacggcctgaagaacatgctggggtccgtcttcggcaacttcttcatcgggatcctcctgttcctggccccgttcgtgctcctggtgctgttcttcatgttcggctggaagatcctgttctgcttcaagtgctgccggcgcacccgggggctcttcaagtaccgccacctgaaggacgacgaggagaccggctacaagcggatcatcgagcgcctgaacaacaagaagggcaagaaccggctcctggacggggagcgcctggcggaccgcaagatcgccgagctcttcagcaccaagacgcacatcggc

SEQ ID NO: 12465 - RNA, 1932 nt, synthetic construct
  misc_feature 1..1932: note = derived and/or modified CDS sequence (opt1) from CCHFV(1-CR/HU-2015)__KU161584.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaagatcgaggaggggttcttcgacctgatgcacgtgcagaaggtcctcagcgcctccacggtgtgcaagctgcagagctgcacccacggcatccccggggacctgcaggtgtaccacatcggcaacctcctgaagggcgaccgcgtcaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtgaacctgctgaacatcgagaccgactacaccaagacgttccacttccacagcaagcgggtcaccgcgcacggggacaccccccagctcgacctgaaggcccgccccacctacggcgccggcgagatcacggtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcaccgtgcacgtcaagagctccgaccccgacgtggtggccgccagcacgtccctgatggcccgcaagctggagttcggcaccgacagcaccttcaaggcgttcagcgccatgcccaagacctccctctgcttctacatcgtcgagcgggagtactgcaagagctgctccgaggacgacaccaagaagtgcgtggacacgaagctggagcagccccagagcatcctgatcgagcacaaggggaccatcatcggcaagcagaacgacacctgcaccgccaaggcctcctgctggctcgagagcgtgaagtccttcttctacggcctgaagaacatgctggggagcgtcttcggcaacttcttcatcgggatcctcctgttcctggccccgttcgtgctcctggtgctgttcttcatgttcggctggaagatcctgttctgcttcaagtgctgccgccggacgcgcgggctcttcaagtaccggcacctgaaggacgacgaggagaccggctaccgccggatcatcgagcgcctgaacaacaagaagggcaagaaccgcctcctggacggggagcggctggcggaccgcaagatcgccgagctcttctccaccaagacccacatcggc

SEQ ID NO: 12466 - RNA, 1932 nt, synthetic construct
  misc_feature 1..1932: note = derived and/or modified CDS sequence (opt1) from CCHFV(Gaib)__KX013445.1__Gc
  source 1..1932: mol_type = other RNA
ttcagcgactccatcgtgaagggcatgaagaacctgctcaacagcacctccctggagaccagcctgtccatcgaggccccctggggcgccatcaacgtccagagcacgttcaagccgaccgtgtccaccgcgaacatcgccctcagctggtccagcatcgagcaccgcgggaacaagatcctggtgtccgggcggagcgagtccatcatgaagctggaggagcgcaccggcatcagctgggacctcggggtcgaggacgcctccgagagccggctgctgacggtgtccgtgatggacctcagccagatgtactcccccgtcttcgagtacctgagcggcgaccgccaggtggaggagtggcccaaggcgacctgcaccggcgactgccccgagcggtgcgggtgcaccagctccacgtgcctgcacaaggagtggccgcacagccgcaactggcggtgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgacctcccaggagcgccagtgcagcctcatcgaggccggcacccggttcaacctgggccccgtgacgatcaccctgtccgagccccgcaacatccagcagaagctcccgcccgagatcatcaccctgcacccccggatcgaggaggggttcttcgacctgatgcacgtccagaaggtgctcagcgcctccaccgtgtgcaagctgcagagctgcacgcacggcgtccccggggacctccaggtgtaccacatcggcaacctgctgaagggcgacaaggtgaacgggcacctgatccacaagatcgagccgcacttcaacacctcctggatgagctgggacggctgcgacctcgactactactgcaacatgggggactggccctcctgcacctacaccggcgtcacgcagcacaaccacgccgccttcgtgaacctgctgaacatcgagaccgactacaccaagaacttccacttccacagcaagcgcgtgaccgcgcacggggacacgccccagctcgacctgaaggcccggcccacctacggcgccggcgagatcaccgtcctggtggaggtcgccgacatggagctccacaccaagaagatcgagatctccgggctgaagttcgccagcctgacgtgcaccggctgctacgcgtgctccagcgggatctcctgcaaggtgcgcatccacgtggacgagccggacgagctcaccgtccacgtcaagagcgaggaccccgacatcgtggccgcctccagcagcctgatggcccggaagctggagttcggcaccgactccacgttcaaggccttcagcgcgatgcccaagacctccctctgcttctacatcgtggagcgcgagtactgcaagagctgctcccgggaggacacccagaagtgcgtgagcaccaagctggagcagccccagtccatcctgatcgagcacaaggggaccatcatcggcaagcagaacaacacgtgcaccaccaagaccacgtgctggctcgagagcgtgaagtccttcttctacggcctgaagaacatgctgagctccatcttcgggaacgtcttcgtgggcatcttcagcttcctcgccccgttcatcctgctgatcctcttcttcatgttcgggtggcgcatcctgttctgcttcaagtgctgccggcgcacccggggcctgttcaagtaccgccacctgaaggacgacgaggagaccgggtaccgccggatcatcgagcgcctcaacaacaagaagggcaagtccaagctgctggacggcgagcggctcgccgaccgcaagatcgccgagctgttcagcaccaagacgcacatcggg

SEQ ID NO: 12467 - RNA, 1932 nt, synthetic construct
  misc_feature 1..1932: note = derived and/or modified CDS sequence (opt1) from CCHFV(Hodzha)__KX013448.1__Gc
  source 1..1932: mol_type = other RNA
ttcctcgacagcatcgtgaagggcaagaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgcagcgagcggtgcgggtgcaccagctccacgtgcctccacaaggagtggccccacagccggaactggcgctgcaacccgacctggtgctggggcgtcgggaccggctgcacgtgctgcgggctggacgtgaaggacctgttcaccgactacatgttcgtgaagtggaaggtcgactacatcaagaccgaggccatcgtgtgcgtggagctcacctcccaggagcggcagtgcagcctggtcgaggccggcacccgcttcaacctgggccccgtgacgatcaccctctccgagccccggaacatccagcagaagctgcccccggagatcatcaccctgcacccccgcatcgaggaggggttcttcgacctcatgcacgtgcagaaggtcctgagcgcctccaccgtgtgcaagctgcagagctgcacgcacggcgtgcccggggacctccaggtctaccacatcggcaacctgctgaagggcgacaaggtgaacgggcacctcatccacaagatcgagccccacttcaacacctcctggatgagctgggacggctgcgacctggactactactgcaacatgggggactggccgtcctgcacctacaccggcgtgacgcagcacaaccacgccagcttcgtcaacctgctcaacatcgagaccgactacaccaagtccttccacttccacagcaagcgggtgaccgcccacggggacacgccccagctggacctgaaggcgcgccccacctacggcgccggcgagatcaccgtcctcgtggaggtggccgacatggagctgcacaccaagaagatcgagatcacggggctgaagttcgcctccctgacctgcaccggctgctacgcctgcagctccgggatcagctgcaaggtccggatccacgtggacgagcccgacgagctcaccgtgcacgtcaagtccgacgacccggacgtggtggcggccagcagctccctgatggcccgcaagctcgagttcggcacggacagcaccttcaaggccttctccgccatgcccaagaccagcctgtgcttctacatcgtcgagcgggagtactgcaagtcctgcagcaaggaggacacccagaagtgcgtgaacaccaagctggagcagccccagtccatcctcatcgagcagaaggggacgatcatcggcaagcagaacaacacgtgcaccgcgaaggccagctgctggctggagtccgtcaagagcttcttctacggcctgaagaacatgctctccgggatcttcggcaacgtgttcgtggggatcttcctgttcctggcccccttcatcctcctgatcctgttcttcatgttcggctggcgcatcctgttctgcttcaagtgctgccggcgcacccggggcctcttcaagtacaagcacctgaaggacgacgaggagaccgggtaccgccggatcatcgagcgcctgaacaacaagaagggcaagaacaagctcctggacggggagcgcctggccgaccggcgcatcgccgagctgttcagcaccaagacccacatcggc

SEQ ID NO: 12468 - RNA, 1932 nt, synthetic construct
  misc_feature 1..1932: note = derived and/or modified CDS sequence (opt1) from CCHFV(IbAn7620)__KX013451.1__Gc
  source 1..1932: mol_type = other RNA
ttcctggacagcatcgccaagggcatgaagaaccccctcaactccaccagcctggagacctccctgagcatcgaggccccgtggggcgcgatcgacgtgcagtccacgtacaagcccaccgtcagcaccgccaacatcgccctctcctggagctccgtggagcaccgcgggaacaagatcctggtgagcgggcggtccgagagcatcatgaagctggaggagcgcaccggcatctcctgggacctcggggtcgaggacgccagcgagtccaagctgctgacggtgagcgtgatggacctctcccagatgtacagccccgtcttcgagtacctgtccggcgaccgccaggtggaggagtggcccaaggcgacctgcaccggcgactgcccggagcggtgcgggtgcaccagcagcacgtgcctgcacaaggagtggccccactcccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgaccagccaggagcggcagtgctccctcatcgaggccggcacccgcttcaacctgggccccgtgacgatcaccctgagcgagccgcggaacatccagcagaagctcccgcccgagatcatcaccctgcacccccgcatcgaggaggggttcttcgacctgatgcacgtccagaaggtgctctccgccagcaccgtgtgcaagctgcagtcctgcacgcacggcgtccccggggacctccaggtgtaccacatcggcaacctgctgaagggcgacaaggtgaacgggcacctgatccacaagatcgagccccacttcaacaccagctggatgtcctgggacggctgcgacctcgactactactgcaacatgggggactggcccagctgcacctacaccggcgtcacgcagcacaaccacgcctccttcgtgaacctgctgaacatcgagaccgactacaccaagaacttccacttccacagcaagcgggtgaccgcgcacggggacacgccccagctcgacctgaaggcccgcccgacctacggcgccggcgagatcaccgtcctggtggaggtcgccaacatggagctccacaccaagaagatcgagatctccgggctgaagttcgccagcctgacgtgcaccggctgctacgcgtgctccagcgggatctcctgcaaggtgcggatccacgtggacgagcccgacgagctcaccgtccacgtcaagagcgacgaccccgacgtggtggccgcctccagcagcctgatggcccgcaagctggagttcggcaccgactccacgttcaaggccttcagcgcgatgcccaagacctccctctgcttctacatcgtggagcgggagcactgcaagagctgctccgaggaggacaccaagaagtgcgtgaacaccaagctggagcagccgcagagcatcctgatcgagcacaaggggaccatcatcggcaagcagaactccacgtgcaccgccaaggccagctgctggctcgagtccgtcaagagcttcttctacggcctgaagaacatgctgtccgggatcttcggcaacgtgttcatggggatcttcctcttcctggcccccttcatcctgctcatcctgttcttcatgttcggctggcgcatcctgttctgcttcaagtgctgccggcgcacccgggggctgttcaagtaccgccacctcaaggacgacgaggagaccggctaccggcgcatcatcgagcgcctgaacaacaagaagggcaagaacaagctgctcgacggggagcggctggccgaccgccggatcgcggagctgttcagcacgaagacccacatcggc

SEQ ID NO: 12469 - RNA, 1932 nt, synthetic construct
  misc_feature 1..1932: note = derived and/or modified CDS sequence (opt1) from CCHFV(K128_76)__KX013454.1__Gc
  source 1..1932: mol_type = other RNA
ttccaggacagcatcgtgaagggcatgaagaacctgctcaactccaccagcctggagacctccctgagcatcgaggccccctggggcgccatcaacgtccagtccacgtacaagccggcggtgagcgccgccaacatcgccctctcctggagctccgtggagcaccgcgggagcaagatcctggtctccgggcggagcgagtccatcatgaagctggaggagcgcaccggcatcagctgggacctcggggtggaggacgcctccgagagcaagctgctgaccgtgtccgtcatggacctcagccagatgtactcccccgtgttcgagtacctgagcggcgaccgccaggtggaggagtggcccaaggcgacctgcacgggcgactgccccgagcggtgcgggtgcaccagctccacgtgcctgcacaaggagtggccgcacagccggaactggcgctgcaaccccacctggtgctggggcgtcgggaccggctgcacgtgctgcgggctcgacgtgaaggacctgttcaccgactacatgttcgtgaagtggaaggtcgagtacatcaagaccgaggccatcgtgtgcgtggagctgacctcccaggagcggcagtgcagcctcatcgaggccggcacccgcttcaacctgggccccgtcaccatcaccctgtccgagccccggaacatccagcagaagctcccgcccgagatcatcacgctgcacccccgcatcgaggaggggttcttcgacctgatgcacgtgcagaaggtgctcagcgcctccaccgtctgcaagctgcagagctgcacccacggcgtgcccggggacctccaggtgtaccacatcggcaacctgctgaagggcgaccgggtcaacgggcacctgatccacaagatcgagccgcacttcaacacctcctggatgagctgggacggctgcgacctcgactactactgcaacatgggggactggccctcctgcacgtacaccggcgtgacccagcacaaccacgcgagcttcgtgaacctgctgaacatcgagaccgactacacgaagtccttccacttccacagcaagcgcgtcaccgcccacggggacacgccccagctcgacctgaaggcccggcccaactacggcgccggcgagatcaccgtgctggtcgaggtggccgacatggagctccacaccaagaagatcgagatctccgggctgaagttcgcgagcctgacctgcaccggctgctacgcctgctccagcgggatctcctgcaaggtgcgcatccacgtcgacgagccggacgagctcaccgtgcacgtcaagagcgacgaccccgacgtggtggccgccagctccagcctgatggcccggaagctggagttcggcacggactccaccttcaaggcgttcagcgccatgcccaagacctccctctgcttctacatcgtggagcgcgagtactgcaagagctgctccaaggaggacacccagaagtgcgtcaacacgaagctggagcagccccagagcatcctgatcgagcacaaggggaccatcatcggcaagcagaacaacacgtgcaccgccaagacctcctgctggctcgagagcgtgaagtccttcttctacggcctgaagaacatgctgagcgggatcttcggcaacgtgttcgtcgggatcttcctcttcctggccccgttcatcctgctcatcctgttcttcatgttcggctggcggatcctgttctgcttcaagtgctgccgccggacccgcgggctgttccggtacaagcacctcgagaacgacgaggagaccggctaccgccgcatcatcgagcggctgaacaacaagaagggcaagaacaagctgctcgacggggagcgcctggccgaccggcgcatcgcggagctgttctccaccaagacccacatcggc

SEQ ID NO: 12470 - RNA, 1932 nt, synthetic construct
  misc_feature 1..1932: note = derived and/or modified CDS sequence (opt1) from CCHFV(K168_40)__KX013457.1__Gc
  source 1..1932: mol_type = other RNA
ttcctcgacggcatcgtgaaggggatgaagaacctcctgaacagcacctccctggagaccagcctctccatcgaggccccctggggcgccatcaacgtccagagcacgtacaagccgaccgtgtccgcggccaacatcgccctgagctggtccagcgtggagcaccgcgggaacaagatcctggtctccggccggagcgagtccatcatgaagctcgaggagcgcaccgggatcagctgggacctgggcgtggaggacgcctccgagagcaagctgctcaccgtgtccgtcatggacctgagccagatgtactcccccgtgttcgagtacctgagcggcgaccgccaggtggaggagtggcccaaggccacgtgcaccggggactgccccgagcggtgcggctgcacctccagcacgtgcctccacaaggagtggccgcacagccggaactggcgctgcaaccccacctggtgctggggcgtcgggaccgggtgcacgtgctgcggcctggacgtgaaggacctgttcaccgactacatgttcgtgaagtggaaggtcgagtacatcaagaccgaggcgatcgtgtgcgtggagctcacctcccaggagcggcagtgcagcctgatcgaggccggcacccgcttcaacctggggcccgtcaccatcacgctctccgagccccggaacatccagcagaagctgccgcccgagatcatcaccctgcacccccgcatcgaggagggcttcttcgacctcatgcacgtgcagaaggtgctgagcgcctccaccgtctgcaagctgcagagctgcacccacggggtgcccggcgacctccaggtgtaccacatcggcaacctgctgaagggggacaaggtcaacggccacctcatccacaagatcgagccgcacttcaacacgtcctggatgagctgggacgggtgcgacctggactactactgcaacatgggcgactggccctcctgcacctacaccggggtgacccagcacaaccacgccagcttcatcaacctgctcaacatcgagacggactacaccaagtccttccacttccacagcaagcgggtgaccgcgcacggcgacacgccccagctggacctgaaggcccgccccaactacggcgccggggagatcaccgtcctcgtggaggtcgccgacatggagctgcacaccaagaagatcgagatctccggcctgaagttcgccagcctgacctgcaccgggtgctacgcgtgctccagcggcatctcctgcaaggtgcggatccacgtggacgagccggacgagctcacggtccacgtcaagagcgacgaccccgacgtggtggccgcctccagcagcctgatggcccgcaagctcgagttcgggaccgactccaccttcaaggccttcagcgcgatgcccaagacctccctgtgcttctacatcgtggagcgggagtactgcaagagctgctccaaggaggacacgcagaagtgcgtgaacaccaagctggagcacccccagagcatcctcatcgagcacaagggcaccatcatcggcaagcagaacaacacgtgcaccgccaagacctcctgctggctggagagcgtcaagtccttcttctacgggctgaagaacatgctcagcggcatcttcgggaacgtgttcgtgggcatcttcctgttcctggccccgttcatcctcctgatcctgttcttcatgttcgggtggcgcatcctgttctgcttcaagtgctgccggcgcacccggggcctcttccgctacaagcacctggaggacgacgaggagaccggctaccggcgcatcatcgagcgcctgaacaacaagaaggggaagaacaagctcctggacggcgagcggctggccgaccgccggatcgccgagctgttctccaccaagacgcacatcggg

SEQ ID NO: 12471 - RNA, 1932 nt, synthetic construct
  misc_feature 1..1932: note = derived and/or modified CDS sequence (opt1) from CCHFV(K168_125)__KX013460.1__Gc
  source 1..1932: mol_type = other RNA
ttcctcgacagcatcgtgaagggcaagaagaacctcctgaactccaccagcctggagacctccctcagcatcgaggccccctggggcgccatcaacgtccagtccacgtacaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgagtacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcatcaccctgcacccccgcatcgaggaggggttcttcgacctcatgcacgtgcagaaggtgctgtccgccagcaccgtctgcaagctgcagtcctgcacccacggcgtgcccggggacctccaggtgtaccacatcggcaacctgctgaagggcgacaaggtcaacgggcacctcatccacaagatcgagccgcacttcaacacgagctggatgtcctgggacggctgcgacctggactactactgcaacatgggggactggcccagctgcacctacaccggcgtgacccagcacaaccacgcctccttcatcaacctgctcaacatcgagacggactacaccaagagcttccacttccactccaagcgggtgaccgcgcacggggacacgccccagctggacctgaaggcccgccccaactacggcgccggcgagatcaccgtcctcgtggaggtcgccgacatggagctgcacaccaagaagatcgagatcagcgggctgaagttcgcctccctgacctgcaccggctgctacgcgtgcagctccgggatcagctgcaaggtgcggatccacgtggacgagccggacgagctcacggtccacgtgaagtccgacgaccccgacgtggtcgccgccagcagctccctgatggcccgcaagctcgagttcggcaccgacagcaccttcaaggccttctccgcgatgcccaagaccagcctgtgcttctacatcgtggagcgggagtactgcaagtcctgcagcaaggaggacacgcagaagtgcgtgaacaccaagctggagcacccccagtccatcctcatcgagcacaaggggaccatcatcggcaagcagaacaacacgtgcaccgccaagaccagctgctggctggagtccgtcaagagcttcttctacggcctgaagaacatgctctccgggatcttcggcaacgtgttcgtggggatcttcctgttcctggccccgttcatcctcctgatcctgttcttcatgttcggctggcgcatcctgttctgcttcaagtgctgccggcgcacccggggcctcttccgctacaagcacctggaggacgacgaggagaccgggtaccggcgcatcatcgagcgcctgaacaacaagaagggcaagaacaagctcctggacggggagcggctggccgaccgccggatcgccgagctgttcagcaccaagacgcacatcggc

SEQ ID NO: 12472 - RNA, 1932 nt, synthetic construct
  misc_feature 1..1932: note = derived and/or modified CDS sequence (opt1) from CCHFV(K229_194)__KX013463.1__Gc
  source 1..1932: mol_type = other RNA
ttcctggacagcatcgtgaagggcaagaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagacgttccacttccacagcaagcgggtcaccgcgcacggggacaccccccagctggacctgaaggcccgccccacctacggcgccggcgagatcacggtgctcgtggaggtcgccgacatggagctgcacaccaagaaggtggagatctccgggctgaagttcgccagcctcgcgtgcaccggctgctactcctgcagctccgggatcagctgcaaggtccggatccacgtggacgagccggacgagctgaccgtgcacgtcaagtccagcgaccccgacgtggtggccgcctccacgagcctgatggcccgcaagctcgagttcggcaccgacagcaccttcaaggccttctccgcgatgcccaagaccagcctgtgcttctacatcgtcgagcgggagtactgcaagtcctgcagcgaggacgacaccaagaagtgcgtggacacgaagctggagcagccccagtccatcctcatcgagcacaaggggaccatcatcggcaagcagaacgacacctgcaccgccaaggccagctgctggctggagtccgtgaagagcttcttctacggcctgaagaacatgctcgggtccgtcttcggcaacttcttcgtggggatcctgctgttcctcgccccgttcgtgctgctggtcctgttcttcatgttcggctggaagatcctcttctgcttcaagtgctgccgccggacgcgcgggctgttcaagtaccggcacctgaaggacgacgaggagaccggctaccgcaagatcatcgagcggctcaacagcaagaagggcaagaaccgcctgctggacggggagcgcctcgccgaccggaagatcgcggagctgttctccaccaagacccacatcggc

SEQ ID NO: 12473 - RNA, 1932 nt, synthetic construct
  misc_feature 1..1932: note = derived and/or modified CDS sequence (opt1) from CCHFV(K229_243)__KX013466.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagaaggagtactgcaagagctgctccgaggaggacacccagaagtgcgtggacacgaagctggagcagccccagagcatcctgatcgagcacaaggggaccatcatcggcaagcagaacgacacctgcaccgccaaggcctcctgctggctcgagagcgtcaagtccttcttctacggcctgaagaacatgctggggagcgtgttcggcaacttcttcatcgggatcctcctgttcctgacgccgttcgtgctcctggtcctgttcttcatgttcggctggaagatcctgttctgcttcaagtgctgccggcgcacccgggggctcctgaagtaccgccacctgaaggacgacgaggagaccggctaccggcgcatcatcgagcggctcaacaacaagaagggcaagaaccgcctgctggacggggagcgcctcgccgaccggaagatcgcggagctgttctccaccaagacgcacatcggc

SEQ ID NO: 12474 - RNA, 1932 nt, synthetic construct
  misc_feature 1..1932: note = derived and/or modified CDS sequence (opt1) from CCHFV(K315_14)__KX013469.1__Gc
  source 1..1932: mol_type = other RNA
ttcctggacagcatcgtgaagggcatgaagaagctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtgctggtcgaggtggccgacatggagctccacaccaagaaggtcgagatctccgggctgaagttcgccagcctgacctgcaccggctgctacgcgtgctccagcgggatctcctgcaaggtgcggatccacgtggacgagccggacgagctcacggtccacgtgaagagctccgaccccgacgtggtcgccgccagcacctccctgatggcccgcaagctggagttcggcaccgacagcaccttcaaggccttcagcgcgatgcccaagacctccctctgcttctacatcgtggagcgggagtactgcaagagctgctccgaggacgacacgaagaagtgcgtggacaccaagctggagcagccccagagcatcctgatcgagcacaaggggaccatcatcggcaagcagaacgacacctgcacggccaaggcctcctgctggctcgagagcgtcaagtccttcttctacggcctgaagaacatgctggggagcgtgttcggctccttcttcgtggggatcctcctgttcctggccccgttcgtcctcctggtgctgttcttcatgttcggctggaagatcctgttctgcttcaagtgctgccgccggacccgcgggctcttcaagtaccggcacctgaaggacgacgaggagaccggctaccgccggatcatcgagcgcctgaacagcaagaagggcaagaaccgcctcctggacggggagcggctggccgaccgcaagatcgcggagctcttctccaccaagacgcacatcggc

SEQ ID NO: 12475 - RNA, 1932 nt, synthetic construct
  misc_feature 1..1932: note = derived and/or modified CDS sequence (opt1) from CCHFV(K323_27)__KX013472.1__Gc
  source 1..1932: mol_type = other RNA
ttcctggacagcatcgccaagggcatgaagaacctcctgaactccaccagcctggagacctccctcagcatcgaggccccctggggggcgatcaacgtgcagtccacgttcaagccgaccgtcagcaccgccaacatcgccctgtcctggagctccgtggagcaccgcggcaacaagatcctggtgaccgggcggagcgagtccatcatgaagctcgaggagcgcacgggcgtcagctgggacctgggggtggaggacgcctccgagagcaagctgctcaccgtgtccatcatggacctgagccagatgtactcccccgtcttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtggggaccggctgcacgtgctgcggggtcgacgtgaaggacctgttcaccgaccacatgttcatcaagtggaaggtggagtacatcaagaccgaggcgatcgtctgcgtggagctgaccggccaggagcggcagtgctccctcatcgaggccggcacgcgcttcaacctggggcccgtgaccatcaccctgagcgagccccggaacatccagcagaagctcccgcccgagatcatcaccctgcaccccaagatcgaggagggcttcttcgacctgatgcacgtccagaaggtgctctccgccagcacggtgtgcaagctgcagtcctgcacccacgggatccccggcgacctgcagatctaccacatcggcaacctcctgaagggggaccgcgtcaacggccacctgatccacaagatcgagccgcacttcaacaccagctggatgtcctgggacgggtgcgacctcgactactactgcaacatgggcgactggcccagctgcacctacacgggggtgacccagcacaaccacgccgcgttcgtgaacctgctgaacatcgagaccgactacaccaagacgttccacttccactccaagcgggtcaccgcccacggcgacaccccccagctcgacctgaaggcccgccccacctacggcgccggggagatcacggtgctggtggaggtcgccgacatggagctccacaccaagaaggtggagatcagcggcctgaagttcgcgtccctgacctgcaccgggtgctacgcctgcagctccggcatcagctgcaaggtccggatccacgtggacgagccggacgagctcacggtgcacgtcaagtccagcgaccccgacgtggtggccgcctccaccagcctgatggcccgcaagctggagttcgggaccgactccaccttcaaggcgttcagcgccatgcccaagaccagcctctgcttctacatcgtcgagcgggagtactgcaagtcctgcagcgaggacgacacgaagaagtgcgtggacaccaagctggagcagccccagtccatcctgatcgagcacaagggcaccatcatcggcaagcagaacgacacctgcacggccaaggccagctgctggctcgagtccgtgaagagcttcttctacgggctgaagaacatgctgggctccgtcttcgggagcttcttcgtgggcatcctcctgttcctggccccgttcgtgctcctggtcctgttcttcatgttcgggtggaagatcctgttctgcttcaagtgctgccgccggacccgcggcctcttcaagtaccggcacctgaacgacgacgaggagaccggctaccgccggatcatcgagcgcctgaactccaagaaggggaagaaccgcctcctggacggcgagcggctggcggaccgcaagatcgccgagctcttcagcaccaagacgcacatcggg

SEQ ID NO: 12476 - RNA, 1932 nt, synthetic construct
  misc_feature 1..1932: note = derived and/or modified CDS sequence (opt1) from CCHFV(K340_6)__KX013475.1__Gc
  source 1..1932: mol_type = other RNA
agcctggactccatcgtgaagggcatgaagaacctcctgaacagcacctccctggagaccagcctctccatcgaggccccctggggggccatcaacgtccagagcacgttcaagccgaccgtgtccaccgcgaacatcgccctgagctggtccagcgtggagcaccgcggcaacaagatcctggtcaccgggcggtccgagagcatcatgaagctcgaggagcgcacgggcgtgtcctgggacctgggggtggaggacgccagcgagtccaagctgctcaccgtcagcatcatggacctgtcccagatgtacagccccgtgttcgagtacctgtccggcgaccggcaggtggaggagtggcccaaggccacctgcaccggcgactgccccgagcgctgcgggtgcacgagcagcacctgcctccacaaggagtggccgcactcccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgaccagccaggagcggcagtgctccctcatcgaggcgggcacgcgcttcaacctgggccccgtcaccatcaccctgagcgagccccggaacatccagcagaagctcccgcccgagatcatcaccctgcaccccaagatcgaggaggggttcttcgacctgatgcacgtgcagaaggtgctctccgccagcacggtctgcaagctgcagtcctgcacccacggcatccccggggacctgcagatctaccacatcggcaacctcctgaagggcgaccgcgtgaacgggcacctgatccacaagatcgagccgcacttcaacaccagctggatgtcctgggacggctgcgacctcgactactactgcaacatgggggactggcccagctgcacctacacgggcgtgacccagcacaaccacgccgccttcgtcaacctgctgaacatcgagaccgactacaccaagacgttccacttccactccaagcgggtgaccgcgcacggggacaccccccagctcgacctgaaggcccgccccacctacggcgccggcgagatcacggtgctggtcgaggtgaccgacatggagctccacaccaagaaggtcgagatcagcgggctgaagttcgcctccctgacctgcacgggctgctacgcctgcagctccgggatcagctgcaaggtgcggatccacgtggacgagccggacgagctcaccgtccacgtgaagtccagcgaccccgacgtggtcgcggcctccaccagcctgatggcccgcaagctggagttcggcaccgacagcaccttcaaggccttctccgccatgcccaagacgagcctctgcttctacatcgtggagcgggagtactgcaagtcctgcagcgaggacgacaccaagaagtgcgtggacaccaagctggagcagccccagtccatcctgatcgagcacaaggggaccatcatcggcaagcagaacgacacgtgcaccgcgaaggccagctgctggctcgagtccgtcaagagcttcttctacggcctgaagaacatgctggggtccgtgttcggcagcttcttcgtggggatcctcctgttcctggccccgttcgtcctcctggtgctgttcttcatgttcggctggaagatcctgttctgcttcaagtgctgccgccggacccgcgggctcttcaagtaccggcacttcaaggacgacgaggagaccggctaccgccggatcatcgagcgcctgaactccaagaagggcaagaaccgcctgctcgacggggagcggctggccgaccgcaagatcgccgagctgttcagcacgaagacccacatcggc

SEQ ID NO: 12477 - RNA, 1932 nt, synthetic construct
  misc_feature 1..1932: note = derived and/or modified CDS sequence (opt1) from CCHFV(Mamon)__KX013478.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggcgggcacgcgcttcaacctgggccccgtgaccatcaccctgtccgagccccggaacatccagcagaagctcccgcccgagatcatcaccctgcaccccaaggtggaggaggggttcttcgacctgatgcacgtccagaaggtgctcagcgcctccacggtgtgcaagctgcagagctgcacccacggcatccccggggacctgcaggtctaccacatcggcaacctcctgaagggcgaccgcgtgaacgggcacctgatccacaagatcgagccgcacttcaacacctcctggatgagctgggacggctgcgacctcgactactactgcaacatgggggactggccctcctgcacctacacgggcgtgacccagcacaaccacgccgccttcgtcaacctgctgaacatcgagaccgactacaccaagacgttccacttccacagcaagcgggtgaccgcgcacggggacaccccccagctcgacctgaaggcccgccccacctacggcgccggcgagatcacggtcctggtggaggtggccgacatggagctccacaccaagaaggtcgagatctccgggctgaagttcgccagcctggcgtgcaccggctgctacgcctgctccagcgggatctcctgcaaggtgcggatccacgtggacgagccggacgagctcaccgtccacgtgaagagctccgaccccgacgtggtcgccgccagcacgtccctgatggcccgcaagctggagttcggcaccgacagcaccttcaaggcgttcagcgccatgcccaagacctccctctgcttctacatcgtggagcgggagtactgcaagagctgctccgaggaggacacccagaagtgcgtggacacgaagctggagcagccccagagcatcctgatcgagcacaaggggaccatcatcggcaagcagaacgacacctgcaccgccaagacgtcctgctggctcgagagcgtcaagtccttcttctacggcctgaagaacatgctggggagcgtgttcggcaacttcttcatcgggatcctcctgttcctggccccgttcgtgctcctggtcctgttcttcatgttcggctggaagatcctgttctgcttcaagtgctgccgccggacccgcgggctcctgaagtaccggcacctgaaggacgacgaggagaccggctaccgccggatcatcgagcgcctcaacaacaagaagggcaagaaccgcctgctggacggggagcggctcgccgaccgcaagatcgcggagctgttctccaccaagacgcacatcggc

SEQ ID NO: 12478 - RNA, 1932 nt, synthetic construct
  misc_feature 1..1932: note = derived and/or modified CDS sequence (opt1) from CCHFV(Min)__KX013481.1__Gc
  source 1..1932: mol_type = other RNA
ttcctggacagcatcgtgaagggcaccaagaacctcctgaactccaccagcctggagacgtccctcagcatcgaggccccctggggcgccatcaacgtccagtccaccttcaagccgaccgtgagcaccgcgaacatcgccctgtcctggagctccgtggagcaccgcgggaacaagatcctggtcacggggcggagcgagtccatcatgaagctcgaggagcgcaccggcgtgagctgggacctgggggtggaggacgcctccgagagcaagctgctcaccgtctccatcatggacctgagccagatgtactcccccgtgttcgagtacctgagcggcgaccgccaggtggaggagtggcccaaggcgacctgcacgggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggccggcacccgcttcaacctgggccccgtgaccatcaccctgtccgagccccggaacatccagcagaagctcccgcccgagatcatcacgctgcaccccaaggtggaggaggggttcttcgacctgatgcacgtccagaaggtgctcagcgcctccaccgtgtgcaagctgcagagctgcacccacggcatccccggggacctgcaggtctaccacatcggcaacctcctgaagggcgaccgcatcaacgggcacctgatccacaagatcgagccgcacttcaacacctcctggatgagctgggacggctgcgacctcgactactactgcaacatgggggactggccctcctgcacgtacaccggcgtgacccagcacaaccacgccgccttcgtgaacctgctgaacatcgagaccgactacacgaagaccttccacttccacagcaagcgggtcaccgcgcacggggacacgccccagctcgacctgaaggcccgccccacctacggcgccggcgagatcaccgtgctggtcgaggtggccgacatggagctccacaccaagaaggtggagatctccgggctgaagttcgccagcctggcgtgcaccggctgctacgcctgctccagcgggatctcctgcaaggtccggatccacgtggacgagccggacgagctcacggtgcacgtcaagagctccgaccccgacgtggtggccgccagcacctccctgatggcccgcaagctggagttcggcaccgacagcaccttcaaggcgttcagcgccatgcccaagacctccctctgcttctacatcgtcgagcgggagtactgcaagagctgctccgaggaggacacgcagaagtgcgtggacaccaagctggagcagccccagagcatcctgatcgagcacaaggggaccatcatcggcaagcagaacgacacgtgcaccgccaaggcctcctgctggctcgagagcgtgaagtccttcttctacggcctgaagaacatgctggggagcgtcttcggcaacttcttcatcgggatcctcctgttcctggccccgttcgtgctcctggtgctgttcttcatgttcggctggaagatcctgttctgcttcaagtgctgccgccggacccgcgggctcctgaagtaccggcacctgaaggacgacgaggagaccggctaccgccggatcatcgagcgcctcaacaacaagaagggcaagaaccgcctgctggacggggagcggctcgcggaccgcaagatcgccgagctgttctccaccaagacgcacatcggc

SEQ ID NO: 12479 - RNA, 1932 nt, synthetic construct
  misc_feature 1..1932: note = derived and/or modified CDS sequence (opt1) from CCHFV(Nakiwogo)__KX013484.1__Gc
  source 1..1932: mol_type = other RNA
tacctggacagcatcgccaagggcatgaagtccctcctgaacagcaccaacctggagacctccctcagcatcgaggccccctggggcgcgatcaacgtgcagtccacgttcaagccgaccgtgagcgccgccaacatcgccctgtcctggagctccgtggagcaccgcgggaacaagatcctggtgagcgggcggtccgagagcatcatgaagctcgaggagcgcaccggcatctcctggagcctgggggtcgaggacgcctccgagagcaagaccctgacggtgtccgtgatggacctcagccagatgtactcccccgtcttcgagtacctgagcggcgaccgccaggtggaggagtggcccaaggcgacctgcaccggcgactgccccgagcggtgcgggtgcaccagctccacgtgcctgcacaaggagtggccgcacagccggaactggcgctgcaaccccacctggtgctggggcgtggggaccggctgcacgtgctgcgggctcgacgtccgggacctgttcaccgactacatgatggtgaagtggaaggtggagtacgtcaagaccgaggccatcatgtgcgtggagctgacctcccaggagcgccagtgcagcctcatcgaggccggcacccggttcaacctgggccccgtgacgatcaccctgtccgagccccgcaacgtccagcagcggctcccgagcgagatcgtgaccctgcaccccaagatcgaggaggggttcttcgacctgatgcacgtgcagaaggtcctcttctgcaagcactccctgcaggccaccagctgcacgcacggcgtgcccggggacctccaggtgtaccacgtcggcaacctcctgaagggcgacaaggtgaacgggcactccatccacaagatcgagagccacttcaacacctcctggatgagctgggacggctgcgacctggactacttctgcaacatgggggactggccctcctgcacctacaccggcgtgacgcagcacaaccgcgcggccttcgtcaacatgctcaacatcgagaccgactacaccaagaccttccacttccacagcaagcgggtgacggcccacggggacaccccgcagctggacctgaaggcccgccccacctacggcgccggcgaggtcaccgtgctcgtggaggtcgcggacctggagctgcacacgaagaagatcgaggtgtccgggctcaagttcgccagcctgacctgctccggctgctacgcctgcagctccgggatcagctgcaaggtgcggatccacgtcaacgagcccgacgagttcaccgtgcacgtcaagagcaacgaccccgacgtggtggccgccggctccagcctgatggcgcgcaagatcgagctcggggccgactccaccttcaaggccttcagctccatgccgaagaacagcctgtgcttctacatcgtggagcgggactactgctccagctgcacggacgacgacacccagaagtgcgtcaacaccaagctggagcacccccagtccatcctcatcgagcacaagggcaccatcatcggcaagcagaacgacacgtgccccaccaagaccagctgctggctggagtccgtcaagagcttcttctacgggctgaagaacatgctcggcgggatcttcggcaacgtgttcctggggatcttcctgttcctcgcccccttcgccctgctgatcctcttcttcttcttcggctggcgcctgctgttctgcctgaagtgctgccggcgcacccggggcctcctgaagtacaagcagctgaaggacgaggaggaggcggggtacaagaagatcatcgagcgcctcaacgacaagaagggcaagtcccgcctgttcgacggggagcggctggccgaccgcaagatcgccgagctgttcagcaccaagacgcacatcggc

SEQ ID NO: 12480 - RNA, 1932 nt, synthetic construct
  misc_feature 1..1932: note = derived and/or modified CDS sequence (opt1) from CCHFV(Saf)__KX013487.1__Gc
  source 1..1932: mol_type = other RNA
ttcagcgactccatcgtgaagggcatgaagaacctgctcaacagcacctccctggagaccagcctgtccatcgaggccccctggggggccatcaacgtccagagcacgttcaagccgaccgtgtccaccgcgaacatcgccctcagctggtccagcgtggagcaccgcggcaacaagatcctggtcaccgggcggtccgagagcatcatgaagctggaggagcgcacgggcgtgtcctgggacctcggggtggaggacgccagcgagtccaagctgctgaccgtcagcatcatggacctctcccagatgtacagccccgtgttcgagtacctgtccggcgaccggcaggtggaggagtggcccaaggccacctgcaccggcgactgccccgagcgctgcgggtgcacgagcagcacctgcctgcacaaggagtggccgcactcccggaactggcgctgcaaccccacctggtgctggggcgtcgggaccggctgcacgtgctgcggggtggacgtgaaggacctcttcaccgaccacatgttcgtcaagtggaaggtggagtacatcaagaccgaggccatcgtgtgcgtcgagctgaccagccaggagcggcagtgctccctgatcgaggcgggcacgcgcttcaacctcggccccgtgaccatcaccctgagcgagccccggaacatccagcagaagctgccgcccgagatcatcaccctccaccccaaggtggaggaggggttcttcgacctgatgcacgtccagaaggtgctgtccgccagcacggtgtgcaagctccagtcctgcacccacggcatccccggggacctgcaggtctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacctacacgggcgtgacccagcacaaccacgccgccttcgtcaacctcctgaacatcgagaccgactacatgaagaccttccacttccactccaagcgggtgacggcgcacggggacaccccccagctggacctcaaggcccgccccacctacggcgccggcgagatcaccgtcctggtggaggtggccgacatggagctgcacacgaagaaggtcgagatcagcgggctcaagttcgtgtccctggcctgcaccggctgctacgcgtgcagctccgggatcagctgcaaggtgcggatccacgtcgacgagccggacgagctgaccgtgcacgtgaagtccagcgaccccgacgtcgtggccgcctccaccagcctcatggcccgcaagctggagttcggcacggacagcaccttcaaggccttctccgcgatgcccaagaccagcctgtgcttctacatcgtggagcgggagtactgcaagtcctgcagcgaggaggacacccagaagtgcgtcgacaccaagctcgagcagccccagtccatcctgatcgagcacaaggggacgatcatcggcaagcagaacgacacctgcaccgccaaggccagctgctggctggagtccgtgaagagcttcttctacggcctcaagaacatgctggggtccgtgttcggcaacttcttcatcgggatcctgctcttcctggccccgttcgtcctgctcgtgctgttcttcatgttcggctggaagatcctgttctgcttcaagtgctgccgccggacccgcgggctgctcaagtaccggcacctgaaggacgacgaggagacgggctaccgccggatcatcgagcgcctgaacaacaagaagggcaagaaccgcctcctggacggggagcggctggccgaccgcaagatcgcggagctcttcagcaccaagacccacatcggc

SEQ ID NO: 12481 - RNA, 1932 nt, synthetic construct
  misc_feature 1..1932: note = derived and/or modified CDS sequence (opt1) from CCHFV(Ast199)__KX056051.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagacgttccacttccacagcaagcgggtcaccgcgcacggggacaccccccagctggacctgaaggcccgccccacctacggcgccggcgagatcacggtgctcgtggaggtcgccgacatggagctgcacaccaagaaggtggaggtctccgggctgaagttcgccagcctcgcgtgcaccggctgctacgcctgctccagcgggatctcctgcaaggtgcggatccacgtggacgagccggacgagctgaccgtccacgtgaagagctccgaccccgacgtggtcgccgccagcacgtccctgatggcccgcaagctcgagttcggcaccgacagcaccttcaaggcgttcagcgccatgcccaagacctccctgtgcttctacatcgtggagcgggagtactgcaagagctgctccgaggacgacaccaagaagtgcgtggacacgaagctggagcagccccagagcatcctcatcgagcacaaggggaccatcatcggcaagcagaacgacacctgcaccgccaaggcctcctgctggctggagagcgtcaagtccttcttctacggcctgaagaacatgctcgggagcgtgttcggcaacttcttcgtggggatcctgctgttcctcgccccgttcgtcctgctggtgctgttcttcatcttcggctggaagatcctcttctgcttcaagtgctgccgccggacgcgcgggctgttcaagtaccggcacctgaaggacgacgaggagaccggctaccgcaagatcatcgagcggctcaactccaagaagggcaagaaccgcctgctggacggggagcgcctcgcggaccggaagatcgccgagctgttcagcaccaagacccacatcggc

SEQ ID NO: 12482 - RNA, 1932 nt, synthetic construct
  misc_feature 1..1932: note = derived and/or modified CDS sequence (opt1) from CCHFV(Ast149)__KX056054.1__Gc
  source 1..1932: mol_type = other RNA
ttcctggacagcatcgtgaagggcatgaagaacctcctgaactccaccagcctggagacctccctcagcatcgaggccccctggggggccatcaacgtccagtccacgttcaagccgaccgtgagcaccgcgaacatcgccctgtcctggagctccgtggagcaccgcggcaacaagatcctggtcaccgggcggagcgagtccatcatgaagctcgaggagcgcacgggcgtgagctgggacctgggggtggaggacgcctccgagagcaagctgctcaccgtctccatcatggacctgagccagatgtactcccccgtgttcgagtacctgagcggcgaccggcaggtggaggagtggcccaaggccacctgcaccggcgactgccccgagcgctgcgggtgcacgtccagcacctgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggcgggcacgcgcttcaacctgggccccgtcaccatcaccctgtccgagccccggaacatccagcagaagctcccgcccgagatcatcaccctgcaccccaagatcgaggaggggttcttcgacctgatgcacgtgcagaaggtgctcagcgcctccacggtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacctacacgggcgtgacccagcacaaccacgccgccttcgtgaacctgctcaacatcgagaccgactacaccaagacgttccacttccacagcaagcgggtcaccgcgcacggggacaccccccagctggacctgaaggcccgccccacctacggcgccggcgagatcacggtgctcgtggaggtcgccgacatggagctgcacaccaagaaggtggaggtctccgggctgaagttcgccagcctcgcgtgcaccggctgctacgcctgctccagcgggatctcctgcaaggtgcggatccacgtggacgagccggacgagctgaccgtccacgtgaagagctccgaccccgacgtggtcgccgccagcacgtccctgatggcccgcaagctcgagttcggcaccgacagcaccttcaaggcgttcagcgccatgcccaagacctccctgtgcttctacatcgtggagcgggagtactgcaagagctgctccgaggacgacaccaagaagtgcgtggacacgaagctggagcagccccagagcatcctcatcgagcacaaggggaccatcatcggcaagcagaacgacacctgcaccgccaaggcctcctgctggctggagagcgtcaagtccttcttctacggcctgaagaacatgctcgggagcgtgttcggcaacttcttcgtggggatcctgctgttcctcgccccgttcgtcctgctggcgctgttcttcatcttcggctggaagatcctcttctgcttcaagtgctgccgccggacgcgcgggctgttcaagtaccggcacctgaaggacgacgaggagaccggctaccgcaagatcatcgagcggctcaactccaagaagggcaagaaccgcctgctggacggggagcgcctcgccgaccggaagatcgccgagctgttcagcaccaagacccacatcggc

SEQ ID NO: 12483 - RNA, 1932 nt, synthetic construct
  misc_feature 1..1932: note = derived and/or modified CDS sequence (opt1) from CCHFV(Ast137)__KX056057.1__Gc
  source 1..1932: mol_type = other RNA
ttcctggacagcatcgtgaagggcaccaagaacctcctgaactccaccagcctggagacgtccctcagcatcgaggccccctggggcgccatcaacgtccagtccaccttcaagccgaccgtgagcaccgcgaacatcgccctgtcctggagctccgtggagcaccgcgggaacaagatcctggtcacggggcggagcgagtccatcatgaagctcgaggagcgcaccggcgtgagctgggacctgggggtggaggacgcctccgagagcaagctgctcaccgtctccatcatggacctgagccagatgtactcccccgtgttcgagtacctgagcggcgaccgccaggtggaggagtggcccaaggcgacctgcacgggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcatcaagtggaaggtcgagtacatcaagaccgaggccatcgtgtgcgtggagctgacctcccaggagcggcagtgcagcctcatcgaggccggcacccgcttcaacctgggccccgtcaccatcaccctgtccgagccccggaacatccagcagaagctcccgcccgagatcatcacgctgcaccccaagatcgaggaggggttcttcgacctgatgcacgtgcagaaggtgctcagcgcctccaccgtctgcaagctgcagagctgcacccacggcatccccggggacctgcagatctaccacatcggcaacctcctgaagggcgaccgcctgaacgggcacctcatccacaagatcgagccgcacttcaacacctcctggatgagctgggacggctgcgacctggactactactgcaacatgggggactggccctcctgcacgtacaccggcgtgacccagcacaaccacgccgccttcgtgaacctgctcaacatcgagaccgactacacgaagaccttccacttccacagcaagcgggtcaccgcgcacggggacacgccccagctggacctgaaggcccgccccacctacggcgccggcgagatcaccgtgctcgtggaggtcgccgacatggagctgcacaccaagaaggtggaggtctccgggctgaagttcgccagcctcgcgtgcaccggctgctacgcctgctccagcgggatctcctgcaaggtgcggatccacgtggacgagccggacgagctgacggtccacgtcaagagctccgaccccgacgtggtggccgccagcacctccctgatggcccgcaagctcgagttcggcaccgacagcaccttcaaggcgttcagcgccatgcccaagacctccctgtgcttctacatcgtggagcgggagtactgcaagagctgctccgaggacgacacgaagaagtgcgtggacaccaagctggagcagccccagagcatcctcatcgagcacaaggggaccatcatcggcaagcagaacgacacgtgcaccgccaaggcctcctgctggctggagagcgtcaagtccttcttctacggcctgaagaacatgctcgggagcgtgttcggcaacttcttcgtggggatcctgctgttcctcgccccgttcgtcctgctggtgctgttcttcatcttcggctggaagatcctcttctgcttcaagtgctgccgccggacccgcgggctgttcaagtaccggcacctgaaggacgacgaggagaccggctaccgcaagatcatcgagcggctcaactccaagaagggcaagaaccgcctgctggacggggagcgcctcgcggaccggaagatcgccgagctgttcagcaccaagacgcacatcggc

SEQ ID NO: 12484 - RNA, 1932 nt, synthetic construct
  misc_feature 1..1932: note = derived and/or modified CDS sequence (opt1) from CCHFV(Ast133)__KX056060.1__Gc
  source 1..1932: mol_type = other RNA
ttcagcgactccatcgtgaagggcatgaagaacctgctcaacagcacctccctggagaccagcctgtccatcgaggccccctggggggccatcaacgtccagagcacgttcaagccgaccgtgtccaccgcgaacatcgccctcagctggtccagcgtggagcaccgcggcaacaagatcctggtcaccgggcggtccgagagcatcatgaagctggaggagcgcacgggcgtgtcctgggacctcggggtggaggacgccagcgagtccaagctgctgaccgtcagcatcatggacctctcccagatgtacagccccgtgttcgagtacctgtccggcgaccggcaggtggaggagtggcccaaggccacctgcaccggcgactgccccgagcgctgcgggtgcacgagcagcacctgcctgcacaaggagtggccgcactcccggaactggcgctgcaaccccacctggtgctggggcgtcgggaccggctgcacgtgctgcggggtggacgtgaaggacctcttcaccgaccacatgttcatcaagtggaaggtcgagtacatcaagaccgaggccatcgtgtgcgtggagctgaccagccaggagcggcagtgctccctgatcgaggcgggcacgcgcttcaacctcggccccgtcaccatcaccctgagcgagccccggaacatccagcagaagctgccgcccgagatcatcaccctccaccccaagatcgaggaggggttcttcgacctgatgcacgtgcagaaggtgctgtccgccagcacggtctgcaagctccagtcctgcacccacggcatccccggggacctgcagatctaccacatcggcaacctgctcaagggcgaccgcgtgaacgggcacctgatccacaagatcgagccgcacttcaacaccagctggatgtcctgggacggctgcgacctggactactactgcaacatgggggactggcccagctgcacctacacgggcgtgacccagcacaaccacgccgccttcgtcaacctcctgaacatcgagaccgactacaccaagacgttccacttccactccaagcgggtgaccgcgcacggggacaccccccagctggacctcaaggcccgccccacctacggcgccggcgagatcacggtgctggtcgaggtggccgacatggagctgcacaccaagaaggtcgagatcagcgggctcaagttcgcctccctgacctgcaccggctgctacgcgtgcagctccgggatcagctgcaaggtgcggatccacgtggacgagccggacgagctgacggtccacgtgaagtccagcgaccccgacgtggtcgccgcctccaccagcctcatggcccgcaagctggagttcggcaccgacagcaccttcaaggccttctccgcgatgcccaagaccagcctgtgcttctacatcgtggagcgggagtactgcaagtcctgcagcgaggacgacacgaagaagtgcgtggacaccaagctcgagcagccccagtccatcctgatcgagcacaaggggaccatcatcggcaagcagaacgacacctgcacggccaaggccagctgctggctggagtccgtcaagagcttcttctacggcctcaagaacatgctggggtccgtgttcggcagcttcttcgtggggatcctgctcttcctggccccgttcgtcctgctcgtgctgttcttcatgttcggctggaagatcctgttctgcttcaagtgctgccgccggacccgcgggctgttcaagtaccggcacctcaaggacgacgaggagaccggctaccgccggatcatcgagcgcctgaactccaagaagggcaagaaccgcctgctcgacggggagcggctggccgaccgcaagatcgcggagctgttcagctccaagacccacatcggc

SEQ ID NO: 12485 - RNA, 1932 nt, synthetic construct
  misc_feature 1..1932: note = derived and/or modified CDS sequence (opt1) from CCHFV(SK/2015/human)__KX458183.1__Gc
  source 1..1932: mol_type = other RNA
ttcctggacagcatcgtgcgcggcatgaagaacctcctgaactccaccagcctggagacctccctcagcatcgaggccccctggggggccatcaacgtccagtccacgtacaagccgaccgtgagcaccgcgaacatcgccctgtcctggagctccgtggagcaccggggcaacaagatcctggtcagcgggcgctccgagagcatcatgaagctcgaggagcggaccggcgtgtcctgggacctgggggtggaggacgccagcgagtccaagctgctcacggtcagcgtgatggacctgtcccagatgtacagccccgtgttcgagtacctgtccggcgaccgccaggtcgaggagtggcccaaggccacctgcaccggcgactgccccgagcggtgcgggtgcaccacgagcacctgcctccacaaggagtggccgcacagccgcaactggcggtgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcacctcccagggccgccagtgcagcctgatcgaggcgggcacgcggttcaacctggggtccgtgaccatcaccctcagcgagccccgcaacatccagcacaagctgcccccggagatcatcaccctgcacccccggatcgaggagggcttcttcgacctcatgcacgtgcagaaggtcctgtccgccagcacggtgtgcaagctgcagtcctgcacccacggggtgcccggcgacctccaggtctaccacatcggcaacctgctgaagggggacaaggtgaacggccacctcatccacaagatcgagccccacttcaacaccagctggatgtcctgggacgggtgcgacctggactactactgcaacatgggcgactggccgagctgcacctacacgggggtgacccagcacaaccacgcctccttcgtcaacctgctcaacatcgagaccgactacaccaagaacttccacttccacagcaagcgcgtgacggcccacggcgacaccccccagctggacctgaaggcgcggcccacctacggcgccggggagatcaccgtcctcgtggaggtggccgacatggagctgcacacgaagaagatcgagatctccggcctgaagttcgccagcctcacctgcaccgggtgctacgcctgctccagcggcatctcctgcaaggtccgcatccacgtggacgagcccgacgagctgaccgtgcacgtcaagagcgacgacccggacgtggtggcggcctccagcagcctgatggcccggaagctcgagttcgggacggactccaccttcaaggccttcagcgccatgcccaagacctccctgtgcttctacatcgtcgagcgcgagtactgcaagagctgctccaaggaggacacccagaagtgcgtgaacaccaagctggagcagccccagagcatcctcatcgagcaccggggcacgatcatcggcaagcagaacaacacctgcatcgcgaaggcctcctgctggctggagagcgtgaagtccttcttctacgggctgaagaacatgctcagcggcatcttcgggaacctgttcctgggcatcttcctcttcctggcccccttcatcctgctgatcctcttcttcatgttcgggtggcgcatcctgttctgcttcaagtgctgccggcgcacccggggcctgttcaagtaccgccacctcaaggacgacgaggagaccggctaccgccggatcatcgagcgcctgaacaacaagaaggggaagaacaagctgctcgacggcgagcggctggccgaccgccggatcgccgagctgttctccacgaagacccacatcggg

SEQ ID NO: 12486 - RNA, 1932 nt, synthetic construct
  misc_feature 1..1932: note = derived and/or modified CDS sequence (opt1) from CCHFV(YL16070)__KY354081.1__Gc
  source 1..1932: mol_type = other RNA
ttcctggacagcatcgccaagggcatgaagtccctcctgaacagcacctccctggagaccagcctctccatcgaggccccctggggcgcgatcaacgtgcagagcacgttcaagccgaccgtctccgccgccaacatcgccctgagctggtccagcgtggagcaccgcgggaacaagatcctggtgtccgggcggagcgagtccatcatgaagctcgaggagcgcaccggcgtcagctggaacctgggggtggaggacgcctccgagagcaagaccctgacggtgtccgtcatggacctcagccagatgtactcccccgtgttcgagtacctgagcggcgaccgccaggtggaggagtggcccaaggcgacctgcaccggcgactgccccgagcggtgcgggtgcaccagctccacgtgcctgcacaaggagtggccgcacagccggaactggcgctgcaaccccacctggtgctggggcgtcgggaccggctgcacgtgctgcgggctcgacgtgaaggacttcttcaccgactacatgctggtgaagtggaaggtcgagtacatcaagaccgaggccatcgtgtgcgtggagctgacctcccaggagcggcagtgcagcctcatcgaggccggcacccgcttcaacctgggccccgtcacgatcaccctgtccgagccccggaacgtgcagcagcgcctcccgcccgagatcgtgaccctgcaccccaagatcgaggaggggttcttcgacctgatgcacgtccagaagatcctcagcgcctccaccgtgtgcaagctgcagagctgcacgcacggcgtgcccggggacttccaggtctaccacgtgggcaacctgctccggggcgacaaggtgaacgggcactccatccacaagatcgagccgcacttcaacaccagctggatgtcctgggacggctgcgacctggactacttctgcaacatgggggactggcccagctgcacctacaccggcgtcacgcagcacaaccgcgcggccttcatcaacatgctgaacatcgagaccgactacaccaagaccttccacttccactccaagcgggtgacggcccacggggacacgccccagctcgacctgaaggcccgccccgcctacggcgcgggcgaggtcaccgtgctggtggaggtcgccgacctcgagctgcacaccaagaagctggaggtgagcgggctcaagatcgcctccctgacctgcagcggctgctacgcctgctccagcgggatctcctgcaaggtgcggatccacgtcaacgagccggacgagttcaccgtgcacgtgcgcagcagcgaccccgacgtcgtggccgcgggctccagcctgatggcccggaagatcgagttcggggccgactccaccttcaaggccttcagctccatgcccaaggacagcctctgcttctacatcgtggagaaggactactgctccagctgcaccgacgacgacacgcagaagtgcgtcaacaccaagctggaccacccccagtccatcctgatcgagcacaagggcaccatcatcggcaagcagaacgacacgtgcagcaccaagacctcctgctggctcaagagcttcaaggggttcttctacggcctgaagaacatgctgtccgggatcttcggcaacgtgttcctcgggatcctgctgttcctcgccccgttcgtgctgctgatcttcttcttcttcttcggctggcgcctcctgttctgcctgaagtgctgcaagaagaccaagggcctgctcaagtacaagcacctgaaggacaaggaggaggcggggtacaagaagatcatcgagcggctgaacggcaagaagggcaagagccagctgttcgacggggagcgcctcgccaaccggaagatcgccgagctgttctccaccaagatccacatcggc

SEQ ID NO: 12487 - RNA, 1932 nt, synthetic construct
  misc_feature 1..1932: note = derived and/or modified CDS sequence (opt1) from CCHFV(Oman_812956)__KY362518.1__Gc
  source 1..1932: mol_type = other RNA
ttcttcgacagcatcgccaagggcatgaagaacctgctcaactccaccagcctggagacctccctgagcatcgaggccccctggggcgcgatcaacgtgcagtccacgttcaagccgaccgtgagcaccgccaacatcgccctctcctggagctccgtggagcaccgcgggaacaagatcctggtgagcgggcggtccgagagcatcatgaagctggaggagcgcaccggcatctcctgggacctcggggtcgaggacgccagcgagtccaagctgctgacggtgagcgtgatggacctctcccagatgtacagccccgtcttcgagtacctgtccggcgaccgccaggtggaggagtggcccaaggcgacctgcaccggcgactgccccgagcggtgcgggtgcaccagcagcacgtgcctgcacaaggagtggccgcactcccggaactggcgctgcaaccccacctggtgctggggcgtggggaccggctgcacgtgctgcgggctcgacgtcaaggacctgttcaccgactacatgttcgtgaagtggaaggtggagtacatcaagaccgaggccatcgtctgcgtggagctgaccagccaggagcggcagtgctccctcatcgaggccggcacccgcttcaacctgggccccgtgacgatcaccctgagcgagccccggaacatccagcagaagctcccgcccgagatcgtcaccctgcacccccgcatcgaggaggggttcttcgacctgatgcacgtgcagaaggtgctctccgccagcaccgtctgcaagctgcagtcctgcacgcacggcgtgcccggggacctccaggtgtaccacatcggcaacctgctgaagggcgacaaggtcaacgggcacctgatccacaaggtggagccgcacttcaacaccagctggatgtcctgggacggctgcgacctcgactactactgcaacatgggggactggcccagctgcacctacaccggcgtgacgcagcacaaccacgccgcgttcgtcaacctgctgaacatcgagaccgactacaccaagaacttccacttccactccaagcgggtgaccgcccacggggacacgccccagctcgacctgaaggcccgccccaactacggcgccggcgagatcaccgtcctggtggaggtggccgacatggagctccacaccaagaagatcgagatcagcgggctgaagttcgcgtccctgacctgcacgggctgctacgcctgcagctccgggatcagctgcaaggtccggatccacgtggacgagccggacgagctcaccgtgcacgtcaagtccgaggaccccgacatcgtggccgccagctccagcctgatggcccgcaagctggagttcggcaccgacagcaccttcaaggcgttctccgccatgcccaagacgagcctctgcttctacatcgtggagcgggagtactgcaagtcctgcagcaaggaggacacccagaagtgcgtcaacgccaagctggagcgcccccagtccatcctgatcgagcacaaggggaccatcatcggcaagcagaacgacacgtgcaccgccaaggccagctgctggctcgagtccgtcaagagcttcttctacggcctgaagaacatgctgtccgggatcttcggcaacgtgttcatcgggatcttcctcttcctggcgccgttcatcctgctcatcctgttcttcatgttcggctggcggatcctgttctgcttcaagtgctgccgccggacccgcgggctgttcaagtaccggcacctcaaggacgacgaggagaccggctaccgcaagatcatcgagcgcctgaacaacaagaagggcaagaacaagctgctcgacggggagcggctggccgaccgcaagatcgccgagctgttcagcaccaagacccacatcggc

SEQ ID NO: 12488 - RNA, 1932 nt, synthetic construct
  misc_feature 1..1932: note = derived and/or modified CDS sequence (opt1) from CCHFV(UCCR4405)__KY484029.1__Gc
  source 1..1932: mol_type = other RNA
ttcctcgacagcaccgtgaagggcatgaagaacctcctgaactccaccagcctggagacgtccctcagcatcgaggccccctggggcgccatcaacgtccagtccaccttcaagccgaccgtgagcaccgcgaacatcgccctgtcctggagctccgtggagcaccgcgggaacaagatcctggtcacggggcggagcgagtccatcatgaagctcgaggagcgcaccggcgtgagctgggacctgggggtggaggacgcctccgagagcaagctgctcaccgtctccatcatggacctgagccagatgtactcccccgtgttcgagtacctgagcggcgaccgccaggtggaggagtggcccaaggcgacctgcacgggcgactgccccgagcggtgcgggtgcacctccagcacgtgcctccacaaggagtggccgcacagccggaactggcgctgcaaccccacctggtgctggggcgtcgggaccggctgcacgtgctgcggggtggacgtgaaggacctgttcaccgaccacatgttcgtcaagtggaaggtggagtacatcaagaccgaggccatcgtgtgcgtcgagctgacctcccaggagcggcagtgcagcctcatcgaggccggcacccgcttcaacctgggccccgtgaccatcaccctgtccgagccccggaacatccagcagaagctcccgcccgagatcatcacgctgcaccccaagatcgaggaggggttcttcgacctgatgcacgtgcagaaggtcctcagcgcctccaccgtgtgcaagctgcagagctgcacccacggcatccccggggacctgcagatctaccacatcggcaacctcctgaagggcgaccgcgtgaacgggcacctgatccacaagatcgagccgcacttcaacacctcctggatgagctgggacggctgcgacctcgactactactgcaacatggggaactggccctcctgcacgtacaccggcgtcacccagcacaaccacgccgccttcgtgaacctgctgaacatcgagaccgactacacgaagaccttccacttccacagcaagcgggtgaccgcgcacggggacacgccccagctcgacctgaaggcccgccccacctacggcgccggcgagatcaccgtcctggtggaggtcgccgacatggagctccacaccaagaaggtggagatctccgggctgaagttcgccagcctggtgtgcaccggctgctacgcgtgctccagcgggatctcctgcaaggtccggatccacgtggacgagccggacgagctcacggtgcacgtcaagagctccgaccccgacgtggtggccgccagcacctccctgatggcccgcaagctggagttcggcaccgacagcatcttcaaggccttcagcgcgatgcccaagacctccctctgcttctacatcgtcgagcgggagtactgcaagagctgctccgaggacgacaccaagaagtgcgtggacacgaagctggagcagccccagagcatcctgatcgagcacaaggggaccatcatcggcaagcagaacgacacgtgcaccgccaaggcctcctgctggctcgagagcgtgaagtccttcttctacggcctgaagaacatgctggggagcgtcttcggcaacttcttcgtggggatcctcctgttcctggccccgttcgtgctcctggtcctgttcttcatgttcggctggaagatcctgttctgcttcaagtgctgccgccggacccgcggcctcttcaagtaccggcacctgaaggacgacgaggagaccgggtaccgccggatcatcgagcgcctgaactccaagaagggcaagaaccgcctcctggacggggagcggctggccgaccgcaagatcgcggagctgttcagcaccaagacccacatcggc

SEQ ID NO: 12489 - RNA, 1932 nt, synthetic construct
  misc_feature 1..1932: note = derived and/or modified CDS sequence (opt1) from CCHFV(UCCR4401)__KY484035.1__Gc
  source 1..1932: mol_type = other RNA
ttcctggacagcaccgccaagggcatgaagaacctcctgaactccaccagcctggagacgtccctcagcatcgaggccccctggggggcgatcaacgtgcagtccacctacaagccgaccgtcagcaccgccaacatcgccctgtcctggagctccgtggagcaccgcggcaacaagatcctggtgagcgggcggtccgagagcatcatgaagctcgaggagcgcacgggcatctcctgggacctgggggtcgaggacgccagcgagtccaagctgctcaccgtgagcgtgatggacctgtcccagatgtacagccccgtcttcgagtacctgtccggcgaccggcaggtggaggagtggcccaaggccacctgcaccggcgactgccccgagcgctgcgggtgcacgagcagcacctgcctccacaaggagtggccgcactcccggaactggcgctgcaaccccacctggtgctggggcgtggggaccggctgcacgtgctgcgggctggacgtcaaggacctgttcaccgactacatgttcgtgaagtggaaggtggagtacatcaagaccgaggcgatcgtctgcgtggagctcaccagccaggagcggcagtgctccctgatcgaggccggcacgcgcttcaacctgggccccgtgaccatcaccctcagcgagccccggaacatccagcagaagctgccgcccgagatcatcaccctgcacccccgcatcgaggaggggttcttcgacctcatgcacgtccagaaggtgctgtccgccagcacggtgtgcaagctgcagtcctgcacccacggcgtccccggggacctccaggtgtaccacatcggcaacctgctgaagggcgacaaggtgaacgggcacctcatccacaagatcgagccgcacttcaacaccagctggatgtcctgggacggctgcgacctggactactactgcaacatgggggactggcccagctgcacctacacgggcgtcacccagcacaaccacgcctccttcgtgaacctgctcaacatcgagaccgactacaccaagaacttccacttccacagcaagcgggtgacggcgcacggggacaccccccagctggacctgaaggcccgccccacctacggcgccggcgagatcaccgtcctcgtggaggtcgccgacatggagctgcacacgaagaagatcgagatctccgggctgaagttcgccagcctcgcgtgcaccggctgctacgcctgctccagcgggatctcctgcaaggtgcggatccacgtggacgagccggacgagctgaccgtccacgtgaagagcgacgaccccgacgtggtcgccgcctccagcagcctgatggcccgcaagctcgagttcggcaccgactccacgttcaaggcgttcagcgccatgcccaagacctccctgtgcttctacatcgtggagcgggagcactgcaagagctgctccgaggaggacaccaagaagtgcgtgaacaccaagctggagcagccccagagcatcctcatcgagcacaaggggaccatcatcggcaagcagaactccacgtgcaccgccaaggccagctgctggctggagtccgtcaagagcttcttctacggcctgaagaacatgctctccgggatcttcggcaacgtgttcatggggatcttcctgttcctggccccgttcatcctcctgatcctgttcttcatgttcggctggcgcatcctgttctgcttcaagtgctgccggcgcacccgggggctcttcaagtaccgccacctgaaggacgacgaggagaccggctaccggcgcatcatcgagaagctgaacaacaagaagggcaagaacaagctcctggacggggagcgcctggcggaccggcgcatcgccgagctcttcagcacgaagacccacatcggc

SEQ ID NO: 12490 - RNA, 1932 nt, synthetic construct
  misc_feature 1..1932: note = derived and/or modified CDS sequence (opt1) from CCHFV(UCCR4448)__KY484042.1__Gc
  source 1..1932: mol_type = other RNA
ttcctcgacagcatcgtgaagggcatgaagaacctcctgaactccaccagcctggagacctccctcagcatcgaggccccctggggcgccatcaacgtgcagtccacgtacaagccgaccgtgagcaccgcgaacatcgccctgtcctggagctccgtggagcaccgcgggaacaagatcctggtcagcgggcggtccgagagcatcatgaagctcgaggagaagaccggcatctcctgggacctgggggtggaggacgccagcgagtccaagctgctcacggtgagcgtcatggacctgtcccagatgtacagccccgtgttcgagtacctgtccggcgaccgccaggtggaggagtggcccaaggcgacctgcaccggcgactgccccgagcggtgcgggtgcaccagcagcacgtgcctccacaaggagtggccgcactcccgcaactggcggtgcaaccccacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacccggttcaacctgggccccgtcacgatcaccctcagcgagccccgcaacatccagcagaagctgccgcccgagatcatcaccctgcacccccggatcgaggaggggttcttcgacctcatgcacgtgcagaaggtgctgtccgccagcaccgtctgcaagctgcagtcctgcacgcacggcgtgcccggggacctccaggtgtaccacatcggcaacctgctgaagggcgacaaggtcaacgggcacctcatccacaagatcgagccgcacttcaacaccagctggatgtcctgggacggctgcgacctggactactactgcaacatgggggactggcccagctgcacctacaccggcgtgacgcagcacaaccacgcctccttcgtgaacctgctcaacatcgagaccgactacaccaagaacttccacttccacagcaagcgcgtcaccgcccacggggacacgccccagctggacctgaaggcgcggcccacctacggcgccggcgagatcaccgtgctcgtcgaggtggccgacatggagctgcacaccaagaagatcgagatctccgggctgaagttcgccagcctcacgtgcaccggctgctacgcctgctccagcgggatctcctgcaaggtgcgcatccacgtcgacgagccggacgagctgaccgtgcacgtcaagagcgacgaccccgacgtggtggcggcctccagcagcctgatggcccggaagctcgagttcggcaccgactccacgttcaaggccttcagcgccatgcccaagacctccctgtgcttctacatcgtggagcgcgagcactgcaagagctgctccgaggaggacaccaagaagtgcgtcaacaccaagctggagcagccccagagcatcctcatcgagcacaaggggaccatcatcggcaagcagaactccacgtgcaccgcgaaggccagctgctggctggagtccgtcaagagcttcttctacggcctgaagaacatgctctccgggatcttcggcaacgtgttcatcgggatcttcctgttcctggccccgttcatcctcctgatcctgttcttcatgttcggctggaagatcctgttctgcttcaagtgctgccggcgcacccggggcctcttcaagtaccgccacctgaaggacgacgaggagaccgggtaccggcgcatcatcgagcggctgaacaacaagaagggcaagaacaagctcctggacggggagatcctggccgaccgccgcatcgccgagctgttcagcacgaagacccacatcggc

SEQ ID NO: 12491 - RNA, 1932 nt, synthetic construct
  misc_feature 1..1932: note = derived and/or modified CDS sequence (opt1) from CCHFV(U2-2-002/U-6415)__AY900144.1__Gc
  source 1..1932: mol_type = other RNA
ttccaggacagcatcgtgaagggcatgaagaacctgctcaactccaccagcctggagacctccctgagcatcgaggccccctggggcgccatcaacgtccagtccacgtacaagccgaccgtgagcgcggccaacatcgccctctcctggagctccgtggagcaccgcgggaacaagatcctggtcagcgggcggtccgagagcatcatgaagctggaggagcgcaccggcatctcctgggacctcggggtggaggacgccagcgagtccaagctgctgaccgtgagcgtcatggacctctcccagatgtacagccccgtgttcgagtacctgtccggcgaccgccaggtggaggagtggcccaaggccacgtgcaccggcgactgccccgagcggtgcgggtgcaccagcagcacgtgcctgcacaaggagtggccgcactcccggaactggcgctgcaaccccacctggtgctggggcgtcgggaccggctgcacgtgctgcgggctcgacgtgaaggacctgttcaccgactacatgttcgtgaagtggaaggtcgagtacatcaagaccgaggcgatcgtgtgcgtggagctgaccagccaggagcggcagtgctccctcatcgaggccggcacccgcttcaacctgggccccgtcaccatcacgctgagcgagccccggaacatccagcagaagctcccgcccgagatcatcaccctgcacccccgcatcgaggaggggttcttcgacctgatgcacgtgcagaaggtgctctccgccagcaccgtctgcaagctgcagtcctgcacccacggcgtgcccggggacctccaggtgtaccacatcggcaacctgctgaagggcgacaaggtcaacgggcacctgatccacaagatcgagccgcacttcaacacgagctggatgtcctgggacggctgcgacctcgactactactgcaacatgggggactggcccagctgcacctacaccggcgtgacccagcacaaccacgcctccttcgtgaacctgctgaacatcgagacggactacaccaagagcttccacttccactccaagcgggtcaccgcgcacggggacacgccccagctcgacctgaaggcccgccccagctacggcgccggcgagatcaccgtgctggtcgaggtggccgacatggagctccacaccaagaagatcgagatctccgggctgaagttcgccagcctgacctgcaccggctgctacgcgtgctccagcgggatctcctgcaaggtgcggatccacgtcgacgagccggacgagttcacggtgcacgtcaagagcgacgaccccgacgtggtggccgccagctccagcctcatggcccgcaagctggagttcggcaccgactccaccttcaaggccttcagcgcgatgcccaagacctccctgtgcttctacatcgtggagcgggagtactgcaagagctgctccgaggaggacacgcagaagtgcgtcaacaccaagctcgagcagccccagagcatcctgatcgagcacaaggggaccatcatcggcaagcagaacaacacgtgcaccgccaaggcctcctgctggctggagagcgtgaagtccttcttctacggcctcaagaacatgctgagcgggatcttcggcaacgtgttcgtcgggatcttcctgttcctcgccccgttcatcctgctgatcctcttcttcatgttcggctggcgcatcctgttctgcttcaagtgctgccggcgcacccgggggctgttccgctacaagcacctggagaacgacgaggagaccggctaccggcgcatcatcgagcgcctcaacaacaagaagggcaagaacaagctgctggacggggagcggctcgccgaccgccggatcgcggagctgttctccaccaagacccacatcggc

SEQ ID NO: 12492 - RNA, 1932 nt, synthetic construct
  misc_feature 1..1932: note = derived and/or modified CDS sequence (opt1) from CCHFV(SPU 45/88)__KJ682809.1__Gc
  source 1..1932: mol_type = other RNA
ttcctggacagcatcgtgaagggcaagaagaacctcctgaactccaccagcctggagacctccctcagcatcgaggccccctggggcgccatcaacgtccagtccacgttcaagccgaccgtgagcgcggccaacatcgccctgtcctggagctccgtggagcaccgcgggaacaagatcctggtcagcgggcggtccgagagcatcatgaagctcgaggagcgcaccggcatctcctgggacctgggggtggaggacgccagcgagtccaagctgctcaccgtgagcgtcatggacctgtcccagatgtacagccccgtgttcgagtacctgtccggcgaccgccaggtggaggagtggcccaaggccacgtgcaccggcgactgccccgagcggtgcgggtgcaccagcagcacgtgcctccacaaggagtggccgcactcccggaactggcgctgcaaccccacctggtgctggggcgtcgggaccggctgcacgtgctgcgggctggacgtgaaggacctgttcaccgactacatgttcgtgaagtggaaggtcgactacatcaagaccgaggcgatcgtgtgcgtggagctcaccagccaggagcggcagtgctccctgatcgaggccggcacccgcttcaacctgggccccgtcaccatcacgctcagcgagccccggaacatccagcagaagctgccgcccgagatcgtgaccctgcacccccgcatcgaggaggggttcttcgacctcatgcacgtgcagaacgtcctgtccgccagcaccgtgtgcaagctgcagtcctgcacccacggcgtgcccggggacctccagatctaccacatcggcaacctgctgaagggcgacaaggtcaacgggcacctcatccacaagatcgagccgcacttcaacacgagctggatgtcctgggacggctgcgacctggactactactgcaacatgggggactggcccagctgctcctacaccggcgtgacccagcacaaccacgccgcgttcgtgaacatgctgaacatcgagaccgactacacgaagaacttccacttccacagcaagcgggtcaccgcccacggggacacgccccagctcgacctgaaggcccgccccacctacggcgccggcgagatcaccgtgctggtcgaggtggccgacatggagctccacaccaagaagatcgagatctccgggctgaagttcgcgagcctgacctgcaccggctgctacgcctgctccagcgggatctcctgcaaggtgcggatccacgtcgacgagccggacgagctcacggtgcacgtcaagagcgaggaccccgacatcgtggccgcctccagcagcctgatggcccgcaagctggagttcggcaccgactccaccttcaaggcgttcagcgccatgcccaagacctccctctgcttctacatcgtggagcgggagtactgcaagagctgctccaaggaggacacgcagaagtgcgtgaacaccaagctggagcagccccagagcatcctgatcgagcacaaggggaccatcatcggcaagcagaacgacacgtgcaccgccaaggcctcctgctggctcgagagcgtcaagtccttcttctacggcctgaagaacatgctgagcgggatcttcggcaacgtgttcatcgggatcctcctgttcctggccccgttcatcatgctcatcctgttcttcatgttcggctggcgcatcctgttctgcttcaagtgctgccggcgcacccgggggctgttcaagtaccgccacctcaaggacgacgaggagatcggctaccggaagatcatcgagcgcctgaacaacaagaagggcaagaacaagctgctcgacggggagcgcctggcggaccggaagatcgccgagctgttctccaccaagacccacatcggc

SEQ ID NO: 12493 - RNA, 1932 nt, synthetic construct
  misc_feature 1..1932: note = derived and/or modified CDS sequence (opt1) from CCHFV(SR3)__AJ538199.1__Gc
  source 1..1932: mol_type = other RNA
ttcctggacagcatcgtgaagggcatgaagaacctcctgaactccaccagcctggagacctccctcagcatcgaggccccctggggcgccatcaacgtccagtccacgtacaagccgaccgtgagcaccgcgaacatcgccctgtcctggagctccgtggagcaccgcgggaacaaggtcctggtgagcgggcggtccgagagcatcatgaagctcgaggagcgcaccggcatctcctgggacctgggggtggaggacgccagcgagtccaagctgctcacggtcagcgtgatggacctgtcccagatgtacagccccgtgttcgagtacctgtccggcgaccggcaggtcgaggagtggcccaaggcgacctgcaccggcgactgccccgagcgctgcgggtgcaccagcagcacgtgcctccacaaggagtggccgcactcccggaactggcgctgcaaccccacctggtgctggggcgtggggaccggctgcacgtgctgcgggctggacgtgaaggacctgttcaccgactacatgttcgtcaagtggaaggtggagtacatcaagaccgaggccatcgtgtgcgtcgagctcaccagccaggagcggcagtgctccctgatcgaggccggcacccgcttcaacctgggcagcgtgacgatcaccctctccgagccccggaacatccagcagaagctgcccccggagatcatcaccctgcaccccaagatcgaggaggggttcttcgacctcatgcacgtgcagaaggtcctgagcgcctccaccgtgtgcaagctgcagagctgcacgcacggcgtgcccggggacctccaggtctaccacatcggcaacctgctgaagggcgaccgcgtgaacgggcacctcatccacaagatcgagcagcacttcaacacctcctggatgagctgggacggctgcgacctggactactactgcaacatgggggactggccctcctgcacctacaccggcgtgacgcagcacaaccacgccagcttcgtcaacctgctcaacatcgagaccgactacaccaagaccttccacttccactccaagcgggtgacggcccacggggacaccccgcagctggacctgaaggcgcgccccacctacggcgccggcgagatcaccgtcctcgtggaggtggccgacatggagctgcacacgaagaagatcgagatcagcgggctgaagttcgccggcctgacctgcaccgggtgctacgcctgctccagcggcatctcctgcaaggtccggatccacgtggacgagcccgacgagctcaccgtgcacgtcaagagcgacgaccccgacgtggtggcggcctccagcagcctgatggcccgcaagctcgagttcgggacggactccaccttcaaggccttcagcgccatgccgaagacctccctgtgcttctacatcgtcgagcgggagtactgcaagagctgcaacaaggaggacacccagaagtgcgtgaacaccaagctggagcagccccagtccatcctcatcgagcacaagggcacgatcatcggcaagcagaacaacacgtgcaccgcgaaggccagctgctggctggagtccgtcaagagcttcttctacgggctgaagaacatgctcggcgggatcttcggcaacgtgttcatcgggatcttcaccttcctgacccccttcatcctgctcatcctgttcttcatgttcggctggcgcatcctgttctgcttcaagtgctgccggcgcacccggggcctgttcaagtaccgccacctcaaggacgacgaggagaccgggtaccggaagatcatcgagcgcctgaacaacaagaagggcaagaaccgcctgctcgacggggagcggctggccgaccgcaagatcgccgagctgttctccaccaagacgcacatcggc

SEQ ID NO: 12494 - RNA, 4656 nt, synthetic construct
  misc_feature 1..4656: note = derived and/or modified CDS sequence (opt1) from DUGV(ArD44313)__NC_004158.1__GP
  source 1..4656: mol_type = other RNA
atgagcaagcgcgtgctgatcatcgccgtcgtggtgtacctcgtcttcaccacccagaaccagatcaccggcaaccacaccaccatcaactccagctcccccagcaccacggaggcctccagcaccccgaccgtgtcccggacgccccagaccaccaccaccagcacggcggtgtccaccaccatcaccgccacgaccacccccaccgccagctggacgacccagtcccagtacttcaacaagaccacccagcaccactggcgcgaggagacgatgatcagccggaaccccaccgtcctggaccgccagtcccgggccagctccgtgcgcgagctgctcaacaccaagttcctgatgctgctcgggttcatcccgaagggcgaggtgaaccacctggagaacgcctgcaaccgggaggggaagaactgcaccgagctgatcctcaaggagcgcatcgcgcggttcttcagcgagacggagaaggagtcctgctacaacacctacctggagaagcacctccgcagcgtctcccccgaggtgagcctcaccccctaccgggtgctgggcctgcgcgaggacatcctcctgaaggagatcgaccggcgcatcatccggttcgagaccgacagccagcgcgtcacgtgcctgtccgccagcctcctgaagcccgacgtgttcatccgggagcagcgcatcgacgccaagccgtccaacgggcccaagatcgtgcccgtcgacagcgtggcctgcatgaacctggaggcgaacgtggacgtccggtccaacaagctcgtgatccagagcctgatgaccaccgtgaagatctccctgaagaactgcaaggtcgtggtgaacagccgccagtgcatccaccagcagaccggctccggcgtcatcaaggtgcccaagttcgagaagcagcagggcgggacgtggagctcctacatcgccggggtctacaccgccaccatcgacctcctggacgagaacaaccagaactgcaagctgttcaccgagtgcatcgtgaagggccgggagctcgtgaaggggcagagcgagctgaagtccttcaacatcgaggtcctgctcccgcgcgtgatgaagacccgccggaagctgctggccgtgacggacggcagcaccgagtgcaactccggcacccagctcatcgaggggaagtccatcgaggtccacaagcaggacatcggcgggcccggcaagaagctgaccatctgcaacggcacgagcgtgctggacgtgcccctcgacgaggggcacggctgctacaccatcaacgtcatcaccagcaagcgcgcctgccggcccaagaactccaagctgcagtgcagcatcgacaaggagctgaagccgtgcgacagcgggaagtgcctctccatcagccagaagggcgcggggcacatcaaggtgtcccgcggcaagaccatcctgatcacggagtgcaaggagcactgccagatccccgtgcccaccggcaagggggacatcatggtcgactgcagcggcgggcggcagcactacctggaggtgaacatcgtggacatccactgccccaacaccaagttcctcggcgggatcatgctgtacttctgccgcatgtccagccggccgaccgtcgccctgctcctgggcatctggatcggctgcgggtacatcctgacgtgcatcttctccttcctcctgtaccacctgatcctgttcttcgccaactgcatcaagcagtgccgcaagaagggcgagcggctcggggagatctgcgtgaagtgcgagcagcagaccgtgaacctgatggaccaggagctgcacgacctcaactgcaacttcaacctgtgcccctactgctgcaaccgcatgagcgacgagggcatgtcccggcacgtcgggaagtgccccaagcgcctggagcggctcaacgagatcgagctgtacctgaccaccagcgagtgcctctgcctgtccgtgtgctaccagctgctcatcagcgtgggcatcttcctgaagcgcacgacctggctggtcgtgctcctggtgctgctcggcctggccatctcccccgtccagggggccccgaccgaggtgagcaacgtgaagcaggacggcgactactccatctgctacttcatcttcgggtgcctggtcaccgcggccctcctgctgaaggtgaagcggacgaacagcaacggcatcgtggtcgtggtggactccttcggccgctgcccctactgcaacgagttcaccgacagcctcttcgaggaggtcctgcacgacaccctgtgcagcctctgcgtgtgccccttctgcgagaagcaggccctggacctggtgaccctcgaggagcacgtcaaggagtgctacaaggtggccacgcggaaggacatcttcaagatcctggggcgcaagttcaccaacgccctggtgcggcgcgagaagctgttcaccaccggcctgcagctgttcatcaacaagacgaacgtcgtggtgttcgcgctcatcatgtgcttcctgctgctcctgaccgggcacaacgcctccgccttcgacagcggcgacctgcccgacggggtctgggaggagtccagccagctcgtgaagtcctgcacccagttctgctacatcgaggaggacgtgtgctactgcccggccgaggacggcgtcggccgcaagctgctgttcttcaacgggctccagaacagcgtgaagcggctgtccgacagccacaagctgctcacctccgtgagcatcgacgccccctggggccgcatcaacgtcgagtccacgtggaagcccaccctggcggccagcaacatcgccatgtcctggagctccaccgacatcaagggggagaaggtgatcctgagcggccggtccaccagcatcatcaagctcaaggagaagacgggggtgatgtggaagctggtcggctccggcctggccagcgagaagaagaagccgttccgcttccccatcatggacttcgcccaggtgtacaacagcgtcttccagtacatcaccggggaccggctcctgtccgagtggcccaaggcggtgtgcaccggcgactgcccccaccgctgcgggtgccagaccagcacgtgcatggccaaggagtgccacacccaggagtgcgtgtccacccacatggtcctgggcatcgggaccggctgcacgtgctgcggcatggacgtggagcggccgttcaacaagtacctcggggtgaagtggagcaccgagtacctgcgcaccgaggtcctggtgtgcgtggaggtcaccgaggaggagcggcactgcgagatcgtggaggccggcacccgcttcaacatcgggcccatcacgatcaccatctccgacccccagaacatcggcagcaagctccccgagtccctgatgaccgtgcaggagatcgacgacagcaacttcgtcgacatcatgcacgtggggaacgtgatctccgccgacaacagctgccggctgcagtcctgcacccacggcagcgcggtcacgacccgcttcaccgccctcaccgccctgatcaaggacgaccactccagcggcctgaacctcgccgtgctggacccgaaggtgaactccagctggctgtcctgggaggggtgcgacatggactactactgcaacgtcggcgactggcccacgtgcacctacaccggggtggtgacccagaagctccgggagttcctgaagctggaccagcaccgcaagcggctccacacgaccctgagcttctccctgaagaagaacctcagcaagcgcagccacacctccgtccggctggagggcaagaccgtgacgcgcatggaggtgaaggtcaccgccctgatcgaggtggacggcatggagctccacagcaagaccatccggctgtccgggatccgcctgaccggcctcaagtgcagcgggtgcttctcctgcacgagcggcatctcctgcagcgtgaacgcgaagctgacctcccccgacgagttcaccctgcacctccggagcacctcccccaacgtcgtggtggccgagacgagcatcatcgcccgcaaggggccgtccgccaccaccagccgcttcaaggtcttctccgtgcgggacaccaagaagatctgcttcgaggtggtcgagcgcgagtactgcaaggactgcacgcccgacgagctgacgacctgcaccggcgtggagctggagcccaccaaggacatcctcctggagcaccggggcaccatcgtgcagcaccagaacgacacgtgcaagagcaagatcgactgctggtccaacagcatctccagcttcgccagcgggatcggcgacttcttcaagcactacatcgggtccatcgcggtcggcgtgctggggaccgtgctccccttcgccctgctgatcctcttcttcatctacggcgacaagatgctgtggccgttcaaggtcttctgccgcccctgccggcgctgctgccggaagaacgagggctacaacaagctggccgaggaggaggagctgcgcgacatcatccggaagttcagcaagtccggggagctcatcaacaaggacgccaaggacaagcgcaccctggcgcggctgttcatgagcgacaaccccaagctcaagaaggagaagaagctgtccgagatcgcctga

SEQ ID NO: 12495 - RNA, 4656 nt, synthetic construct
  misc_feature 1..4656: note = derived and/or modified CDS sequence (opt1) from DUGV(IbAr1792)__KU925456.1__GP
  source 1..4656: mol_type = other RNA
atgagcaagcgggtgctgatcatcgccgtcgtggtgtgcctcgtcttcaccacccagaaccagatcgccggcaaccacaccaccgcgaactccgggagcccctccaccaaggaggccagctccatgccgaccgtgagcgacacgccccagaccaccaccacgtccaccgccgtgagcaccaccatcacggccaccaccacccccacggcctcctggaccacccagagccagtacttcaacaagaccacgcagcaccactggcgggaggagaccatggtctcccgcaaccccaccgtgctgaaccggcagcgccgggcgagctccgtgaaggagctgctcaacaccaagttcctgatgctgctcggcttcatcccgaagggggaggtcaaccacctggagaacgcctgcaaccgcgagggcaagaactgcacggagctgatcctcaaggagcggatcgcccgcttcttcagcgagaccgagaaggagtcctgctacaacacctacctggagaagcacctgtgcagcgtgtcccccgaggtgagcctcaccccctaccgggtcctggggctgcgcgaggacatcctcctgaagaagatcgaccggcgcatcatccggttcgaggccgactcccagcgcgtgacgtgcctgagcgcgagcctcctgaagcccgacgtgttcatccgggagcagcgcatcgacgccaagccgtccaacggccccaagatcgtccccgtggacagcgtgcggtgcatcaacctggaggccaacgtcgacgtgcgctccaacaagctcgtgatccagagcctgatgaccaccgtcaagatctccctgaagaactgcaaggtggtggtcaacagccggcagtgcatccaccagcagaccggctccggggtgatcaaggtccccaagttcgagaagcagcagggcgggacgtggagctcctacatcgccggcgtgtacaccgccaccatcgacctcctggacgagaagaaccagaactgcaagctgttcaccgagtgcatcgtgaaggggcgcgagctcgtcaagggccagagcgagctgaagtccttcaacatcgaggtgctgctcccgcgggtgatgaagacgcgccgcaagctgctggcggtcaccgacggcagcaccgagtgcaactccgggacccagctcatcgagggcaagagcatcgaggtgcacaagcaggacatcgggggccccggcaagaagctgaccatctgcaacgggacgtccgtgctggacgtccccctcgacgagggccacgggtgctacaccatcaacgtgatcaccagcaagcgggcctgccgccccaagaactccaagctgcagtgcagcatcgacaaggagctgaagccgtgcgactccggcaagtgcctcagcatcagccagaagggggccggccacatcaaggtgtcccggggcaagaccatcctgatcacggagtgcaaggagcactgccagatccccgtccccaccgggaagggcgacatcatggtggactgcagcgggggccgccagcactacctggaggtgaacatcgtcgacatccactgccccaacaccaagttcctcgggggcatcatgctgtacttctgccggatgtccagccgcccgaccgtggccctgctcctgggcatctggatcgggtgcggctacatcctgacgtgcatcttctccttcctcctgtaccacctgatcctgttcttcgccaactgcatcaagcagtgccggaagaagggggagcgcctcggcgagatctgcgtgaagtgcgagcagcagaccgtcaacctgatggaccaggagctgcacgacctcaactgcaacttcaacctgtgcccctactgctgcaaccggatgagcgacgaggggatgtcccgccacgtgggcaagtgccccaagcggctggagcgcctcaacgagatcgagctgtacctgaactacaagcgggtgcccagctgcctccgctgcatgctgtccaccagcatctccgtcggcatcttcctgaagcggaccacgtggctcgtggtgctgctggtcctcctggggctggcgatcagcccggtgcagggcgcccccgccgaggtgtccaacgtcaagcaggacggggactacagcatctgctacttcatcttcggctgcctcgtgaccgccgccctgctgctcaaggtgaagcgcaccaactccaacggcatcgtcgtggtggtcgacagcttcgggcggtgcccctactgcaacgagttcaccgactccctgttcgaggaggtgctgcacgacacgctctgcagcctgtgcgtgtgccccttctgcgagaagcaggcgctggacctcgtcaccctggaggagcacgtgaaggagtgctacaaggtgaccacccgcaaggacatcttcaagatcctgggccggaagttcacgaacgccctcgtccgccgcgagaagctgttcaccaccgggctgcagctgttcatcaacaagaccaacgtggtggtcttcgccctgatcatgtgcttcctgctcctgctgacgggccacaacgccagcgccttcgactccggggacctcccggacggcatctgggaggagagctcccagctggtcaagagctgcacccagttctgctacatcgaggaggacgtgtgctactgccccgcggagaacggcgtggggcggaagctcctcttcttcaacggcctgcagaactccgtgaagcgcctgagcgactcccacaagctcctgaccagcgtgtccatcgacgccccctggggcgccatcaacgtcgagagcacctggaagccgacgctggccgcgtccaacatcgccatgagctggtccagcaccgacatcaagggggagaaggtgatcctctccgggcggagcacctccatcatcaagctgaaggagaagaccggcgtgatgtgggagctgggcagcgagctcgcctccgagaagaagaagctgctggtcagcatcatggacttcgcccaggtgtacaacagcgtcttccagtacatcacgggggaccgcctcctgtccgagtggcccaaggccgtgtgcaccggcgactgcccccaccggtgcgggtgccagaccagcacgtgcatggcgaaggagtggccccacacccgcaactggcggtgcaacccgacctggtgctggggcatcgggaccggctgcacgtgctgcggcatggacgtggagcgccccttcaacaagtacctgggggtcaagtggtccaccgagtacctccggaccgaggtgctggtgtgcgtcgaggtgaccgacgaggagcgccactgcgagatcgtggaggccggcacccggttcaacatcgggcccatcaccatcacgatcagcgacccccagaacatcggctccaagctgccggagagcctcatgaccgtccaggagatcgacgactccaacttcgtggacatcatgcacgtggggaacgtcatcagcgccgacaactcctgccgcctgcagagctgcacccacggctccgccggcgactaccagatctacagcaccgactccctgatcaaggacgaccacagctccgggctcaacctggccgtgctggaccccaaggtgaacagctcctggctcagctgggagggctgcgacatggactactactgcaacgtcggggactggcccacgtgcacctacaccggcgtggtgacccagaactccgagagcttcagcaacctgatcaacatcgagaaggactacacgcagcggttccacttccactccaagcgcatcagcgcgaagggccacaccctgcagctcgacctgaaggcccggcccaaccaggacgggggcgaggtcaccgccctgatcgaggtggacgggatggagctccactccaagaccatccgcctgagcggcatccggctgacggggctcaagtgctccggctgcttcagctgcacctccggcatcagctgctccgtgaacgccaagctgaccagcccggacgagttcaccctgcacctccgctccacgagccccaacgtcgtggtggccgagacctccatcatcgcgcggaaggggcccagcgccaccacctccaagttcaaggtcttcagcgtgcgcgacacgaagaagatctgcttcgaggtggtcgagcgggagtactgcaaggactgctcccccgacgagctgacgacctgcaccggcgtggagctggagccgcccaaggacatcctcctggagcaccgcgggaccatcgtgcagcaccagaacgacacgtgcaagagcaagatcgactgctggtccaacagcatcagctccttcgccagcggcatcggggacttcttcaagcactacatcggctccatcgccgtcggcatcctggggaccgtgctccccttcgcgctgctgatcctcttcttcatctacggcgacaagatgctgtggcccttcaaggtgttctgccgcccgtgccggcgctgctgccggaagaacgaggggtacaacaagctggccgaggaggaggagctccgcgacatcatccggaagttcagcaagtccggcgagctgatcaacaaggacgccaaggacaagcgcaccctggcccgcctcttcatgagcgacaaccccaagctgaagaaggagaagaagctgtccgagatcgcctga

SEQ ID NO: 12496 - RNA, 4884 nt, synthetic construct
  misc_feature 1..4884: note = derived and/or modified CDS sequence (opt1) from NSDV(Jilin)__NC_034391.1__GP
  source 1..4884: mol_type = other RNA
atggtgagcctggagaagggcctcatcctgctgctcctgatgcacatcgccatcgcctccaccgggggcagcctggggctccccggcctgaacggggaggaccacaccgacgacccggaggtcggcggcgacgggcccacggaggagtacaccgaggacgaccccgagtccaccaccgtgagcatccccacgaccccgcccgtgctgggccaggggaccgaggaggtccccgcgacctccggcgaggccgaggccgggtacagcacgaccgacgtgcccgacaccgtgtccgagaaggtcgaggacgagcaggacaccacgccgagcacccaggtgacccccgaccagcccgagcagtccaccacgagcctccccgacccgtggaccgccatctccacccgcatcggccgggagctgctgagcgtggagtccgacaccaccaagagctccctcgtcaccgtgggccacccccagcagcccatcttcctggacgggcagcccgtggaggaggtcacccacccggtgaacgagcgcgacgtgaccgaggccctgcggaagtacgacaagatgaagaagctcctgagccagcgcatcctgtccaagatgggcatggcgcgggacttcacggacgaggagctcgacgtctggtgccacgagcgcttcgacaactgcagctccaacgacatcgagaaccggatccgcgacttcttcctgatcagcgaccagaccgagtgcttcgacgaggtgctggtgaagcggctctgcgagagcaccaaccccatcgtcggggagccctggcaggtcgccggcatcaaggaggagatcgtgcgccgggagatgggccgccggatcttccgcttcttcacccccacgctgaaggtgacctgcgtgtccgggagcctgaacccgtccgaccagttcgtgcggttctacgaccccgtcatcgagcgcaccagcggccccaccatccagaactacgactccatgcactgcctcaacatcgagaacgggctggccaagcccagcaagatggtggtcctgaacgtgctcatgacgaccgtggaggtccggctggagtcctgccgcgccttcatcaacgcgcaccagtgcatctacacccagcacgccgacggccaggtgatggtgccgaccttcgtcgaccacagcgggacgcggcgcaccatcggcgcctacaccatgtccttcaacctgaccgacgagcggaaccgcgcctgcatcatccgcaccacgtgcgtggtgaagggcaaggaggtcaagaaggggcagagccagctccggggcttccccacctccatccgcctgttcaagagcgtgaccgggaagcggcgcctgatggccgaggagggcgactggaccgactgcgggtccggcacgcagctcgacatgaccatggcggtgagcgtccacaacgacaagaagggcgggcccggcaagaagctgaccatctgcaacgggaccacggtgtccgacagcaccctgaacgagggcctcgggtgctacaccatcaacaaggtgatcaccggcaaggcctgcaaggtcggcaactccacggggagctgcgaggtgcagaccgagctgcagaagtgcgagaccggcaagtgcatcctggtgaagcagaagtccaagggggtcgtgaagctcaagcggggcaagaccgtgatcatcacggagtgccagggcagctgcctgttcgccatcccccaggacaccggggacatcaccatcgactgcagcggcgggcgccagcactacctggagatcaacatcgtcgacatccactgcccgggcaaggacaagtggaaggggttcatgctctacatctgccgggtgtccagccgccccctgatcgccctgaccttcggcctctggctggccgcgggctacctgatcacgtgcctcgtgtccttcatcatctacaacgccgtcctgctgctgagcatcgccatcaagaaggtgcggcaggggcgcgagaagaagggcgacctctgcatcaagtgcgagcagcactgcatgaacctgtacgaccaggagctgcacgagctcaactgctccttcaacctgtgcccctactgcgccaaccggctgagcgacgaggggctcccgcgccacgtgccccggtgccccaagaagtccgagcgcctggaggagatcgagctgtacatcaactacacccgggtcccctgcatcctccgctggatcctgagcacctccgtccaggtgggcaccgccgtgaagcggctgagctggttctccgtgctcgtgacgctgttcatcctgaccatcagcccggtccaggggttccccctcgagtccccgcccatcggcgcggccaccgacagccgcatcatgtacggcgtggtggggttcatgttcgccctgatcatgatgctgaacctcaagaagtcccactacggcagcatcttccacgtcatcgacgggttcggccggtgcaacctgtgcgacacccgcatcgactccctgatggaggagacggcccacgacctctgctgcatgttcgactgctgcccctactgccaccgcgtgagcgagagcaacgggtcccactgcttccacgtgcggatctgcgtcgccaaggagatcagcaagaagatgctgaaggcgggcggccgcctgttcaccaacaagctcgtgtcccgggaggggaccttcgccaaccgcatccagctgctgtaccggcgcagcaaggtggtctccaccctcgtggtgacggtcctgctgctcctggtgctgctcaagcccaccaccgccttcgacagcggccccctgcccgacgggacctgggaggaggaggagaagctggtgcggaactgcggccaggagtgcatcctcgaccagggggagtgcctgtgcccgggcgagcaccgcgccggccggaagctgctgttcctgaacgggctgcaggacgcggcccgccggatgacggagtcccaccgcctcctgaccagcgtctccatcgacgccccctggggcgccatcaacatcgagagcaccttcaagcccgtgctggccgcgtccaacatcgacctcagctggaactccgccgaggagcagggggacaagatcatcctgagcggccggtccaccggcatcatcaagctgcaggagcgcaccgggctcatgtggaagatgagctccgagaaggccagcgagtccaagaacctgctggtgagcgtcatggacttcagccagctctacaactccatcttccagtacatcacgggcgaccggagcctgtccgagtggcccaaggccgtgtgcaccggggactgcccggaccgctgcggctgccagaccagcacgtgctaccacaaggagtggccccacacgcggaactggcgctgcaaccccacctggtgctgggggatcggcaccggctgcacgtgctgcgggatggacgtcgagcggtacttcaacaagtacttcggcgtgaagtgggccctggagtacgtgcgcaccgacgtcgtggtgtgcgtcgagctcaccaacgaggagcggcactgcgacctggtgcaggcggggtcccgcttcagcatcggccccgtgtccgtcaccctgagcgacccgcagaacgtggtgaaccgcctctccagcaacatcatgaccatccaggagatcgccgacaacgggatcctggacctgatgcacgtctccaaggtgatcagcgccgagaacgcctgcaagctccagtcctgcacgcacggcagccccggcgacctgcagatcctgcacaccgacaacctcatcaagggggacatgtccggcgggatcaacctggcccacctggacccccaggtgaacaccagctggatgtcctgggagggctgcgacctcgactactactgcaccgtcggggactggcccagctgcacgtacaccggcgtgaactccatcaacaccgacagcttcaccaacctgatcaacacggagaccgactacaccggcaagttccacttccacagcaagcggatctccgcgcgcgacgacaccctgcagatggacctcaaggcccggccgaacagcgggggcggggagatgacggtgctggtcgaggtgaacggcctggagctccactccaagcgcatcagcctgaagggcctgcggctcaccaacctgaagtgcgacgggtgcttcgcctgctcccagggcctgacctgcaccatcacggccaagctcgagagccccgacgagttcaccatccacctccgctccaccagccgggacgtggtcgtggcggagacctccgtgacggcccgcaaggtcgagaccggggcccggagcggcttccgcgccttcgccgtgcgggacgtgaagaagctgtgcctcgaggtcgtggagaaggactactgcccctcctgcaccgtggaggacctgaagatctgcgtcgacgtgagcctggagccgcccaaggacatcctcatcgagcacaaggggaccatcatccagcactacaacaagtcctgcgacgagggctacaactgctgggtgggcagcgtctccgggttcttcgtgggcgtgaaggacttcttcgagaagaacctcgggggcgtcctgatcgggctggtgagcacgatcctgcccctggtgctcaccgtcctgttcttcatctacggcaagaagctgttctgcctctgccgcctgtgccacaagaagtgctgccggggctccgggcgcggccgggacgggtacagccgcctgtcccaggaggaggagatcaaggagatcatcaagaagttcagccggaacggcgagctgctcgggaagggcgagaacgacaagcgcaccgtggcgcggatgttcatggacggccagagcaccaagaaggccatcaaggaggtggcctga

SEQ ID NO: 12497 - RNA, 4884 nt, synthetic construct
  misc_feature 1..4884: note = derived and/or modified CDS sequence (opt1) from NSDV(708)__EU697952.1__GP
  source 1..4884: mol_type = other RNA
atggtgagcctggagaagggcttcttcttcctcctgctgctccacatcgtcaccgcctccaccgggggcccgcccgggctgcccggccccaacgggaaggaccagacggacggccccgagggcgggggcgacgggccgaccgaggagtacaccgaggacgacttcgagagcaccacgttctccatccccaccaccccgcccgtgagcgagcaggacgccaaggaggtgtccgcgaccagcgaggaggccgaggtcgaggactccacgctgatcgtgcccaagaccatgagcgagaaggtgggcgacgagcagtccaccaccagcaacatgcaggtcacgacctcccagcccgagcagagcaccaccgggatgcccggcccctggatggcctccagcatcaagatcggccgcgagctcctgtccgtggagagcgacacgaccaagtccagcctggtgaccgtcgggtacccgcagcagcccatcttcctcgacggccagcccgtggaggaggtgacccaccccgtctccgagcgggacgtggccgaggccctgcgcaagtacgacaagatgaagaagctgctcagccagcggatcctgagcaagatggggatggcgcgcgacttcacggacgacgagctggacgcctggtgccacgagcggttcgacaactgctccagcaacgacatcgagaaccgcatcaaggacttcttcctcatctccgaccagaccgagtgcttcgacgaggtgctggtcaagcggctgtgcgagagcaccaacccgatcatcggcgagccctggcaggtcgccggcatcaaggaggaggtggtgcgccgggagatggggcgccggatcttccgcttcttcacccccacgctcaaggtgacctgcgtgtccggcagcctgaacccctccgaccagttcgtccggttctacaacccggtgatcgagcgcaccagcgggcccaccatccagaactacgactccatgcactgcctgaacatcgagaacggcctcatcaagcccagcaaggtggtcatcctgaacgtgctgatgacgaccgtcgaggtgcggctcgagtcctgccgcgccttcgtgaacgcgcaccagtgcatctacacccagcacgccgacgggcaggtccgggtgcccaccttcgtggaccacagcggcacgaagcgcaccatcggcgcctacaccatgtccttcaacctgaccgacgagcggaacaaggcctgcatcatccgcacgacctgcgtcgtgaaggggaaggaggtgaagaagggccagagccagctgcgggggttcccgacctccatccgcctcttcaagagcgtcaccggcaagcgccggctgatggccgaggagggggactggaccgactgcggctccggcacgcagctggacatgaccaccgcggtgagcgtgcacaacgaccgcaagggcgggcccgggaagaagctcaccatctgcaacggcacgaccgtctccgacagcaccctgaacgaggggctgggctgctacaccatcaacaaggtgatgacgggcaaggcctgcaaggtggggaacagcaccggctcctgcgaggtccagcccgagctccagaagtgcgagaccgggaagtgcatcctggtgaagcagaagaacaagggcgtggtcaagctgaagcggggcaagaccgtgatcatcacggagtgccaggggagctgcctcttcgccatcccccaggacaccggcgacatcaccatcgactgctccgggggccgccagcactacctggaggtgaacatcgtcgacatccactgcccggggaaggacaagtggaagggcttcatgctgtacatgtgccgggtgagctcccgccccctcatcgccctgaccttcggcctgtggctcgccgcggggtacctgatcacgtgcctggtgagcttcatcatctacaacgccgtcctcctgctgtccatcgccatcaagaaggtgcggcagggccgcgagcggaagggggacctctgcatcaagtgcgagcagcactgcatgaacctgtacgaccaggagctgcacgagctgaactgcagcttcaacctctgcccctactgcgccaaccgcctgtccgacgagggcctgccgcggcacgtgccccgctgccccaagaagaccgagcggctcgaggagatcgagctgtacatcaactacacccgcgtcccctgcatcctgcggtggatcctcagcacctccgtccaggtggggacggccgtgaagcgcctgagctggttctccgtgctggtgatcctcttcgtcctgaccatcagcccggtgcagggcttccccctggagaacacccccatcggctccaccacggacagccggatcatctacggggtggtcggcttcatcttcgcgctcatcatgatgctgaacctgaagaagtcccactacgggagcatcttccacgtgatcgacggcttcgggcgctgcaacctctgcgacacccggatcgacagcctgatggaggagaccgcccacgacctgtgctgcatcttcgactgctgcccctactgccaccgcgtgtccgagagcaacggctcccactgcttccacgtccgcatgtgcgtggccaaggagatcagcaagaagatgctcaaggccgccggccggctgttcaccaacaagctggtgtcccgcgaggggatcttcgcgaaccgggtccagctcctgtaccgccggagcaaggtggtgtccacgttcgtcgtgaccgtgctgctcctgctggtcttcctccgcccggccaccgccttcgacagcggccccctgcccgacgggacctgggaggaggaggagcggctggtgcgcaactgcggccaggagtgcgtgctcgaccaggacgagtgcctgtgccccggggagaaccgggccggccgccggctgctgttcctgaacggcctgcaggacgcggtccgccggatgacggagtcccaccgcctcctgaccagcgtgtccatcgacgccccgtggggcgccatcaacatcgagagcaccttcaagcccgtcctggccgcctccaacatcgacctcagctggaactccgcggaggagcagggggacaagatcatcctgagcgggcggtccaccggcatcatcaagctgcaggagcgcacgggcctcatgtggcggatgagctccgagaaggccagcgagagcaagaacctgctggtgtccgtgatggacttcagccagctctacaactccatcttccagtacatcaccggggaccgcagcctgtccgagtggcccaaggccgtctgcaccggcgactgccccgaccggtgcgggtgccagaccagcacgtgctaccacaaggagtggccgcacacccgcaactggcggtgcaaccccacctggtgctggggcatcgggaccggctgcacgtgctgcggcatggacgtggagaagtacttcaacaagtacttcggggtgaagtgggccctggagtacgtccgcaccgacgtggtggtctgcgtggagctcaccaacgaggagcgccactgcgacctggtgcaggccggctcccggttcagcatcgggcccgtctccgtgaccctgagcgacccccagaacgtggtcaaccgcctctccagcaacatcatgaccatccaggagatcgcggacaacggcatcctggacctgatgcacgtgtccaaggtgatcagcgccgagaacgcctgcaagctccagtcctgcacgcacgggagcccgggcgacctgcagatcctgcacaccgacaacctcatcaagggcgacatgtccgggggcatcaacctggcccacctggacccccaggtcaacaccagctggatgtcctgggaggggtgcgacctcgactactactgcaccgtgggcgactggcccagctgcacgtacaccggggtgaacagcatcaacaccgactccttcaccaacctgatcaacacggagaccgactacaccagcaagttccacttccactccaagcggatcagcgcccgcgacgacaccctgcagatggacctcaaggcgcggcccaacacgggcggcggggagatgaccgtcctggtggaggtgaacggcctggagctccactccaagcgcatcaacctgaaggggctgcggctcaccaacctgaagtgcgacggctgcttcgcctgcagccagggcctgacctgcacggtcatcgccaagctcgtgtccccggacgagttcaccatccacctccgcagcacctcccgggacgtggtcgtggccgagaccagcatcacggcgcgcaaggtggacaccggggcccggtccagcttccgcgccttcgccgtccgggacgtgaagaagctgtgcctcgaggtggtcgagaaggactactgcccctcctgcaccgtggacgacctgaagatgtgcgtggacgtcagcctggagcccccgaaggacatcctcatcgagcacaagggcaccatcatccagcactacaacaagtcctgcgacgaggggtacaactgctgggtgggcagcgtgtccgggttcttcgtcggcgtgaaggacttcttcgagaagaacctgggcggggtgctgatcggcctcgtcgggacgatcctgcccctggtgctcaccatcctgttcttcatctacggcaagaagctgttctacctctgccgcctgtgccacaagaagtgctgcaaggggagcggccggggccgcgacgggtactcccggatcagccgcgaggaggagatcaaggagatcatcaagaagttcagccggaacggcgagctgctcgggaagggcgagaacgacaagcgcaccgtggcccgcatgttcatggacgggcagtccaccaagaaggcgatcaaggaggtcgcctga

SEQ ID NO: 12498 - RNA, 4875 nt, synthetic construct
  misc_feature 1..4875: note = derived and/or modified CDS sequence (opt1) from NSDV(779)__HQ286599.1__GP
  source 1..4875: mol_type = other RNA
atggccctggtggccaagggcctcatcctgatgctgctcctgtacatgttcaaggcgagcgaggtcaacctggagctcccctcctggaacagcaccgaggggaccgagtacgccgacgagctgccgacggagccgccctccgaggaggagcccaagctggccgccgtgagcaccgtgaccaccccggccccgcccaaggagtccacggaggacaccatcgagagccccgacggcggggagaccatggcgcccaccacgcccgcccccgtcaccgactccgccagcaagctcgaggaggagcccggcaccacccagcaggcccagtccacgcagatgcagaacagccaggcgccgatcgggatgcccgaggcctggtccaccagcccctcccgcgtgggccggaagcccctgagcgcctccccggacgtgagcgagcccgaccagaacaccgaggcccagacccacccgcccgtcttcctggacggccgccccgtggaggaggaggagcactccgtggggacgcgggacgtcgccagcgacctccgcgagtacaaccagatgaagcagctgctgtcccagcggatcctcgcgaagatgggcatggccgtggacttcaccgacgacgagctggacacctggtgctaccgccggtacagcaactgcagctccaacgacatcgagagccgcatccgggacttcttcctgatcaccgaccgctccgagtgcttcgacgaggtgctcgtcaagcggctgtgcgagacgaccagccccatcatcgaccgcgcctggaagatcgccgggctgaaggaggaggtggtgctccgggagatgggccgccggatcttccgcttcttcacccccgccctgaaggtgacctgcatgtccgggagcctgaacccctccaaccagttcgtgcggttctacaacccgacgctcgagcgcaccagcggccccaccatccagaactacgacggcatgcactgcctgaacatcgagaacgggctgatcaagccctccaaggtggtcgtgatcaacgtgctcatgaccacggtcgacatccggctggagagctgccgcgcgttcatcaacgcccagcagtgcacctacacccagcacgccgacggcctggtgcgggtgcccaccttcgtcgggccgcacggcgagaagcgcatcatcggcgcctacacgatgtccttcaacctcaccgacgagaagaacaaggcctgcaccatcaagaccacgtgcgtggtcaaggggaaggaggtgaagaagggccagagccagctgcgcgggttccccaccaccatccggctgttcaagtccgtgaccggcaagcgccggctcatgagcaacgaggaggagtggaccgagtgcgggtccggcacgcagctgaacatggcgaccgccgtcagcgtgcacaacgacaagctgggcgggcccggcaagaagctcaccatctgcaacgggaccacggtgtccgacatcgccctgaacgagggcctggggtgctacaccatcaacaagatcatcaccggcaaggtctgcaagaccggcaacacgaccgggagctgcgaggtgcagccggagctccagaagtgcgagaccggcaagtgcatcctgatcaagcagaagaacaagggggtggtcaagctgaagcgcggcaagaccgtgatcatcacggagtgccaggggtcctgcctcttcgccatcccccaggacaccggcgacatcaccatcgactgcagcggcgggcggcagcactacctggagatcaacatcgtggacatccactgccccggcaaggacaagtggaaggggttcatgctgtacatctgccgcgtcagctcccggcccctcgtggccctgaccttcggcatctggctgacggcgggctacctcatcacgtgcctggccagcttcatcctgtacaacgccatcctgctcatctccatcgccatcaagaagctgaagcagaagcgcgagaagaagggggacctgtgcatcaagtgcgagcagcactgcatgaacctctacgaccaggagctgcacgagctgaactgcagcttcaacctctgcccgtactgcgcgaaccggctgtccgacgacggcctgccccgccacgtgccccggtgccccaagcgcggggagcggctcgaggagatcgagctgtacatcaactacacccgcgtcccgtgcctgctccggtgggccctgagcacctccgtccaggtgggcaccgtcatcaagcgcctgagctggttcggggtgctcctgaccctgttcttcctcaccatctcccccgtgcagggcttccccctggagaacccgcccatcggcaccgccacggacagcaacatcatctacgggctggccggcttcatcttcgccctcgtcctgatgctgaacctcaagaagacccactacgggtccgtgttccacgtgatcgacggcctggggctgtgcagcctctgcgacacccggatcgactccctgatggaggagaccgcgcacgagctgtgctgcgccttcgactgctgcccctactgccaccaggtcagcgagtccaacggcagccactgcttccacatgcgcatctgcgtgtccaaggagatcagcaagaagatgctcaaggccgccggcaagctgttcacgaacaagctggtgagccgggaggggttcttcgccaacaagatccagctcctgtaccagcgctccaaggtcgtgagcaccctgatcctcaccgtgctgctgctcctgatcatcctgaagcccgcggccgccttcgactccggccccctcccggacgggacctgggaggaggaggagagcctgatccgctcctgcgaccaggagtgcgtcctggagcaggacgagtgcctctgccccggcgagcaccgggccgggcgccggctgctgttcctcagcggcctgcaggacgccgcgcgccggatgacggagtcccaccgcctgctcaccagcgtgtccatcgacgccccctggggcgccatcaacatcgagagcaccttcaagcccctgctggccgcgtccaacatcgacctcagctggaactccgccgaggagcagggggacaagatcgtgctgagcggccggtccaccgggatcatcaagctgcaggagcgcacgggcctcatgtggaagatgagctccgagaaggccagcgagtccaagaacctgctggtcagcatcatggacttcagccagctctacaactccatcttccagtacatcaccggggaccggagcctgtccgagtggccgaaggccgtgtgcaccggcgagtgccccgaccgctgcggctgccagaccagcacgtgctaccacaaggagtggccccacacccggaactggcgctgcaaccccacctggtgctgggggatcggcaccgggtgcacgtgctgcggcatggacgtggagcggtacttcaacaagtacttcggcgtcaagtgggccctggagtacgtgcgcaccgacgtggtcgtgtgcgtggagctcaccaacgaggagcggcactgcgacctggtccaggcggggtcccgcttcagcatcggcccggtgtccgtgaccctgagcgacccccagaacgtcgtgaaccggctctccagctccatcatgaccatccaggagatcagcgacaacgggatcctggacgtgatgcacgtctccaaggtgatcagcgccgagaacgcctgcaagctgcagtcctgcacgcacggcagccccggggacctccagatcctgcacaccgacaacctgatcaagggcgagatgtccagcggcatcaacctcgcccacctggacccccaggtgaacacctcctggatgagctgggaggggtgcgacctggactacttctgcaccgtcggcgactggcccagctgcacgtacaccggggtgaactccatcaacaccgacagcttcaccaacctcatcaacacggagaccgactacacctccaagttccacttccacagcaagcgcatctccgcccggggcgacaccctgcagatggacctgaaggcgcgccccaacgtcgggggcggcgagatgacggtgctcgtggaggtcaacgggctggagctgcacagcaagaagatctccctcaagggcctgaagctgagcaacctcaagtgctccgggtgcttcgcctgcagccccggcctgtcctgcaccgtgatcgcccggctggagagcccggacgagttcaccatccacctccgctccaccagccgcgacgtggtcgtggccgagacgtccgtgaccgcccggaaggcggagaccggggccaagagctccttccgcgccttcgccgtcaaggacgtgaaggagatctgcctggaggtggtcgagaaggagtactgccccagctgctccatcgaggacctgaagatctgcatcagcgtgaccctcgagccgcccaaggacatcctgatcgagcacaagggcacgatcgtgcagcactacaacaagagctgcgacgagggctacaactgctggatcgggtccgtcagcggcttcttcgtgggggtgaaggacttcttcgagaagaacttcggctccgtcatcatcggcatcgtgagcaccgtgctgcccctcatcctgaccgtcctgttcttcgtgtacgggcggcgcctgttctgcctctgccggctgtgccacaagaagtgctgccgcggctccagccgggggcgcgacggctactcccggctgagccaggaggaggagatcaaggagatcatcaagaagttcaaccgcaacggggagctcctgggccggggcgagaacgacaagcgcaccgtggcgcggatgttcatggactcccagagcgcccgcaaggccgtcaaggaggtggcctga

SEQ ID NO: 12499 - RNA, 4302 nt, synthetic construct
  misc_feature 1..4302: note = derived and/or modified CDS sequence (opt1) from BUNV__NC_001926.1__GP
  source 1..4302: mol_type = other RNA
atgcgcatcctgatcctcctgctggccgtgacccagctcgccgtcagctcccccgtgatcacccggtgcttccacggcgggcagctgatcgcggagcgcaagagccagacgtccatcagcgagttctgcatcaaggacgacgtgtccatgctcaagagcgagatcgtctacaccaagaacgacaccggcatcttcgggcactccaaggtgttccggcactggaccatcacggactggaaggcctgcaacccggtggtcaccgccggcgggagcatcaacgtgatcgaggtggacaagaacctgaacctggtcacccgcaactacgtgtgcaccggcgactgcacgatcaccgtggaccggaagaacgcccagatcatcttccagaccgacaagctgaaccacttcgaggtcaccggcacgaccatctccaccgggtggttcaagagcaaggcctccgtgaccctcgaccgcacgtgcgagcacatcaaggtgagctgcggcaagaagaccctgcagttccacgcgtgcttcaagcagcacatgtcctgcgtccggttcctgcaccgcagcatcctccccgggtccatggccatcagcatctgccagaacatcgagctgatcatcatcaccatcctggccctctgcatcttcatcatcatgatcatcctgaccaagacgtacatctgctacgtgctgatccccgtgttcatgcccatcgccttcgcgtacggctgggcctacaaccggtcctgcaagaagtgcacgtgctgcgggctcgcctaccacccgttcaccaactgcggcagctactgcgtctgcggctccaagttcgagaccagcgaccgcatgcggatgcaccgcgagagcgggctgtgccagggcttcaagtccctgcgggtggcccgccggctctgcaagagcaaggggtccagcctgatcatctccatcctgctcagcgtgctgatcctgtccttcgtcacccccatcgagggcaccctcaccaactaccccaccgaccagaagtacacgctggacgagatcgccgacgtgctgcaggcgaagacccacgaggacagcaccaagtactacatcatcctctacacctccctgttcggcgccgggctgacgatcatcttcgccggcgtggccctcgggctgaccatcatcctggaggtcctcaccaagatcaacgtgatcttctgcaacgagtgcaacatgtaccacagcaagaagtccatcaagtacgtcggcgacttcaccaacaagtgcgggttctgcacgtgcggcctgctggaggaccccgagggcgtggtggtccacaaggccaagaagtcctgcacctacagctaccagatcaactgggtgcgcgggatcatgatcttcgtggcgttcctcttcgtcatccagaacaccatcatcatggtggccgccgaggaggactgctggaagaacgaggagctgaaggaggactgcgtgggcccgctgatcgcccccaaggactgcaccgacaaggaccacaagacctacctcagcgaggcctccctgctggcgacggccaagaagatcacccaggtcgacgccgagaacgtggagatcctcgggaagaccatggagagcgccatccgggtgatcgagcgccagaagacctaccaccggatgcacctcctggaggccgtcttcctgaacaagcactgcgactactacaagatgttcgagcacaactccggctacagccaggtgaagtggcgcatgatgatcaagacgcagcacttcgacatctgcgcgctgcaggccaactcccccttctgcgcccagtgcatcgccgacaacagctgcgcgcaggggagctgggagttcgacacccacatgaactccacctacagctccaaggtggacaacttcaagcacgacttcagcctgttcctgcggatcttcgaggccgccttccccggcaccgcctacgtccacctcctgacgaacatcaaggagaagaagccgtaccaggccgtgtccatgatcgagaagatcaagaagaagttccccaacaacaagctgctcatcggctacctggacttcgggaagtacctgctcggcctgagccacgcgtccacctacgagctgcagcagcgccagctcgacaagctgtaccagcccaccgagctgacccgcagcgggggccagcagacgtccctcgccaacagcgtggtcgggcaggccaccaaggagtgcaagaagtacaaggacgtgtcctgcctgagcccccggttcggcatcccgctggaggacctcatctcctgctgcgaccagcccaactacaacatctacaagaagcccaagaaggtgtacaaggcccacgacaaggaggagacctggtgcatcaacgaccagcactgcctggtcgacttcgtgcccgccgaggcggacaccgtggagaagctgaagccgatgaagtgctggctcgtcgaccccggcaagaacgacgacgtgtacagcatcgccatcaagacgtgccgcgtggtcgacaagggggtgtgcaccgtgaactcccagaagtggaacatcatcaagtgcgacagcggccccctgtactactccgaccacatccccggggaggacaccggcaacgacatcggccactactgcgtcagcgccgggtgcaagaccgaccggtacccgatcaaccccgacgtggtgacggactgcgtctgggagttcaccagccgcaagtcccagtacatcggcaagatcagcatgcagtccctggaggactacgagaaggccctcaccgaccggctgacccacacgctggagacctacagcttcgcgcccctcgagaacctgccccacatcaagccggtgtacaagtacatcaccgcccagggggtggagaactccgacggcatcgagggggccttcatcaccgccagcatccccgccgcgggcggcacgtccatcgggtacaacgtccgcagcaaggacggcttccccctgctcgacctgatcgtgttcgtgaagtccgccgtcatcaagagcacctacaaccacatctacgacaccgggccgaccatctccatcaacacgaagcacgacgagcactgcaccggccagtgccccagcaacatcgagcacgaggccaactggctgaccttctcccaggagcggaccagccgctgggggtgcgaggagttcggctgcctcgccgtgaacacgggctgcgtgttcgggtcctgccaggacgtcatccggcccgagaccaaggtgtaccgcaaggccgtggacgaggtcgtgatcctgaccgtgtgcatcacctaccccggccacaccttctgcacggagatcaacgcgatcgagccgaagatcaccgaggagatcgagctgcagttcaagaccgtcgacaccaagacgctcccctacatcgtggccgtgaacaaccacaagctgtacagcgggcagatcaacgacctgggcaccttcgggcagatgtgcggcaacgtccagaagaccaactccagcatcctcggcaccgggacgcccaagttcgactacacgtgccacggcgcctcccggaaggacatcatcgtgcgccggtgctacaacaacaacttcgacagctgcaagctgctgaaggaggagacccagctcatcttcaacgacgaccacgacaccatcaccgtctacaacaccaaccacctgatcggggagctggccatcaagctcatcctgggcgacatccagtacaagctgttcaccgagaccctcgacctgcagatcgacgccaagtgcgtggggtgccccgactgcttcgagagctactcctgcaacttccagatcgtgagcaacatcgacacgatctgctccctggagggcccgtgcgacaccttccacaaccgcatcagcatcaaggcgatgcagcagaactacgccgtcaagctctcctgccagaaggacccccggcccagcggcaccttcaagatctgcaaccgcgagtacaccgtggtgttccacacggtcgccaaggacgacaagatcgagatcaacgtgggggaccagacctccttcatcaaggagaaggacgaccggtgcaagacctggctgtgccgcgtgcgggacgagggcatcagcgtcatcttcgagcccatcaaggccttcttcgggtcctacttcagcatcttcttctacatcatcgtggtggtcgtggtgggcttcctgatcatctacatcttcatgccgatgttcatgaagctcaaggaggtcctgaaggccaacgagaagctgtacctccaggagatcaagcagaagtga

SEQ ID NO: 12500 - RNA, 4311 nt, synthetic construct
  misc_feature 1..4311: note = derived and/or modified CDS sequence (opt1) from BUNV(SFCrEq231)__KP063893.1__GP
  source 1..4311: mol_type = other RNA
atgaagatgatcctgctcatcatcatcctgtgcgtgaacctggccgccgcgaaccccgtcgccacccgctgcttccacggcgggcagctcatcgccgagacccggagcgccacgtccatcagcgagttctgcctgaaggacgacgtgtccatgatcaagagcgagatcacctacaccaagaacgacaccggcatcttcgggcactccaagatctacaagagctggctgatcaaggactggaagctctgcaacccggtgcccacggccggcgggtccatcaacgtcatcgaggtgaacagcgacctgtccctgaccaccaaggcgtacgtgtgcagccgcgactgcaccatcacgatcgacaaggaggaggcccagatcatcttccagaccgacaagctcaaccacttcgaggtctccggcaccaccctgagctccggctggttcaagacgaaggccagcgtgaccctggaccggacctgcgagcacatcaaggtgacctgcgggaagaagacgctccagttccacgcctgcttccgccaccacatgtcctgcgtccggttcttccacaacaccatcctgcccggcaccatggtgaacagcatgtgccagaacatcgagctgatcatcatcctcgggctgaccctgatcatcttcacgctcatggtgatcctgaccaagacctacatctgctacatcctgatgcccctcttcatgccgatcgcgtacgcctacggctgggcctacaacaagtcctgcaagaagtgcaactgctgcgggctggcctaccaccccttcaccaactgcggcagccactgcgtctgcggcctgaagttcgaggcctccgaccgcatgcggatccaccgcgagagcgggctctgccagggctacaagagcctgcggatcgcgcgcctgctctgcaagtccaaggggagctccctgatcatcagcacgctgctctccatgctgctgctcagcttcatcacccccatcgagggcaccatgaccaactaccccgagacgcggcagtactccctggaggagatcgccgacgtggtggagggcctgctcagcgagcagaacatcaaggagtacgtcgtgttctacacctccctgttcgggagcctgatcctcctgctggccttcatcctctccatcaccctgaccaaggtgacgaacgccctggcccgcaccaacgtcatctactgcgaggagtgcagcatgtaccacgcgaagaagggcatcaagtacaacggggacttcaccaacaagtgcggcttctgcacgtgcgacgagcaggaggacgaggaggggatcatcatccacaaggtgtccaagaagtgcacctaccggtaccagctccagtgggccaagatcatcatgatcatcctggtgatgctgctcatgatgcagaacaccatcctgatcgtcgccgccgagaccgactgctggaccaagaacagcctggagctggactgcatcggcccgctcctgaccatctccgactgcagcaacaaggagtccaagaactacgaggaggaggccgcgaagctggtgagccagtccaagatcacgcaggccgacgccgagcaggtcaccatcctcggcaacaccatcgacaccgccctgaaggccatccgcagccagaagacgtaccagaccatgcacctcctcgagagcgtgttcctgatgaagaactgcgactactactccagcttcgagcccaactccgggtacagccaggcgaagtggcggctgatcgccaagacctcccacttcgacatctgcagccgccactccatgcaccacttctgccggtgcgtggccgacggcaccaagtgccagaacggggactgggacttcgccggcgagatgaacaacatctacagcacgaagaacgacttctacctccacgacctgaacctgttcttcaccctccacgagaccgcgttccccgggaccacggagtccctgttctaccagctgatcgccaagaagaacaccaccggcgccagcaagctcctgggcaagctgatcaccaagtacgggaacaacaagctgttcgtcggcatctggaagttcgggcagtacctgctgacgctcccctacgtgaacaccaccgagctgtccaagacccgccgggagacgatcctgaagacccaccagatcctcacccgcagccagggcgggcggtccgagagcatgtccagcgccgaggtgggccagatcgccaaggagtgcgcgaacgccaagaacgtcggctgcatctccccgcgcttcgggatccccatcggcaacctgaccgcctgcgggaacagccccaactacaagatctacaagacgcccaacaagatctacaagagcaacaaccgcggcgaggtgtggtgctccgaggacgtgcactgcctggccgacttcgagccggccgacaccgaggtcgtgaacaaggtgaagaagatgacctgcttcctcagcgacgtcaacacccgggcggacatcttctccatcgccatcagcgcctgccgcatggtggacaagggcgtgtgcacggtcaacggggccaagtggaacatcctgaagtgcgagtccggcctgtactacttcaccgaccaccgggaggggcaggacaccggcaacgacttcggggagtactgcatcagccactcctgcaacaccgagcgctaccccatcaaccccgacatcctcaaggagtgcatctgggagtaccacagccggaagtccaagtacatcagcacgatcaacctggagtccctggaggagttcaagcgcgccatgagcgacaagctctcccacaccctgatggtgtacaacttcaagcccaccgcgaacctgccgcacatcaagcccagctacaagttcatcaccgccaacggcatcgagaactccgacggcctcgagagcgcctacatcctgtccagcatccccgccatcgggggcatgtccatcgggtacaacatccagacgaaggacaacttccccctgctcgacctgatcgtgttcgtcaagagcgcggtgatcaagaccacctacaaccacatctacgacaccggcccgaccatcgggatcaacacgaaccacgacgagcactgcaccggcccctgccccaccatcatcccccacaaggagaactggctgaccttcagccaggagcggacgtcccgctggggctgcgaggagttcgggtgcctcgccatcaacaccggctgcgtgttcgggagctgccaggacgtcatccacccggagaccaagatctaccggaaggccgtggaggaggaggtggtcctgaccgtgtgcatcaacttccccggcaacacgttctgcaccgagatcaacgccatcgagcccaagatcaccgacgagatcgagctgcagttcaagaccgtggacacgaagaccctcccgaacctgctggccgtccagaaccacaagctctactccgggcagatcaacgacctgggcagcttctcccagggctgcgggaacgtgcagaagaccaaccagagcatcctgggcgcggggaccgtgaagttcgactacgtctgccacggcgcctcccgcaaggacatcatcgtgcggcgctgctacacgaacaactacgacagctgcaagctcctgaaggaggagcggtccctgatcttcgccgacaaccacgagaccctcgaggtggccaacacccgccacctgatcggggagctgcagttcaagatcatgctcggcgacatccggtacaaggccttcgcggagaagcccgagctggagatcgacgccaagtgcgtcggctgccccagctgcttcgagtcctacagctgcaacttccagatcgtgacctccatcgacacggtgtgcagcgtcgaggggccctgcaccctgttccacaaccgcatcatcatcaccgccgccaagcagtcctacggcgtgaagatgagctgcaagaccaagccggggcccgtggaggagttcacgatctgcaaccggaactaccgcgtctccttcgccaccatcgacaagaacgacaagatcgagatcaacaccggcgaccagaccagctacatcgtggagaaggactcccggtgcaagacgtggctctgccgcgtgcgcgacgagggcatcagcgtcatcttcgagcccctgaaggcgttcttcgggagctacttctccatcgccttctacatcatcatcggcatcgccgccctgttcctcatcatctacatcttcctgcccatgttcttcaagctgcgggacgtgctcaagaagaacgagtacctgtacctgcaggagctcaagcacaagtga

SEQ ID NO: 12501 - RNA, 4302 nt, synthetic construct
  misc_feature 1..4302: note = derived and/or modified CDS sequence (opt1) from BUNV(GSA/S4/11232/WT)__KM507339.1__GP
  source 1..4302: mol_type = other RNA
atgcgcatcctgatcctcctgctggccgtgaccaagctcgccgtcggcagccccgtggtgacccggtgcttccacgggggccagctgatcgcggagcgcaagtcccagacgagcatctccgagttctgcatcaaggacgacgtcagcatgctgaagtccgagatcgtgtacaccaagaacgacaccgggatcttcggccacagcaaggtgttccggcactggaccatcacggactggaaggcctgcaacccggtcgtgaccgccgggggctccatcaacgtgatcgaggtcgacaagaacctcaacctggtgacccgcaactacgtgtgcaccggcgactgcacgatcaccgtcgacaaggagaacgcccagatcatcttccagaccgaccggctgaaccacttcgaggtgaccgggacgaccatcagcaccggctggttcaagtccaaggccagcgtgaccctcgaccgcacgtgcgagcacatcaaggtctcctgcgggaagaagaccctgcagttccacgcgtgcttcaagcagcacatgagctgcgtgcggttcctgcaccgctccatcctccccggcagcatggccatctccatctgccagaacatcgagctgatcatcatcaccatcctggccctctgcatcttcatcatcatgatcatcctgaccaagacgtacatctgctacgtgctgatccccgtcttcatgcccatcgccttcgcgtacgggtgggcctacaaccggagctgcaagaagtgcacgtgctgcggcctcgcctaccacccgttcaccaactgcggctcctactgcgtgtgcgggagcaagttcgagacctccgaccgcatgcggatgcaccgcgagagcggcctgtgccaggggttcaagagcctgcgggtggcccgccggctctgcaagtccaagggcagctccctgatcatcagcatcctgctctccgtcctgatcctgagcttcgtgacccccatcgagggcaccctcaccaactaccccaccgaccagaagtacacgctggacgagatcgccgacgtgctgcaggcgaagacccacgaggactccaccaagtactacatcatcctctacaccagcctgttcggggccggcctgacgatcatcttcgccggggtcgccctcggcctgaccatcatcctggaggtgctcaccaagatcaacgtcatcttctgcaacgagtgcaacatgtaccactccaagaagtccatcaagtacgtgggggacttcaccaacaagtgcggcttctgcacgtgcggcctgctggaggaccccgagggggtggtcgtgcacaaggccaagaagtcctgcacctacagctaccagatctcctgggtgaagggcatcatgatcttcgtcgcgttcctcttcgtgatccagaacaccatcatcatggtggccgccgaggaggactgctggaagaacgaggagctgaaggaggactgcgtcgggccgctgatcgcccccaaggactgcaccgacaaggaccgcaagacctacctcagcgaggcctccctgctggcgacggccaagaagatcacccaggtggacgccgagaacgtggagatcctcggcaagaccatggagagcgccatccgggtcatcgagcgccagaagacctaccaccggatgcacctcctggaggccgtgttcctcaacaagcactgcgactactacaagatgttcgagcacaactccgggtacagccaggtgaagtggcgcatgatgatcaagacgcagcacttcgacatctgcgcgctgcaggcctccagccccttctgcgcccagtgcatcgccgacaacagctgcgcgcagggctcctgggagttcgacacccacatgaacagcacctactccagcaaggtcgacaacttcaagcacgacttctccctgttcctgcggatcttcgaggccgccttccccggcaccgcctacgtgcacctcctgacgaacatcaaggagaagaagccgtaccaggccgtgagcatgatcgagaagatcaagaagaagttccccaacaacaagctgctcatcgggtacctggacttcggcaagtacctgctcgggctgtcccacgcgagcacctacgagctgcagcagtcccagctcgacaagctgtaccagcccaccgagctgacccgcagcggcgggcagcagacgtccctcgccagctccgtcgtgggccaggccaccaaggagtgcaagaagtacaaggacgtgagctgcctgagcccccgcttcggcatcccgctggaggacctcatcagctgcggggaccagcccaactacaacatctacaagaagcccaagaaggtctacaaggcccacaacaaggaggagacctggtgcatcaacgaccagcactgcctggtggacttcgtgcccgccgaggcggacaccgtcgagaagctgaagccgatgaagtgctggctcgtggaccccggcaagaacgacgacgtgtactccatcgccatcaagacgtgccgggtcatcgacaagggggtgtgcaccgtgaacagccagaagtggaacatcatcaagtgcgacagcgacctgctgtactactccgaccacgtccccggcgaggacaccggcaacgacatcgggcactactgcgtgagcgccggctgcaagaccgaccgctaccccatcaacccggacgtggtcacggactgcgtgtgggagttcacctcccggcgcagccagtacatcgggaagatctccatgcagagcctcgaggactacaagaaggccctgaccgaccggctgacccacacgctcgagacctactccttcgcgcccctggagaacctgccccacatcaagcccgtgtacaagtacatcaccgcccagggcgtcgagaacagcgacgggatcgagggcgccttcatcaccgcctccatcccggccgcgggcgggacgagcatcggctacaacgtgcgctccaaggacgggttccccctcctggacctgatcgtgttcgtcaagagcgccgtgatcaagtccacctacaaccacatctacgacaccggccccaccatcagcatcaacacgaagcacgacgagcactgcaccgggcagtgcccgtccaacatcgagcacgaggccaactggctcaccttcagccaggagcggacctcccgctggggctgcgaggagttcggctgcctggccgtgaacacggggtgcgtcttcggcagctgccaggacgtgatccggcccgagaccaaggtgtaccgcaaggccgtcgacgagatcgtgatcctgaccgtgtgcatcacctaccccgggcacaccttctgcacggagatcaacgcgatcgagcccaagatcaccgaggagatcgagctccagttcaagaccgtcgacaccaagacgctgccgtacatcgtggccgtgaacaaccacaagctgtactccggccagatcaacgacctcgggaccttcggccagatgtgcggcaacgtccagaagaccaacagcagcatcctggggaccggcacgcccaagttcgactacacgtgccacggggcctcccggaaggacatcatcgtgcgccggtgctacaacaacaacttcgacagctgcaagctgctcaaggaggagacccagctgatcttcaacgacgaccacgacaccatcaccgtctacaacaccaaccacctgatcggcgagctcgccatcaagctgatcctgggggacatccagtacaagctgttcaccgagaccctggacctgcagatcgacgccaagtgcgtgggctgccccgactgcttcgagtcctacagctgcaacttccagatcgtgtccaacatcgacacgatctgcaacctcgagggcccctgcgacaccttccacaaccgcatcagcatcaaggcgatgcagcagaactacgccgtcaagctgtcctgccagaaggacccggggcccagcggcaccttcaagatctgcaaccgggagtacaccgtggtgttccacacggtcgccaaggacgacaagatcgagatcaacgtgggggaccagacctccttcatcaaggagaaggacgaccgctgcaagacctggctgtgccgggtgcgcgacgagggcatcagcgtcatcttcgagcccatcaaggccttcttcggctcctacttcagcatcttcttctacatcatcatcatcgtggtggtcgggttcctcatcatctacatcttcatgcccatgttcatgaagctgaaggaggtgctgaaggccaacgagaagctctacctgcaggagatcaagcagaagtga

SEQ ID NO: 12502 - RNA, 4302 nt, synthetic construct
  misc_feature 1..4302: note = derived and/or modified CDS sequence (opt1) from BUNV(MGD/S1/12060/WT)__KM507340.1__GP
  source 1..4302: mol_type = other RNA
atgcgcatcctgatcctcctgctggccgtgaccaagctcgccgtcggcagccccgtggtgacccggtgcttccacgggggccagctgatcgcggagcgcaagtcccagacgagcatctccgagttctgcatcaaggacgacgtcagcatgctgaagtccgagatcgtgtacaccaagaacgacaccgggatcttcggccacagcaaggtgttccggcactggaccatcacggactggaaggcctgcaacccggtcgtgaccgccgggggctccatcaacgtgatcgaggtcgacaagaacctcaacctggtgacccgcaactacgtgtgcaccggcgactgcacgatcaccgtcgacaaggagaacgcccagatcatcttccagaccgaccggctgaaccacttcgaggtgaccgggacgaccatcagcaccggctggttcaagtccaaggccagcgtgaccctcgaccgcacgtgcgagcacatcaaggtctcctgcgggaagaagaccctgcagttccacgcgtgcttcaagcagcacatgagctgcgtgcggttcctgcaccgctccatcctccccggcagcatggccatctccatctgccagaacatcgagctgatcatcatcaccatcctggccctctgcatcttcatcatcatgatcatcctgaccaagacgtacatctgctacgtgctgatccccgtcttcatgcccatcgccttcgcgtacgggtgggcctacaaccggagctgcaagaagtgcacgtgctgcggcctcgcctaccacccgttcaccaactgcggctcctactgcgtgtgcgggagcaagttcgagacctccgaccgcatgcggatgcaccgcgagagcggcctgtgccaggggttcaagagcctgcgggtggcccgccggctctgcaagtccaagggcagctccctgatcatcagcatcctgctctccgtcctgatcctgagcttcgtgacccccatcgagggcaccctcaccaactaccccaccgaccagaagtacacgctggacgagatcgccgacgtgctgcaggcgaagacccacgaggactccaccaagtactacatcatcctctacaccagcctgttcggggccggcctgacgatcatcttcgccggggtcgccctcggcctgaccatcatcctggaggtgctcaccaagatcaacgtcatcttctgcaacgagtgcaacatgtaccactccaagaagtccatcaagtacgtgggggacttcaccaacaagtgcggcttctgcacgtgcggcctgctggaggaccccgagggggtggtcgtgcacaaggccaagaagtcctgcacctacagctaccagatctcctgggtgaagggcatcatgatcttcgtcgcgttcctcttcgtgatccagaacaccatcatcatggtggccgccgaggaggactgctgggagaacgaggagctgaaggaggactgcgtcgggccgctgatcgcccccaaggactgcaccgacaaggaccgcaagacctacctcagcgaggcctccctgctggcgacggccaagaagatcacccaggtggacgccgagaacgtggagatcctcggcaagaccatggagagcgccatccgggtcatcgagcgccagaagacctaccaccggatgcacctcctggaggccgtgttcctcaacaagcactgcgactactacaagatgttcgagcacaactccgggtacagccaggtgaagtggcgcatgatgatcaagacgcagcacttcgacatctgcgcgctgcaggcctccagccccttctgcgcccagtgcatcgccgacaacagctgcgcgcagggctcctgggagttcgacacccacatgaacagcacctactccagcaaggtcgacaacttcaagcacgacttctccctgttcctgcggatcttcgaggccgccttccccggcaccgcctacgtgcacctcctgacgaacatcaaggagaagaagccgtaccaggccgtgagcatgatcgagaagatcaagaagaagttccccaacaacaagctgctcatcgggtacctggacttcggcaagtacctgctcgggctgtcccacgcgagcacctacgagctgcagcagtcccagctcgacaagctgtaccagcccaccgagctgacccgcagcggcgggcagcagacgtccctcgccagctccgtcgtgggccaggccaccaaggagtgcaagaagtacaaggacgtgagctgcctgagcccccgcttcggcatcccgctggaggacctcatcagctgcggggaccagcccaactacaacatctacaagaagcccaagaaggtctacaaggcccacaacaaggaggagacctggtgcatcaacgaccagcactgcctggtggacttcgtgcccgccgaggcggacaccgtcgagaagctgaagccgatgaagtgctggctcgtggaccccggcaagaacgacgacgtgtactccatcgccatcaagacgtgccgggtcatcgacaagggggtgtgcaccgtgaacagccagaagtggaacatcatcaagtgcgacagcgacctgctgtactactccgaccacgtccccggcgaggacaccggcaacgacatcgggcactactgcgtgagcgccggctgcaagaccgaccgctaccccatcaacccggacgtggtcacggactgcgtgtgggagttcacctcccggcgcagccagtacatcgggaagatctccatgcagagcctcgaggactacaagaaggccctgaccgaccggctgacccacacgctcgagacctactccttcgcgcccctggagaacctgccccacatcaagcccgtgtacaagtacatcaccgcccagggcgtcgagaacagcgacgggatcgagggcgccttcatcaccgcctccatcccggccgcgggcgggacgagcatcggctacaacgtgcgctccaaggacgggttccccctcctggacctgatcgtgttcgtcaagagcgccgtgatcaagtccacctacaaccacatctacgacaccggccccaccatcagcatcaacacgaagcacgacgagcactgcaccgggcagtgcccgtccaacatcgagcacgaggccaactggctcaccttcagccaggagcggacctcccgctggggctgcgaggagttcggctgcctggccgtgaacacggggtgcgtcttcggcagctgccaggacgtgatccggcccgagaccaaggtgtaccgcaaggccgtcgacgagatcgtgatcctgaccgtgtgcatcacctaccccgggcacaccttctgcacggagatcaacgcgatcgagcccaagatcaccgaggagatcgagctccagttcaagaccgtcgacaccaagacgctgccgtacatcgtggccgtgaacaaccacaagctgtactccggccagatcaacgacctcgggaccttcggccagatgtgcggcaacgtccagaagaccaacagcagcatcctggggaccggcacgcccaagttcgactacacgtgccacggggcctcccggaaggacatcatcgtgcgccggtgctacaacaacaacttcgacagctgcaagctgctcaaggaggagacccagctgatcttcaacgacgaccacgacaccatcaccgtctacaacaccaaccacctgatcggcgagctcgccatcaagctgatcctgggggacatccagtacaagctgttcaccgagaccctggacctgcagatcgacgccaagtgcgtgggctgccccgactgcttcgagtcctacagctgcaacttccagatcgtgtccaacatcgacacgatctgcaacctcgagggcccctgcgacaccttccacaaccgcatcagcatcaaggcgatgcagcagaactacgccgtcaagctgtcctgccagaaggacccggggcccagcggcaccttcaagatctgcaaccgggagtacaccgtggtgttccacacggtcgccaaggacgacaagatcgagatcaacgtgggggaccagacctccttcatcaaggagaaggacgaccgctgcaagacctggctgtgccgggtgcgcgacgagggcatcagcgtcatcttcgagcccatcaaggccttcttcggctcctacttcagcatcttcttctacatcatcatcatcgtggtggtcgggttcctcatcatctacatcttcatgcccatgttcatgaagctgaaggaggtgctgaaggccaacgagaagctctacctgcaggagatcaagcagaagtga

SEQ ID NO: 12503 - RNA, 4308 nt, synthetic construct
  misc_feature 1..4308: note = derived and/or modified CDS sequence (opt1) from Ab-BUNV(Cu20-XJ)__KJ710423.1__GP
  source 1..4308: mol_type = other RNA
atggccatcagcatcgtgctgatgatcatcttctccaccaccagctgcctcgcccgcgcggccccctccatcagcaagtgcttccaggacggcgtcctgatcgccgagaagaagtccagctccgggatcagcgagttctgcatcaaggacgacatctccatcctcaagagcgagatcaactactccaagaacgacacgggcatcttcatgcacagcaaggtgttccggcactggaccgtggccgactggaagcagtgccagccgatcccctccgccgggggcagcatcaacgtcctcgaggtggacaagaacctgaacctggtggcgaagaactacatgtgcacccgcccctgcgtcatcaccatcgacaaggagaacgcccagctcctgttccagacggagcagctgaaccagttcgaggtgaccgggaccaccatctccacgggctggttcaagagcaagacctccgtgagcctcgacaacacgtgcgagcacatcaaggtgacctgcggcaagaagtccctgcagttccacgcctgcttcaagcagcacatgagctgcgtccggttcctgcaccgcagcgtgctccccgggtacatggccaactccatctgccagaacatcgagctgatcatcatcatcaccctgaccctcgcgatcttcatcttcatgtgcatcatcacccggacctacatctgctacatcatgctgccgctgttcgcccccatcgcctacatctacggctggctctacaaccgcagctgcaagaagtgcatctgctgcgggctggcctaccaccccttcacgaactgcggctcctactgcgtctgcgggagccggttcgagacctccgaccgcatgcggctgcaccgcgagagcggcctctgccagggcttcaagtccctgcgggtggcccgcaccctgtgcaagagcaaggggtccagcctcgtgatctccgtcctgaccgcgatgctgatcctcagcttcgtgacgcccctggaggccatctccaccaactacccgaccgaccggaagtacaccctgaacgaggtgaacgacatcgtcctcggcaaggggacggagaacgagctgaagaccagcatcctggccctcgtgtccatctgcggcatcggcatcatcatcatcttcatcgccctgaccatgctgctcgacatcgtgctggaggccatcgcgaagcgcagcaccatcttctgcacggagtgcaacctgatccacgacaagaaggccatgaagttcgtcggggacttcaccaacaagtgcggcttctgcccctgcggggagctcgaggaccccgagggcctggtgatccacaccacccggaagtcctgcacgtactacatcaagatccgcaacctgaagctcatcatgctggtgttcagcatcgccatcctgatgcagaacaccgccatgctcgtcgtggccgacgagaactgctggaccaacaccgagatcaaggcggactgcgtcgggcccctgatcggcccgacgacctgcaccaacaagggctccaagacctacaaggccgtggcccaggagctggtgaccagcaacaagatcacgcagctcgacgccgacaagtacaccctgctgggggacaccatcgagagcgccctgtccgcgatcaccgagcagaagcactacagcgccatccacctcctggagacgatcttcctgatgaagcactgcgactactacaaggtctacgagcacaactccggctacagccagaccaagtggcggctcatcgccaagaccaactccttcgacatctgcagcatcccctccacccccaacttctgcaagtgcctgagcgactccagctgctccacgagcaccctgaacttcgccacctccatgaacagcacctacacgtccaaggcggagtacttcaaccacgacttcaccctcttcctgaacatcttcgaggccgccttccccgggagcgccaccgccttcctgttcaagaagatcaaggagaaggcgccgtaccaggccttcgagatgatgggcaagatcgccaacaagtaccccaacaacaagctcctggtggtgctgctcaagtacgggcagtacatggtcggcctgtcccacgccagcacctaccagctgaagcaggagtggatcgccaagagcctctccctggtgcgcagcacgaagaccggcctgaagatggcgatgaccaacgccgagcccgggcccgccaccaaggagtgctccgacgccaagacgatcgcctgcctcaccccgaagttccaggtggaggtcaacaacctgatgagctgcggcgcgtcccccaacttcaagatctacatgaagtccggggagctgtacaaggcccacgaccggaacagcgtgtggtgcctcaacgacatgcactgcctgaccccctacacccccgccaacgccgagctggtggcgacgatgaagaagatggagtgctggcaggacaacccgaagcagcccaccaacgactacgccacgccccgccggagctgccagatgaaggaccgcggcctctgcaacgtcggggccgacaagtggaaggtgatcaagtgcgacgacgacctgatgttctacaccgacgccctggagtcccccgacccggccgcggacatcggccagtactgcttcagcgagaagtgccagatcgagcgctaccccatcaaccccacctccctcaccaactgcgagtggctgtaccgggccgtgaagccgcagtacatcaagcgcctgagcctccagaccatcgaggagtacaagaaggccatcaccgacaagctgacgcacaccctgcagctctaccacttcgcgcccctggagaacctgccccacatccggcccacctacgagtacatcaccgcccagggcacgtacaccgccgacgggatcgagggcgcctccatcatcaccagcatcccggccctctccgggaccagcgtcggcttcaagatcaacgccaaggacggcaccgccctgctggacatcgtggtgtacatcaagtccagcgtcgtgaagtccgtgtacaaccacatctacgacacggggcccaccatcaacatcaacagcaagcacgacgagctctgcaccggccagtgccccaagcgcatccccgcggacccgaactggctgaccttcagccaggagcggacgtcccgctgggggtgcgaggagttcggctgcctggccatcaacaccgggtgcgtctacggcagctgccaggacgtgatccggaccgagaccaaggtgtaccgcaaggccaacgaggagacggtcatgctcaccgtgtgcatcacctaccccggccacaccttctgcacggacgtgaacgccctggagcccaagatcaccgacgagctggagctccagttcaagaccatcgacatcaagtccctgcccaacctggtcgcgatcaccaaccacaagctctacacggggcagatcaacgacctgggcaccttcgggcagatgtgcggcaacgtgcagaagaccaacaccagcatcctgggggccggcacgccgaagttcgactacacgtgctactccgccagccggaaggacatcatcatccgccggtgctacaacaacaactacgactcctgccgcctcctgaagcaggagggcgacctgctgttcgacgacaaccacgagaccctgatcgtgtacaacaacaagcggctgaacggggagctcaccatgaagctgctgctcggcgacatccagtacaagctgtacaccgagaacatggagctggagctcgaggccaagtgcgtcgggtgcgtgggctgcttcgagagctaccagtgcaacctgcagatcacctccagcctggacgggaactgcgccatctccggcccctgcgagaccttccacgaccgcatccagatcaagaccacgaagaaggactacgcgctcaagctggcctgcaccaaggaccccggcgacaaggccaccttccgggtgtgcgggaaggactacgacttcaacttccacaccgtcgtgaagaacgacaagatcgaggtgaacgtcggcgacgagacgagctacatcaaggagaaggacgcccgctgcgggacctggctgtgccgggtgcgcgacgagggcctctccgtgatcttcgagcccctgaagaacttcttcgggaactacctgaacatgttcctctacatcctgggcggcgtcctgctcctgttcctgagcctctacatcatcatgccggtgtgcgcccggctgcgcgacgagctgaagaagaacgagaagctccaccagatggagatgaagaagcgctga

SEQ ID NO: 12504 - RNA, 4305 nt, synthetic construct
  misc_feature 1..4305: note = derived and/or modified CDS sequence (opt1) from ANADV(EIV-13128Kam)__KT313718.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacaccgacctgtccctcagcacgaagacctacgtgtgctcccgcgactgcaccatcaccgtggacaaggaggacgcccagatcatcttccagacggacaagctgaaccacttcgaggtcagcgggaccaccctgtccagcggctggttcaagaccaaggcctccgtgacgctcgaccggacctgcgagcacatcaaggtgacctgcggcaagaagaccctgcagttccacgcgtgcttcaagcaccacatgagctgcatccgcttcttccacaacacgatcctgcccgggaccatggccgtctccatctgccagaacatcgagctcatcatcatcaccagcctgaccctgatcatcttcatcctcatggtgatcctgacgaagacctacatctgctacgtgctgatgccgctgttcatgcccgtcgcctacctgtacggctgggcctacaaccggtcctgcaagaagtgcagctgctgcgggctggcgtaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcacgctgaccaactacccggagagcaagaagtactccctggaggagatcgccgacgtgatcgaggggttcatcgccgagaagggcatcaaggagtacatcgtcctctacaccagcatcttcggcgcgctgctgctcctgatcgccctgatcatcaccgtgtccctcaaccggatcacggagtacctgaccaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgccaacgacgactgctgggcgaagcagagcctcgagatcgagtgcgtcgggcccctgcagcaggtcgacgcctgcgaggacaagtccagccggtcctacaacggcgaggccaagaagctggtgggcaccagcaaggtgaccgagctcgacgccggccaggtgaacctgctggggcagacgatcgagagcgccatcatcgcgatccgcaagcagcggacctacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacgcaccacttctgccggtgcatgagcgacgggaccaagtgcgagaacggcaactgggacttcgccggcgagatgaacaccacctaccactccaagcgcgacttcttcaagcacgacttcaacctgttctgcacgctgctcgagaacgcgttccccgggaccaccgagagcctgtactaccagctgctctccaagcggaacaccacgggcgccagcaagctgctggggaagctcatcaccaagttcggcaacaacaacctgttcgtggggatctggaagttcggccagttcctgctctccctgccctacgtgaacaacaccgagctgagcgccctccagtccagcaagatcctggagtccccggagcccctgctccgcagcgcctccggccgccaggagagcctgagctccaccacgcccggggaggcgagcaaggagtgccggaacgccaagaagatctcctgcatcagcccccgcttcggcgtcccgatggagaacctgaccgcctgcggggagtcccccaactacaagatctacaagacccccacccggatctacaagagcaacaacaagggcgagatctggtgcgccggcgacgtgcactgcttccaggagttcacgcccgtgctccaggaggtcgtggacaagctgaagaagatgacctgcttcctgaccgagccggaggccgaggaggacgcgttctccatcgccatcgccatgtgcaagatcctcgacaagggggtgtgcaccatcaacagcgagcgctggaacatcatcaagtgcgactccggcctgatgtactacacggaccagcgggacgggcaggacaccggcaacgacttcggggagtactgcatcagccacaactgcaagaccgagcgcttccccatcaacccctccatcatcagcgactgcatctgggagtaccactcccgcaagagccggtacatctccaccctgaacctcgagagcctggaggagttcaagcgggccatctccgagaagctgagccacacgctcgtcgtgtaccagttcaagcccacctccaacctgccgcacatgaagcccgtgtacaagtacatcaccgcccagggcgtcgagaacagcgacggcatcgacagcgcgttcatcaccgcctccatgcccgccctgagcgggacgtccatcggctacaacgtgatgagcaaggacaacttccccctcttcgacatcatcatcttcatcaagtccgccgtgatcaagaccacctacaaccacatctacgacaccgggccgacgatcggcatcaacgtcatgcacgacgagcactgcaccgggcagtgccccatcgagatcccccacaaggagaactggctgaccttcagccaggagcgcacctcccggtggggctgcgaggagttcggctgcctggccatcaacaccgggtgcgtgttcggcagctgccaggacatcatccgcccggagacgaaggtgtaccggaaggcgatcgaggagtccgtcctcctgaccgtgtgcgtgacctaccccgggaacaccttctgcacggagatcaacgccatcgagcccaagatcaccgacgagctggagctccagttcaagaccgtcgacaccaagacgctgcccaacctgctcgccgtgcagaaccacaagctgtacagcggccagatcaacgacctggggtccttcgcccagggctgcggcaacatccagaagaccaacctcagcgtgatcgggaccggcaccgcgaagttcgactacatctgccacggggcctcccgcaaggacatcgtcgtgcggcgctgctacaacaacaactacgagagctgcaagctgctgaaggaggagccgtccctcatcttcagcgacaaccacgagacgatcgaggtggccaacatccggcacctcctgggcgagctccagttcaagctgatgctgggggacctccgctacaagtccttcgccgagaaccccgagctggagatcgaggccaagtgcgtcggctgccccagctgcttctccagctacagctgcaacttccggatctccagctccatcgacaccgtgtgcgcgatcgacggcccctgcaccatcttccacaaccgcctgatcatcagctccaccaagcaggactacgggatcaagatgagctgcaaggagaagccgaaccccgtggagaagttcaacatctgcaagcgcatctactccgtcctcttcacgaccatcgacaagagcgacaagatcgagatcaacaccggcgaccagacctccttcatccaggagaaggacgaccggtgcaagacgtggctgtgccgcgtgcgggacgaggggatcagcgtgatcttcgagcccatcaaggccttcttcggctcctacttcagcatcgccttctacgtcgtgatcggcatcatcgccctgttcatcaccatctacatcttcctccccatggtgttcaagctgaaggacatcctgaagaagaacgagctcctgtacctgcaggagatgaagtacaagtga

SEQ ID NO: 12505 - RNA, 4305 nt, synthetic construct
  misc_feature 1..4305: note = derived and/or modified CDS sequence (opt1) from ANADV(EIV-13130Kam)__KT313721.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaacctgttctgcaccctgctcgagaacgccttccccgggacgaccgagagcctgtactaccagctgctctccaagcggaacaccaccggcgccagcaagctgctggggaagctcatcacgaagttcggcaacaacaacctgttcgtggggatctggaagttcggccagttcctgctctccctgccctacgtgaacaacaccgagctgagcgccctccagtccagcaagatcctggagtccccggagcccctgctccgcagcgcgtccggccgccaggagagcctgagctccgccacccccggggaggccagcaaggagtgccggaacgccaagaagatctcctgcatcagcccccgcttcggcgtcccgatggagaacctgaccgcctgcggggagtcccccaactacaagatctacaagacgcccacccggatctacaagagcaacaacaagggcgagatctggtgcgcgggcgacgtgcactgcttccaggagttcacccccgtgctccaggaggtcgtggacaagctgaagaagatgacctgcttcctgacggagccggaggccgaggaggacgccttctccatcgccatcgccatgtgcaagatcctcgacaagggggtgtgcaccatcaacagcgagcgctggaacatcatcaagtgcgactccggcctgatgtactacaccgaccagcgggacgggcaggacaccggcaacgacttcggggagtactgcatcagccacaactgcaagacggagcgcttccccatcaacccctccatcatcagcgactgcatctgggagtaccactcccgcaagagccggtacatctccaccctgaacctcgagagcctggaggagttcaagcgggcgatctccgagaagctgagccacaccctcatcgtctaccagttcaagcccacctccaacctgccgcacatgaagcccgtgtacaagtacatcacggcccagggcgtggagaacagcgacggcatcgacagcgccttcatcaccgcctccatgcccgccctgagcgggacctccatcggctacaacgtcatgagcaaggacaacttccccctcttcgacatcatcatcttcatcaagtccgcggtgatcaagaccacgtacaaccacatctacgacaccgggccgaccatcggcatcaacgtgatgcacgacgagcactgcaccgggcagtgccccatcgagatcccccacaaggagaactggctgacgttcagccaggagcgcacctcccggtggggctgcgaggagttcggctgcctggccatcaacaccgggtgcgtcttcggcagctgccaggacatcatccgcccggagaccaaggtgtaccggaaggccatcgaggagtccgtgctcctgaccgtctgcgtgacgtaccccgggaacaccttctgcaccgagatcaacgccatcgagcccaagatcaccgacgagctggagctccagttcaagacggtggacaccaagaccctgcccaacctgctcgcggtccagaaccacaagctgtacagcggccagatcaacgacctggggtccttcgcccagggctgcggcaacatccagaagaccaacctcagcgtgatcgggacgggcaccgccaagttcgactacatctgccacggggcctcccgcaaggacatcgtggtccggcgctgctacaacaacaactacgagagctgcaagctgctgaaggaggagccgtccctcatcttcagcgacaaccacgagaccatcgaggtggccaacatccggcacctcctgggcgagctccagttcaagctgatgctgggggacctccgctacaagtccttcgcggagaaccccgagctggagatcgaggccaagtgcgtgggctgccccagctgcttctccagctacagctgcaacttccggatctccagctccatcgacaccgtctgcgccatcgacggcccctgcacgatcttccacaaccgcctgatcatcagctccaccaagcaggactacgggatcaagatgagctgcaaggagaagccgaaccccgtggagaagttcaacatctgcaagcgcgtgtactccgtcctcttcaccaccatcgacaagaacgacaagatcgagatcaacacgggcgaccagaccagcttcatccaggagaaggacgaccggtgcaagacctggctgtgccgcgtgcgggacgaggggatctccgtgatcttcgagcccatcaaggccttcttcggcagctacttctccatcgccttctacgtcgtgatcggcatcatcgcgctgttcatcaccatctacatcttcctccccatggtgttcaagctgaaggacatcctgaagaagaacgagctcctgtacctgcaggagatgaagtacaagtga

SEQ ID NO: 12506 - RNA, 4305 nt, synthetic construct
  misc_feature 1..4305: note = derived and/or modified CDS sequence (opt1) from ANADV(EIV-13395Mg)__KU159765.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaaccgcgacttcgcgggcgagatgaacaccacctaccactccaagcgggacttcttcaagcacgacttcaacctgttctgcaccctgctcgagaacgccttccccgggacgaccgagagcctgtactaccagctgctctccaagcgcaacaccaccggcgccagcaagctgctggggaagctcatcacgaagttcggcaacaacaacctgttcgtggggatctggaagttcggccagttcctgctctccctgccctacgtgaacaacaccgagctgagcgccctccagtccagcaagatcctggagtccccggagcccctgctccgcagcgcgtccggccggcaggagagcctgagctccgccacccccggggaggccagcaaggagtgccgcaacgccaagaagatctcctgcatcagcccccggttcggcgtcccgatggagaacctgaccgcctgcggggagtcccccaactacaagatctacaagacgcccacccgcatctacaagagcaacaacaagggcgagatctggtgcgcgggcgacgtgcactgcttccaggagttcacccccgtgctccaggaggtcgtggacaagctgaagaagatgacctgcttcctgacggagccggaggccgaggaggacgccttctccatcgccatcgccatgtgcaagatcctcgacaagggggtgtgcaccatcaacagcgagcggtggaacatcatcaagtgcgactccggcctgatgtactacaccgaccagcgcgacgggcaggacaccggcaacgacttcggggagtactgcatcagccacaactgcaagacggagcggttccccatcaacccctccatcatcagcgactgcatctgggagtaccactcccgcaagagccggtacatctccaccctgaacctcgagagcctggaggagttcaagcgcgcgatctccgagaagctgagccacaccctcgtcgtgtaccagttcaagcccacctccaacctgccgcacatgaagcccgtgtacaagtacatcacggcccagggcgtcgagaacagcgacggcatcgacagcgccttcatcaccgcctccatgcccgccctgagcgggacctccatcggctacaacgtgatgagcaaggacaacttccccctcttcgacatcatcatcttcatcaagtccgcggtgatcaagaccacgtacaaccacatctacgacaccgggccgaccatcggcatcaacgtcatgcacgacgagcactgcaccgggcagtgccccatcgagatcccccacaaggagaactggctgacgttcagccaggagcggacctcccgctggggctgcgaggagttcggctgcctggccatcaacaccgggtgcgtgttcggcagctgccaggacatcatccggccggagaccaaggtgtaccgcaaggccatcgaggagtccgtcctcctgaccgtgtgcgtgacgtaccccgggaacaccttctgcaccgagatcaacgccatcgagcccaagatcaccgacgagctggagctccagttcaagacggtcgacaccaagaccctgcccaacctgctcgcggtgcagaaccacaagctgtacagcggccagatcaacgacctggggtccttcgcccagggctgcggcaacatccagaagaccaacctcagcgtgatcgggacgggcaccgccaagttcgactacatctgccacggggcctcccggaaggacatcgtcgtgcgccggtgctacaacaacaactacgagagctgcaagctgctgaaggaggagccgtccctcatcttcagcgacaaccacgagaccatcgaggtggccaacatccgccacctcctgggcgagctccagttcaagctgatgctgggggacctccggtacaagtccttcgcggagaaccccgagctggagatcgaggccaagtgcgtcggctgccccagctgcttctccagctacagctgcaacttccgcatctccagctccatcgacaccgtgtgcgccatcgacggcccctgcacgatcttccacaaccgcctgatcatcagctccaccaagcaggactacgggatcaagatgagctgcaaggagaagccgaaccccgtggagaagttcaacatctgcaagcgggtctactccgtcctcttcaccaccatcgacaagaacgacaagatcgagatcaacacgggcgaccagaccagcttcatccaggagaaggacgaccgctgcaagacctggctgtgccgggtgcgcgacgaggggatctccgtgatcttcgagcccatcaaggccttcttcggcagctacttctccatcgccttctacgtggtgatcggcatcatcgcgctgttcatcaccatctacatcttcctccccatggtcttcaagctgaaggacatcctgaagaagaacgagctcctgtacctgcaggagatgaagtacaagtga

SEQ ID NO: 12507 - RNA, 4305 nt, synthetic construct
  misc_feature 1..4305: note = derived and/or modified CDS sequence (opt1) from ANADV(EIV-16002Mg)__KT313724.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacgtcggggacttcaccaacaagtgcggcttctgcacgtgcggggagctcgaggaccaggagggcctgaacatgcacaaggtgagcaagaagtgcatctaccgctaccagctgacctggtccaaggtcatcatgaccatcctcgtgtgcctgctgatcgcccagaacaccgtgctgatcgtcgccgcgaacgacgactgctgggccaagcagagcctcgagatcgagtgcgtggggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtcttcctggggcgccactgcgactactacaaggtgttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaagctgttctgcaccctgctcgagaacgccttccccgggacgaccgagagcctgtactaccagctgctctccaagcggaacaccaccggcgccagcaagctgctggggaagctcatcacgaagttcggcaacaacaacctgttcgtggggatctggaagttcggccagttcctgctctccctgccctacgtcaacaacaccgagctgagcgccctccagtccagcaagatcctggagtccccggagcccctgctccgcagcgcgtccggccgccaggagagcctgagctccgccacccccggggaggccagccgggagtgccgcaacgccaagaagatctcctgcatcagcccccggttcggcgtgccgatggagaacctgaccgcctgcggggagtcccccaactacaagatctacaagacgcccgcgcgcatctacaagagcaacaacaagggcgagatctggtgcgccggcgacgtgcactgcttccaggagttcacccccgtcctccaggaggtggtggacaagctgaagaagatgacctgcttcctgaccgagccggaggccgaggaggacgccttctccatcgccatcgcgatgtgcaagatcctcgacaagggggtctgcacgatcaacagcgagcggtggaacatcatcaagtgcgactccggcctgatgtactacaccgaccagcgcgacgggcaggacaccggcaacgacttcggggagtactgcatcagccacaactgcaagaccgagcggttccccatcaacccctccatcatcagcgactgcatctgggagtaccactcccgcaagagccggtacatctccacgctgaacctcgagagcctggaggagttcaagcgcgccatctccgagaagctgagccacaccctcgtggtgtaccagttcaagcccacctccaacctgccgcacatgaagcccgtctacaagtacatcaccgcccagggcgtggagaacagcgacggcatcgacagcgccttcatcacggcctccatgcccgcgctgagcgggacctccatcggctacaacgtgatgagcaaggacaacttccccctcttcgacatcatcatcttcatcaagtccgccgtcatcaagaccacctacaaccacatctacgacacggggccgaccatcggcatcaacgtgatgcacgacgagcactgcaccgggcagtgccccatcgagatcccccacaaggagaactggctgaccttcagccaggagcggacgtcccgctggggctgcgaggagttcggctgcctggccatcaacaccgggtgcgtgttcggcagctgccaggacatcatccggccggagaccaaggtctaccgcaaggccatcgaggagtccgtgctcctgaccgtgtgcgtcacctaccccgggaacacgttctgcaccgagatcaacgcgatcgagcccaagatcaccgacgagctggagctccagttcaagaccgtggacacgaagaccctgcccaacctgctcgccgtgcagaaccacaagctgtacagcggccagatcaacgacctggggtccttcgcccagggctgcggcaacatccagaagaccaacctcagcgtcatcgggaccggcacggccaagttcgactacatctgccacggggcctcccggaaggacatcgtggtgcgccggtgctacaacaacaactacgagagctgcaagctgctgaaggaggagccgtccctcatcttcagcgacaaccacgagaccatcgaggtcgcgaacatccgccacctcctgggcgagctccagttcaagctgatgctgggggacctccggtacaagtccttcgccgagaaccccgagctggagatcgaggccaagtgcgtgggctgccccagctgcttctccagctacagctgcaacttccgcatctccagctccatcgacaccgtgtgcgccatcgacggcccctgcaccgtcttccacaaccgcctgatcatcagctccacgaagcaggactacgggatcaagatgagctgcaaggagaagccgaaccccgtggagaagttcaacatctgcaagcgggtgtactccgtcctcttcaccaccatcgacaagaacgacaagatcgagatcaacaccggcgaccagacgagcttcatccaggagaaggacgaccgctgcaagacctggctgtgccgggtgcgcgacgaggggatctccgtgatcttcgagcccatcaaggccttcttcggcagctacttctccatcgcgttctacgtcgtgatcggcatcatcgccctgttcatcaccatctacatcttcctccccatggtgttcaagctgaaggacatcctgaagaagaacgagctcctgtacctgcaggagatgaagtacaagtga

SEQ ID NO: 12508 - RNA, 4305 nt, synthetic construct
  misc_feature 1..4305: note = derived and/or modified CDS sequence (opt1) from ANADV(EIV-16199Mg)__KT313730.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacgaggaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctgggccgccactgcgactactacaaggtcttcgagcacaacagcgggtactcccaggccaagtggcggctgctcgccaagaccaaccacttcgacatctgcagccgccactccacccaccacttctgccggtgcatgagcgacggcacgaagtgcgagaacgggaactgggacttcgcgggcgagatgaacaccacctaccactccaagcgcgacttcttcaagcacgacttcaacctgttctgcaccctgctcgagaacgccttccccggcacgaccgagagcctgtactaccagctgctctccaagcggaacaccaccggggccagcaagctgctgggcaagctcatcacgaagttcgggaacaacaacctgttcgtgggcatctggaagttcgggcagttcctgctctccctgccctacgtgaacaacaccgagctgagcgccctccagtccagcaagatcctggagtccccggagcccctgctccgcagcgcgtccggccgccaggagagcctgagctccgccacccccggcgaggccagcaaggagtgccggaacgccaagaagatctcctgcatcagcccccgcttcggggtcccgatggagaacctgaccgcctgcggcgagtcccccaactacaagatctacaagacgcccacccggatctacaagagcaacaacaagggggagatctggtgcgcgggcgacgtgcactgcttccaggagttcacccccgtgctccaggaggtcgtggacaagctgaagaagatgacctgcttcctgacggagccggaggccgaggaggacgccttctccatcgccatcgccatgtgcaagatcctcgacaagggcgtgtgcaccatcaacagcgagcgctggaacatcatcaagtgcgactccgggctgatgtactacaccgaccagcgggacggccaggacaccgggaacgacttcggcgagtactgcatcagccacaactgcaagacggagcgcttccccatcaacccctccatcatcagcgactgcatctgggagtaccactcccgcaagagccggtacatctccaccctgaacctcgagagcctggaggagttcaagcgggcgatctccgagaagctgagccacaccctcatcgtctaccagttcaagcccacctccaacctgccgcacatgaagcccgtgtacaagtacatcacggcccagggggtggagaacagcgacggcatcgacagcgccttcatcaccgcctccatgcccgccctgagcggcacctccatcgggtacaacgtcatgagcaaggacaacttccccctcttcgacatcatcatcttcatcaagtccgcggtgatcaagaccacgtacaaccacatctacgacaccggcccgaccatcgggatcaacgtgatgcacgacgagcactgcaccggccagtgccccatcgagatcccccacaaggagaactggctgacgttcagccaggagcgcacctcccggtgggggtgcgaggagttcggctgcctggccatcaacaccggctgcgtcttcgggagctgccaggacatcatccgcccggagaccaaggtgtaccggaaggccatcgaggagtccgtgctcctgaccgtctgcgtgacgtaccccggcaacaccttctgcaccgagatcaacgccatcgagcccaagatcaccgacgagctggagctccagttcaagacggtggacaccaagaccctgcccaacctgctcgcggtccagaaccacaagctgtacagcgggcagatcaacgacctgggctccttcgcccaggggtgcggcaacatccagaagaccaacctcagcgtgatcggcacggggaccgccaagttcgactacatctgccacggcgcctcccgcaaggacatcgtggtccggcgctgctacaacaacaactacgagagctgcaagctgctgaaggaggagccgtccctcatcttcagcgacaaccacgagaccatcgaggtggccaacatccggcacctcctgggggagctccagttcaagctgatgctgggcgacctccgctacaagtccttcgcggagaaccccgagctggagatcgaggcccggtgcgtggggtgccccagctgcttctccagctacagctgcaacttccgcatctccagctccatcgacaccgtctgcgccatcgacggcccctgcacgatcttccacaaccgcctgatcatcagctccaccaagcaggactacggcatcaagatgagctgcaaggagaagccgaaccccgtggagaagttcaacatctgcaagcgggtgtactccgtcctcttcaccaccatcgacaagaacgacaagatcgagatcaacacgggggaccagaccagcttcatccaggagaaggacgaccgctgcaagacctggctgtgccgggtgcgcgacgagggcatctccgtgatcttcgagcccatcaaggccttcttcgggagctacttctccatcgccttctacgtcgtgatcggcatcatcgcgctgttcatcatcatctacatcttcctccccatggtgttcaagctgaaggacatcctgaagaagaacgagctcctgtacctgcaggagatgaagtacaagtga

SEQ ID NO: 12509 - RNA, 4305 nt, synthetic construct
  misc_feature 1..4305: note = derived and/or modified CDS sequence (opt1) from ANADV(EIV-16208Mg)__KT313733.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgccgcaagtgcagctgctgcgggctggcctaccaccccttcaccaactgcggctcccactgcgtgtgcgggctcaagttcgaggccagcgaccggatgcgcatccaccgggagagcggcctgtgccagggctacaagtccctgcgcgtggcccggctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccgcatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccggtaccagctgacctggtccaaggtgatcatgaccatcctcatctgcctgctgatcgcccagaacgccgtcctgatcgtggcggccaacgacgactgctgggccaagcagagcctcgagatcgagtgcgtggggcccctgcagcaggtcgacgcctgcgaggacaagtccagccgctcctacaacggcgaggccaagaagctggtgggcaccagcaaggtgaccgagctcgacgcggggcaggtcaacctgctgggccagaccatcgagagcgccatcatcgccatccggaagcagcgcacctacgccacgatgcacttcctcgagtccgtgttcctggggcggcactgcgactactacaaggtgttcgagcacaacagcggctactcccaggccaagtggcgcctgctcgcgaagaccaaccacttcgacatctgcagccggcactccacccaccacttctgccgctgcatgagcgacgggaccaagtgcgagaacggcaactgggacttcgccggcgagatgaacacgacctaccactccaagcgggacttcttcaagcacgacttcaagctgttctgcaccctgctcgagaacgccttccccgggaccacggagagcctgtactaccagctgctctccaagcgcaacaccaccggcgccagcaagctgctggggaagctcatcaccaagttcggcaacaacaacctgttcgtcgggatctggaagttcggccagttcctgctctccctgccctacgtgaacaacacggagctgagcgcgctccagtccagcaagatcctggagtccccggagcccctgctccgcagcgcctccggccggcaggagagcctgagctccgccacccccggggaggccagcaaggagtgccgcaacgccaagaagatctcctgcatcagcccccggttcggcgtgccgatggagaacctgaccgcgtgcggggagtcccccaactacaagatctacaagacccccacgcgcatctacaagagcaacaacaagggcgagatctggtgcgccggcgacgtccactgcttccaggagttcacccccgtgctccaggaggtggtcgacaagctgaagaagatgacctgcttcctgaccgagccggaggccgaggaggacgccttctccatcgccatcgcgatgtgcaagatcctcgacaagggggtgtgcacgatcaacagcgagcggtggaacatcatcaagtgcgactccggcctgatgtactacaccgaccagcgcgacgggcaggacaccggcaacgacttcggggagtactgcatcagccacaactgcaagaccgagcggttccccatcaacccctccatcatcagcgactgcatctgggagtaccactcccgcaagagcaagtacatctccacgctgaacctcgagagcctggaggagttcaagcgggccatctccgagaagctgagccacaccctcgtggtctaccagttcaagcccacctccaacctgccgcacatgaagcccgtgtacaagtacatcaccgcccagggcgtggagaacagcgacggcatcgacagcgccttcatcacggcctccatgcccgcgctgagcgggacctccatcggctacaacgtcatgagcaaggacaacttccccctcttcgacatcatcatcttcatcaagtccgccgtgatcaagaccacctacaaccacatctacgacacggggccgaccatcggcatcaacgtgatgcacgacgagcactgcaccgggcagtgccccatcgagatcccccacaaggagaactggctgaccttcagccaggagcgcacgtcccggtggggctgcgaggagttcggctgcctggccatcaacaccgggtgcgtcttcggcagctgccaggacatcatccgcccggagaccaaggtgtaccggaaggccatcgaggagtccgtgctcctgaccgtctgcgtgacctaccccgggaacacgttctgcaccgagatcaacgcgatcgagcccaagatcaccgacgagctggagctccagttcaagaccgtggacacgaagaccctgcccaacctgctcgccgtccagaaccacaagctgtacagcggccagatcaacgacctggggtccttcgcccagggctgcggcaacatccagaagaccaacctcagcgtgatcgggaccggcacggccaagttcgactacatctgccacggggcctcccgcaaggacatcatcgtgcggcgctgctacaacaacaactacgagagctgcaagctgctgaaggaggagccgtccctcatcttcagcgacaaccacgagaccatcgaggtcgcgaacatccggcacctcctgggcgagctccagttcaagctgatgctgggggacctccgctacaagtccttcgccgagaaccccgagctggagatcgaggccaagtgcgtgggctgccccagctgcttctccagctacagctgcaacttccggatctccagctccatcgacaccgtgtgcgccatcgacggcccctgcaccatcttccacaaccgcctgatcatcagctccacgaagcaggactacgggatcaagatgagctgcaaggagaagccgaactccgtcgagaagttcaacatctgcaagcgcgtgtacagcgtcctcttcaccaccatcgacaagaacgacaagatcgagatcaacaccggcgaccagacgtccttcatccaggagaaggacgaccggtgcaagacctggctgtgccgcgtgcgggacgaggggatcagcgtgatcttcgagcccatcaaggccttcttcggctcctacttcagcatcgcgttctacgtggtcatcggcatcatcgccctgttcatcatcatctacatcttcctccccatggtgttcaagctgaaggacatcctgaagaagaacgagctcctgtacctgcaggagatgaagtacaagtga

SEQ ID NO: 12510 - RNA, 4305 nt, synthetic construct
  misc_feature 1..4305: note = derived and/or modified CDS sequence (opt1) from ANADV(EIV-16356Mg)__KT313736.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgcccctcttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaagctgttctgcaccctgctcgagaacgccttccccgggacgaccgagagcctgtactaccagctgctctccaagcggaacaccaccggcgccagcaagctgctggggaagctcatcacgaagttcggcaacaacaacctgttcgtggggatctggaagttcggccagttcctgctctccctgccctacgtgaacaacaccgagctgagcgccctccagtccagcaagatcctggagtccccggagcccctgctccgcagcgcgtccggccgccaggagagcctgagctccgccacccccggggaggccagcaaggagtgccggaacgccaagaagatctcctgcatcagcccccgcttcggcgtcccgatggagaacctgaccgcctgcggggagtcccccaactacaagatctacaagacgcccacccggatctacaagagcaacaacaagggcgagatctggtgcgcgggcgacgtgcactgcttccaggagttcaccccgctcctgcaggaggtggtcgacaagctgaagaagatgacctgcttcctcacggagccggaggccgaggaggacgccttctccatcgccatcgccatgtgcaagatcctggacaagggggtgtgcaccatcaacagcgagcgctggaacatcatcaagtgcgactccggcctgatgtactacaccgaccagcgggacgggcaggacaccggcaacgacttcggggagtactgcatcagccacaactgcaagacggagcgcttccccatcaacccctccatcatcagcgactgcatctgggagtaccactcccgcaagagccggtacatctccaccctcaacctggagagcctggaggagttcaagcgggcgatctccgagaagctcagccacaccctggtggtctaccagttcaagcccacctccaacctgccgcacatgaagcccgtgtacaagtacatcacggcccagggcgtggagaacagcgacggcatcgacagcgccttcatcaccgcctccatgcccgccctcagcgggacctccatcggctacaacgtcatgagcaaggacaacttccccctgttcgacatcatcatcttcatcaagtccgcggtgatcaagaccacgtacaaccacatctacgacaccgggccgaccatcggcatcaacgtgatgcacgacgagcactgcaccgggcagtgccccatcgagatcccccacaaggagaactggctgacgttcagccaggagcgcacctcccggtggggctgcgaggagttcggctgcctcgccatcaacaccgggtgcgtcttcggcagctgccaggacatcatccgcccggagaccaaggtgtaccggaaggccatcgaggagtccgtgctgctgaccgtctgcgtgacgtaccccgggaacaccttctgcaccgagatcaacgccatcgagcccaagatcaccgacgagctcgagctgcagttcaagacggtggacaccaagaccctgcccaacctcctggcggtccagaaccacaagctgtacagcggccagatcaacgacctcgggtccttcgcccagggctgcggcaacatccagaagaccaacctgagcgtgatcgggacgggcaccgccaagttcgactacatctgccacggggcctcccgcaaggacatcgtggtccggcgctgctacaacaacaactacgagagctgcaagctgctcaaggaggagccgtccctgatcttcagcgacaaccacgagaccatcgaggtggccaacatccggcacctcctcggcgagctgcagttcaagctgatgctcggggacctgcgctacaagtccttcgcggagaaccccgagctggagatcgaggccaagtgcgtgggctgccccagctgcttctccagctacagctgcaacttccggatctccagctccatcgacaccgtctgcgccatcgacggcccctgcacgatcttccacaaccgcctcatcatcagctccaccaagcaggactacgggatcaagatgagctgcaaggagaagccgaaccccgtggagaagttcaacatctgcaagcgcgtgtactccgtcctgttcaccaccatcgacaagaacgacaagatcgagatcaacacgggcgaccagaccagcttcatccaggagaaggacgaccggtgcaagacctggctgtgccgcgtgcgggacgaggggatctccgtgatcttcgagcccatcaaggccttcttcggcagctacttctccatcgccttctacgtcgtgatcggcatcatcgcgctgttcatcaccatctacatcttcctgcccatggtgttcaagctgaaggacatcctcaagaagaacgagctgctgtacctccaggagatgaagtacaagtga

SEQ ID NO: 12511 - RNA, 4305 nt, synthetic construct
  misc_feature 1..4305: note = derived and/or modified CDS sequence (opt1) from ANADV(EIV-17769Yak)__KT313739.1__GP
  source 1..4305: mol_type = other RNA
atgttcctgatcctcgtgctgctgatccccttctacatcaccgccaccccggtcgccacgcgctgcttccacggcgggcagctcatcgcggagagcaagtccctgaccgccatcagcgagttctgcctgaaggacgacgtgtccaccgtcaagagcgagatcacctacctcaagaacgacacgggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacctacgtgtgctcccgcgactgcacgatcaccgtggacaaggaggacgcgcagatcatcttccagaccgacaacctgaaccacttcgaggtcagcgggaccacgctgtccagcggctggttcaagaccaaggcctccgtgaccctcgaccggacctgcgagcacatcaaggtgacgtgcggcaagaagaccctgcagttccacgcctgcttcaagcaccacatgagctgcatccgcttcttccacaacaccatcctgcccgggaccatggccgtctccatctgccagaacatcgagctcatcatcatcacgagcctgaccctgatcatcttcatcctcatggtgatcctgaccaagacctacatctgctacgtgctgatgccgctgttcatgcccgtcgcgtacctgtacggctgggcctacaaccggtcctgcaagaagtgcagctgctgcgggctggcctaccaccccttcacgaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgaccaactacccggagagcaagaagtactccctggaggagatcgcggacgtgatcgaggggttcatcgccgagaagggcatcaaggagtacatcgtcctctacacgagcatcttcggcgccctgctgctcctgatcgccctgatcatcaccgtgtccctcaaccggatcaccgagtacctgaccaacctgaacgtgatctactgccacgagtgcagcatgtaccactccaagaagaacatcaagtacgtcggggacttcacgaacaagtgcggcttctgcacgtgcggggagctcgaggaccaggagggcctgaacatgcacaaggtgagcaagaagtgcatctaccgctaccagctgacctggtccaaggtcatcatgaccatcctcgtgtgcctgctgatcgcccagaacaccgtgctgatcgtcgcggccaacgacgactgctgggccaagcagagcctcgagatcgagtgcgtggggcccctgcagcaggtcgacgcctgcgaggacaagtccagccggtcctacaacggcgaggccaagaagctggtgggcaccagcaaggtgaccgagctcgacgcgggccaggtgaacctgctggggcagaccatcgagagcgccatcatcgccatccgcaagcagcggacctacgccacgatgcacttcctcgagtccgtcttcctggggcgccactgcgactactacaaggtgttcgagcacaacagcggctactcccaggccaagtggcggctgctcgcgaagaccaaccacttcgacatctgcagccgccactccacccaccacttctgccggtgcatgagcgacgggaccaagtgcgagaacggcaaccgcgacttcgccggcgagatgaacacgacctaccactccaagcgggacttcttcaagcacgacttcaacctgttctgcaccctgctcgagaacgccttccccgggaccacggagagcctgtactaccagctgctctccaagcgcaacaccaccggcgccagcaagctgctggggaagctcatcaccaagttcggcaacaacaacctgttcgtggggatctggaagttcggccagttcctgctctccctgccctacgtcaacaacacggagctgagcgcgctccagtccagcaagatcctggagtccccggagcccctgctccgcagcgcctccggccggcaggagagcctgagctccgccacccccggggaggccagccgcgagtgccggaacgccaagaagatctcctgcatcagcccccgcttcggcgtgccgatggagaacctgaccgcgtgcggggagtcccccaactacaagatctacaagacccccacgcggatctacaagagcaacaacaagggcgagatctggtgcgccggcgacgtgcactgcttccaggagttcacccccgtcctccaggaggtggtggacaagctgaagaagatgacctgcttcctgaccgagccggaggccgaggaggacgccttctccatcgccatcgcgatgtgcaagatcctcgacaagggggtctgcacgatcaacagcgagcgctggaacatcatcaagtgcgactccggcctgatgtactacaccgaccagcgggacgggcaggacaccggcaacgacttcggggagtactgcatcagccacaactgcaagaccgagcgcttccccatcaacccctccatcatcagcgactgcatctgggagtaccactcccgcaagagccggtacatctccacgctgaacctcgagagcctggaggagttcaagcgggccatctccgagaagctgagccacaccctcgtggtgtaccagttcaagcccacctccaacctgccgcacatgaagcccgtctacaagtacatcaccgcccagggcgtggagaacagcgacggcatcgacagcgccttcatcacggcctccatgcccgcgctgagcgggacctccatcggctacaacgtgatgagcaaggacaacttccccctcttcgacatcatcatcttcatcaagtccgccgtcatcaagaccacctacaaccacatctacgacacggggccgaccatcggcatcaacgtgatgcacgacgagcactgcaccgggcagtgccccatcgagatcccccacaaggagaactggctgaccttcagccaggagcgcacgtcccggtggggctgcgaggagttcggctgcctggccatcaacaccgggtgcgtgttcggcagctgccaggacatcatccgcccggagaccaaggtctaccggaaggccatcgaggagtccgtgctcctgaccgtgtgcgtcacctaccccgggaacacgttctgcaccgagatcaacgcgatcgagcccaagatcaccgacgagctggagctccagttcaagaccgtggacacgaagaccctgcccaacctgctcgccgtgcagaaccacaagctgtacagcggccagatcaacgacctggggtccttcgcccagggctgcggcaacatccagaagaccaacctcagcgtcatcgggaccggcacggccaagttcgactacatctgccacggggcctcccgcaaggacatcgtggtgcggcgctgctacaacaacaactacgagagctgcaagctgctgaaggaggagccgtccctcatcttcagcgacaaccacgagaccatcgaggtcgcgaacatccggcacctcctgggcgagctccagttcaagctgatgctgggggacctccgctacaagtccttcgccgagaaccccgagctggagatcgaggccaagtgcgtgggctgccccagctgcttctccagctacagctgcaacttccgcatctccagctccatcgacaccgtgtgcgccatcgacggcccctgcaccatcttccacaaccggctgatcatcagctccacgaagcaggactacgggatcaagatgagctgcaaggagaagccgaaccccgtcgagaagttcaacatctgcaagcgcgtgtactccgtcctcttcaccaccatcgacaagaacgacaagatcgagatcgacaccggcgaccagacgagcttcatccaggagaaggacgaccggtgcaagacctggctgtgccgcgtgcgggacgaggggatctccgtgatcttcgagcccatcaaggccttcttcggcagctacttctccatcgcgttctacgtggtcatcggcatcatcgccctgttcatcaccatctacatcttcctccccatggtgttcaagctgaaggacatcctgaagaagaacgagctcctgtacctgcaggagatgaagtacaagtga

SEQ ID NO: 12512 - RNA, 4305 nt, synthetic construct
  misc_feature 1..4305: note = derived and/or modified CDS sequence (opt1) from ANADV(EIV-18098Yak)__KT313742.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacgtcggggacttcaccaacaagtgcggcttctgcacgtgcggggagctcgaggaccaggagggcctgaacatgcacaaggtgagcaagaagtgcatctaccgctaccagctgacctggtccaaggtcatcatgaccatcctcgtgtgcctgctgatcgcccagaacaccgtgctgatcgtcgccgcgaacgacgactgctgggccaagcagagcctcgagatcgagtgcgtggggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtcttcctggggcgccactgcgactactacaaggtgttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaacctgttctgcaccctgctcgagaacgccttccccgggacgaccgagagcctgtactaccagctgctctccaagcggaacaccaccggcgccagcaagctgctggggaagctcatcacgaagttcggcaacaacaacctgttcgtggggatctggaagttcggccagttcctgctctccctgccctacgtcaacaacaccgagctgagcgccctccagtccagcaagatcctggagtccccggagcccctgctccgcagcgcgtccggccgccaggagagcctgagctccgccacccccggggaggccagccgggagtgccgcaacgccaagaagatctcctgcatcagcccccggttcggcgtgccgatggagaacctgaccgcctgcggggagtcccccaactacaagatctacaagacgcccgcgcgcatctacaagagcaacaacaagggcgagatctggtgcgccggcgacgtgcactgcttccaggagttcacccccgtcctccaggaggtggtggacaagctgaagaagatgacctgcttcctgaccgagccggaggccgaggaggacgccttctccatcgccatcgcgatgtgcaagatcctcgacaagggggtctgcacgatcaacagcgagcggtggaacatcatcaagtgcgactccggcctgatgtactacaccgaccagcgcgacgggcaggacaccggcaacgacttcggggagtactgcatcagccacaactgcaagaccgagcggttccccatcaacccctccatcatcagcgactgcatctgggagtaccactcccgcaagagccggtacatctccacgctgaacctcgagagcctggaggagttcaagcgcgccatctccgagaagctgagccacaccctcgtggtgtaccagttcaagcccacctccaacctgccgcacatgaagcccgtctacaagtacatcaccgcccagggcgtggagaacagcgacggcatcgacagcgccttcatcacggcctccatgcccgcgctgagcgggacctccatcggctacaacgtgatgagcaaggacaacttccccctcttcgacatcatcatcttcatcaagtccgccgtcatcaagaccacctacaaccacatctacgacacggggccgaccatcggcatcaacgtgatgcacgacgagcactgcaccgggcagtgccccatcgagatcccccacaaggagaactggctgaccttcagccaggagcggacgtcccgctggggctgcgaggagttcggctgcctggccatcaacaccgggtgcgtgttcggcagctgccaggacatcatccggccggagaccaaggtctaccgcaaggccatcgaggagtccgtgctcctgaccgtgtgcgtcacctaccccgggaacacgttctgcaccgagatcaacgcgatcgagcccaagatcaccgacgagctggagctccagttcaagaccgtggacacgaagaccctgcccaacctgctcgccgtgcagaaccacaagctgtacagcggccagatcaacgacctggggtccttcgcccagggctgcggcaacatccagaagaccaacctcagcgtcatcgggaccggcacggccaagttcgactacatctgccacggggcctcccggaaggacatcgtggtgcgccggtgctacaacaacaactacgagagctgcaagctgctgaaggaggagccgtccctcatcttcagcgacaaccacgagaccatcgaggtcgcgaacatccgccacctcctgggcgagctccagttcaagctgatgctgggggacctccggtacaagtccttcgccgagaaccccgagctggagatcgaggccaagtgcgtgggctgccccagctgcttctccagctacagctgcaacttccgcatctccagctccatcgacaccgtgtgcgccatcgacggcccctgcaccgtcttccacaaccgcctgatcatcagctccacgaagcaggactacgggatcaagatgagctgcaaggagaagccgaaccccgtggagaagttcaacatctgcaagcgggtgtactccgtcctcttcaccaccatcgacaagaacgacaagatcgagatcaacaccggcgaccagacgagcttcatccaggagaaggacgaccgctgcaagacctggctgtgccgggtgcgcgacgaggggatctccgtgatcttcgagcccatcaaggccttcttcggcagctacttctccatcgcgttctacgtcgtgatcggcatcatcgccctgttcatcaccatctacatcttcctccccatggtgttcaagctgaaggacatcctgaagaagaacgagctcctgtacctgcaggagatgaagtacaagtga

SEQ ID NO: 12513 - RNA, 4305 nt, synthetic construct
  misc_feature 1..4305: note = derived and/or modified CDS sequence (opt1) from ANADV(EIV-18136Yak)__KT313745.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagaagggcatcaaggagtacatcgtcctctacaccagcatcttcggcgccctgctgctcctgatcgccctgatcatcaccgtgtccctcaaccggatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacggcgaggccaagaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaagctgttctgcaccctgctcgagaacgccttccccgggacgaccgagagcctgtactaccagctgctctccaagcggaacaccaccggcgccagcaagctgctggggaagctcatcacgaagttcggcaacaacaacctgttcgtggggatctggaagttcggccagttcctgctctccctgccctacgtgaacaacaccgagctgagcgccctccagtccagcaagatcctggagtccccggagcccctgctccgcagcgcgtccggccgccaggagagcctgagctccgccacccccggggaggccagcaaggagtgccggaacgccaagaagatctcctgcatcagcccccgcttcggcgtcccgatggagaacctgaccgcctgcggggagtcccccaactacaagatctacaagacgcccacccggatctacaagagcaacaacaagggcgagatctggtgcgtgggcgacgtgcactgcttccaggagttcacccccgtcctccaggaggtggtggacaagctgaagaagatgacctgcttcctgacggagccggaggcggaggaggacgccttctccatcgccatcgccatgtgcaagatcctcgacaagggggtctgcaccatcaacagcgagcgctggaacatcatgaagtgcgactccggcctgatgtactacaccgaccagcgggacgggcaggacaccggcaacgacttcggggagtactgcatcagccacaactgcaagacggagcgcttccccatcaacccctccatcatcagcgactgcatctgggagtaccactcccgcaagagccggtacatcggcaccctgaacctcgagtccctggaggagttcaagcgggccatcagcgagaagctgtcccacaccctcgtggtgtaccagttcaagcccaccagcaacctgccgcacatgaagcccgtctacaagtacatcacggcgcagggcgtggagaactccgacgggatcgacagcgccttcatcaccgccagcatgcccgccctgtccggcaccagcatcgggtacaacgtgatgtccaaggacaacttccccctcttcgacatcatcatcttcatcaagagcgccgtcatcaagaccacgtacaaccacatctacgacaccggcccgaccatcgggatcaacgtgatgcacgacgagcactgcaccggccagtgccccatcgagatcccccacaaggagaactggctgacgttctcccaggagcgcaccagccggtggggctgcgaggagttcgggtgcctggcgatcaacaccggctgcgtgttcgggtcctgccaggacatcatccgcccggagaccaaggtctaccggaaggccatcgaggagagcgtgctcctgaccgtgtgcgtcacgtaccccggcaacaccttctgcaccgagatcaacgccatcgagcccaagatcaccgacgagctggagctccagttcaagacggtggacaccaagaccctgcccaacctgctcgccgtgcagaaccacaagctgtactccgggcagatcaacgacctgggcagcttcgcgcagggctgcgggaacatccagaagaccaacctctccgtcatcggcacggggaccgccaagttcgactacatctgccacggcgccagccgcaaggacatcgtggtgcggcgctgctacaacaacaactacgagtcctgcaagctgctgaaggaggagccgagcctcatcttctccgacaaccacgagaccatcgaggtcgccaacatccggcacctcctgggggagctccagttcaagctgatgctgggcgacctccgctacaagagcttcgccgagaaccccgagctggagatcgaggcgcggtgcgtgggctgcccctcctgcttcagctcctacagctgcaacttccgcatcagctccagcatcgacaccgtgtgcgccatcgacgggccctgcacgatcttccacaaccgcctgatcatctccagcaccaagcaggactacggcatcaagatgtcctgcaaggagaagccgaaccccgtcgagaagttcaacatctgcaagcgggtgtacagcgtcctcttcaccaccatcgacaagaacgacaagatcgagatcaacacgggggaccagacctccttcatccaggagaaggacgaccgctgcaagacctggctgtgccgggtgcgcgacgagggcatcagcgtgatcttcgagcccatcaaggccttcttcggctcctacttcagcatcgccttctacgtggtcatcgggatcatcgccctgttcatcatcatctacatcttcctccccatggtgttcaagctgaaggacatcctgaagaagaacgagctcctgtacctgcaggagatgaagtacaagtga

SEQ ID NO: 12514 - RNA, 4305 nt, synthetic construct
  misc_feature 1..4305: note = derived and/or modified CDS sequence (opt1) from ANADV(EIV-18146Yak)__KT313748.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcatctacctcaagaacgacacgggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacctacgtgtgctcccgcgactgcacgatcaccgtggacaaggaggacgcccagatcatcttccagaccgacaagctgaaccacttcgaggtcagcgggaccacgctgtccagcggctggttcaagaccaaggcgtccgtgaccctcgaccggacctgcgagcacatcaaggtgacgtgcggcaagaagaccctgcagctgcacgcctgcttcaagcaccacatgagctgcatccgcttcttccacaacaccatcctccccgggaccatggccgtctccatctgccagaacatcgagctgatcatcatcacgagcctgaccctcatcatcttcatcctgatggtgatcctgaccaagacctacatctgctacgtgctcatgccgctgttcatgcccgtcgcctacctgtacggctgggcgtacaaccggtcctgcaagaagtgcagctgctgcgggctcgcctaccaccccttcacgaactgcggctcccactgcgtgtgcgggctgaagttcgaggccagcgaccgcatgcggatccaccgcgagagcggcctgtgccagggctacaagtccctccgggtggcccgcctgctgtgcaagagcaaggggtccagcctcatcgtctccatcctgctgagcgtgctcatcctgtccttcgtgacccccatcgagggcaccctgaccaactacccggagagcaagaagtactccctcgaggagatcgccgacgtcatcgaggggttcatcgcggagaagggcatcaaggagtacatcgtgctgtacacgagcatcttcggcgccctgctcctgctgatcgccctcatcatcaccgtgtccctgaaccggatcaccgagtacctgaccaacctcaacgtcatctactgccacgagtgcagcatgtaccactccaagaagaacatcaagtacatcggggacttcacgaacaagtgcggcttctgcacgtgcggggagctggaggaccaggagggcctgaacatgcacaaggtgagcaagaagtgcatctaccgctaccagctcacctggtccaaggtcatcatgaccatcctggtgtgcctgctgatcgcccagaacaccgtgctcatcgtcgccgcgaacgacgactgctgggccaagcagagcctggagatcgagtgcgtggggcccctgcagcaggtcgacgcctgcgaggacaagtccagccggtcctacaacgaggaggccaagaagctcgtgggcaccagcaaggtgaccgagctggacgccggccaggtgaacctgctcgggcagaccatcgagagcgcgatcatcgccatccgcaagcagcggacctacgccacgatgcacttcctggagtccgtcttcctgggccgccactgcgactactacaaggtgttcgagcacaacagcgggtactcccaggccaagtggcggctcctggccaagaccaaccacttcgacatctgcagccgccactccacccaccacttctgccggtgcatgagcgacggcaccaagtgcgagaacgggaactgggacttcgcgggcgagatgaacacgacctaccactccaagcgcgacttcttcaagcacgacttcaacctgttctgcaccctcctggagaacgccttccccggcaccacggagagcctgtactaccagctcctgtccaagcggaacaccaccggggccagcaagctgctcggcaagctgatcaccaagttcgggaacaacaacctgttcgtgggcatctggaagttcgggcagttcctcctgtccctgccctacgtcaacaacacggagctcagcgccctgcagtccagcaagatcctggagtccccggagcccctcctgcgcagcgcgtccggccgccaggagagcctgagctccgccacccccggcgaggccagcaaggagtgccggaacgccaagaagatctcctgcatcagcccccgcttcggggtgccgatggagaacctcaccgcctgcggcgagtcccccaactacaagatctacaagacccccacgcggatctacaagagcaacaacaagggggagatctggtgcgcgggcgacgtgcactgcttccaggagttcacccccgtcctgcaggaggtggtggacaagctgaagaagatgacctgcttcctcaccgagccggaggccgaggaggacgccttctccatcgccatcgccatgtgcaagatcctggacaagggcgtctgcacgatcaacagcgagcgctggaacatcatcaagtgcgactccgggctgatgtactacaccgaccagcgggacggccaggacaccgggaacgacttcggcgagtactgcatcagccacaactgcaagaccgagcgcttccccatcaacccctccatcatcagcgactgcatctgggagtaccactcccgcaagagccggtacatctccacgctcaacctggagagcctggaggagttcaagcgggcgatctccgagaagctcagccacaccctgatcgtgtaccagttcaagcccacctccaacctgccgcacatgaagcccgtgtacaagtacatcaccgcccagggggtcgagaacagcgacggcatcgacagcgccttcatcacggcctccatgcccgccctcagcggcacctccatcgggtacaacgtgatgagcaaggacaacttccccctgttcgacatcatcatcttcatcaagtccgcggtgatcaagaccacctacaaccacatctacgacacgggcccgaccatcgggatcaacgtcatgcacgacgagcactgcaccggccagtgccccatcgagatcccccacaaggagaactggctgaccttcagccaggagcgcacgtcccggtgggggtgcgaggagttcggctgcctcgccatcaacaccggctgcgtgttcgggagctgccaggacatcatccgcccggagaccaaggtgtaccggaaggccatcgaggagtccgtcctgctgaccgtgtgcgtgacctaccccggcaacacgttctgcaccgagatcaacgccatcgagcccaagatcaccgacgagctcgagctgcagttcaagaccgtcgacacgaagaccctgcccaacctcctggcggtgcagaaccacaagctgtacagcgggcagatcaacgacctcggctccttcgcccaggggtgcggcaacatccagaagaccaacctgagcgtgatcggcaccgggacggccaagttcgactacatctgccacggcgcctcccgcaaggacatcgtcgtgcggcgctgctacaacaacaactacgagagctgcaagctgctcaaggaggagccgtccctgatcttcagcgacaaccacgagaccatcgaggtggccaacatccggcacctcctcggggagctgcagttcaagctgatgctcggcgacctgcgctacaagtccttcgcggagaaccccgagctggagatcgaggcccggtgcgtcgggtgccccagctgcttctccagctacagctgcaacttccgcatctccagctccatcgacaccgtgtgcgccatcgacggcccctgcaccatcttccacaaccgcctcatcatcagctccacgaagcaggactacggcatcaagatgagctgcaaggagaagccgaaccccgtggagaagttcaacatctgcaagcgggtctactccgtgctgttcaccaccatcgacaagaacgacaagatcgagatcaacaccggggaccagacgagcttcatccaggagaaggacgaccgctgcaagacctggctgtgccgggtgcgcgacgagggcatctccgtcatcttcgagcccatcaaggccttcttcgggagctacttctccatcgccttctacgtggtgatcggcatcatcgcgctgttcatcatcatctacatcttcctgcccatggtcttcaagctgaaggacatcctcaagaagaacgagctgctgtacctccaggagatgaagtacaagtga

SEQ ID NO: 12515 - RNA, 4305 nt, synthetic construct
  misc_feature 1..4305: note = derived and/or modified CDS sequence (opt1) from ANADV(EIV-18353Yak)__KT313751.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcatctacctcaagaacgacacgggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacctacgtgtgctcccgcgactgcacgatcaccgtggacaaggaggacgcccagatcatcttccagaccgacaagctgaaccacttcgaggtcagcgggaccacgctgtccagcggctggttcaagaccaaggcgtccgtgaccctcgaccggacctgcgagcacatcaaggtgacgtgcggcaagaagaccctgcagttccacgcctgcttcaagcaccacatgagctgcatccgcttcttccacaacaccatcctgcccgggaccatggccgtctccatctgccagaacatcgagctcatcatcatcacgagcctgaccctgatcatcttcatcctcatggtgatcctgaccaagacctacatctgctacgtgctgatgccgctgttcatgcccgtcgcctacctgtacggctgggcgtacaaccggtcctgcaagaagtgcagctgctgcgggctggcctaccaccccttcacgaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgaccaactacccggagagcaagaagtactccctggaggagatcgccgacgtgatcgaggggttcatcgcggagaagggcatcaaggagtacatcgtcctctacacgagcatcttcggcgccctgctgctcctgatcgccctgatcatcaccgtgtccctcaaccggatcaccgagtacctgaccaacctgaacgtgatctactgccacgagtgcagcatgtaccactccaagaagaacatcaagtacatcggggacttcacgaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacgaggaggccaagaagctggtgggcaccagcaaggtgaccgagctcgacgccggccaggtgaacctgctggggcagaccatcgagagcgcgatcatcgccatccgcaagcagcggacctacgccacgatgcacttcctcgagtccgtgttcctgggccgccactgcgactactacaaggtcttcgagcacaacagcgggtactcccaggccaagtggcggctgctcgccaagaccaaccacttcgacatctgcagccgccactccacccaccacttctgccggtgcatgagcgacggcaccaagtgcgagaacgggaactgggacttcgcgggcgagatgaacacgacctaccactccaagcgcgacttcttcaagcacgacttcaacctgttctgcaccctgctcgagaacgccttccccggcaccacggagagcctgtactaccagctgctctccaagcggaacaccaccggggccagcaagctgctgggcaagctcatcaccaagttcgggaacaacaacctgttcgtgggcatctggaagttcgggcagttcctgctctccctgccctacgtgaacaacacggagctgagcgccctccagtccagcaagatcctggagtccccggagcccctgctccgcagcgcgtccggccgccaggagagcctgagctccgccacccccggcgaggccagcaaggagtgccggaacgccaagaagatctcctgcatcagcccccgcttcggggtcccgatggagaacctgaccgcctgcggcgagtcccccaactacaagatctacaagacccccacgcggatctacaagagcaacaacaagggggagatctggtgcgcgggcgacgtgcactgcttccaggagttcacccccgtgctccaggaggtcgtggacaagctgaagaagatgacctgcttcctgaccgagccggaggccgaggaggacgccttctccatcgccatcgccatgtgcaagatcctcgacaagggcgtgtgcacgatcaacagcgagcgctggaacatcatcaagtgcgactccgggctgatgtactacaccgaccagcgggacggccaggacaccgggaacgacttcggcgagtactgcatcagccacaactgcaagaccgagcgcttccccatcaacccctccatcatcagcgactgcatctgggagtaccactcccgcaagagccggtacatctccacgctgaacctcgagagcctggaggagttcaagcgggcgatctccgagaagctgagccacaccctcatcgtctaccagttcaagcccacctccaacctgccgcacatgaagcccgtgtacaagtacatcaccgcccagggggtggagaacagcgacggcatcgacagcgccttcatcacggcctccatgcccgccctgagcggcacctccatcgggtacaacgtcatgagcaaggacaacttccccctcttcgacatcatcatcttcatcaagtccgcggtgatcaagaccacctacaaccacatctacgacacgggcccgaccatcgggatcaacgtgatgcacgacgagcactgcaccggccagtgccccatcgagatcccccacaaggagaactggctgaccttcagccaggagcgcacgtcccggtgggggtgcgaggagttcggctgcctggccatcaacaccggctgcgtcttcgggagctgccaggacatcatccgcccggagaccaaggtgtaccggaaggccatcgaggagtccgtgctcctgaccgtctgcgtgacctaccccggcaacacgttctgcaccgagatcaacgccatcgagcccaagatcaccgacgagctggagctccagttcaagaccgtggacacgaagaccctgcccaacctgctcgcggtccagaaccacaagctgtacagcgggcagatcaacgacctgggctccttcgcccaggggtgcggcaacatccagaagaccaacctcagcgtgatcggcaccgggacggccaagttcgactacatctgccacggcgcctcccgcaaggacatcgtggtccggcgctgctacaacaacaactacgagagctgcaagctgctgaaggaggagccgtccctcatcttcagcgacaaccacgagaccatcgaggtggccaacatccggcacctcctgggggagctccagttcaagctgatgctgggcgacctccgctacaagtccttcgcggagaaccccgagctggagatcgaggcccggtgcgtggggtgccccagctgcttctccagctacagctgcaacttccgcatctccagctccatcgacaccgtctgcgccatcgacggcccctgcaccatcttccacaaccgcctgatcatcagcccgacgaagcaggactacggcatcaagatgtcctgcaaggagaagcccaaccccgtggagaagttcaacatctgcaagcgggtgtacagcgtcctcttcaccaccatcgacaagaacgacaagatcgagatcaacaccggggaccagacgtccttcatccaggagaaggacgaccgctgcaagacctggctgtgccgggtgcgcgacgagggcatcagcgtgatcttcgagcccatcaaggccttcttcgggtcctacttcagcatcgccttctacgtcgtgatcggcatcatcgcgctgttcatcatcatctacatcttcctcccgatggtgttcaagctgaaggacatcctgaagaagaacgagctcctgtacctgcaggagatgaagtacaagtga

SEQ ID NO: 12516 - RNA, 4305 nt, synthetic construct
  misc_feature 1..4305: note = derived and/or modified CDS sequence (opt1) from ANADV(EIV-18560Yak)__KT313754.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcatctacctcaagaacgacacgggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacctacgtgtgctcccgcgactgcacgatcaccgtggacaaggaggacgcccagatcatcttccagaccgacaagctgaaccacttcgaggtcagcgggaccacgctgtccagcggctggttcaagaccaaggcgtccgtgaccctcgaccggacctgcgagcacatcaaggtgacgtgcggcaagaagaccctgcagttccacgcctgcttcaagcaccacatgagctgcatccgcttcttccacaacaccatcctgcccgggaccatggccgtctccatctgccagaacatcgagctcatcatcatcacgagcctgaccctgatcatcttcatcctcatggtgatcctgaccaagacctacatctgctacgtgctgatgccgctgttcatgcccgtcgcctacctgtacggctgggcgtacaaccggtcctgcaagaagtgcagctgctgcgggctggcctaccaccccttcacgaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgaccaactacccggagagcaagaagtactccctggaggagatcgccgacgtgatcgaggggttcatcgcggagaagggcatcaaggagtacatcgtcctctacacgagcatcttcggcgccctgctgctcctgatcgccctgatcatcaccgtgtccctcaaccggatcaccgagtacctgaccaacctgaacgtgatctactgccacgagtgcagcatgtaccactccaagaagaacatcaagtacatcggggacttcacgaacaagtgcggcttctgcacgtgcggggagctcgaggaccaggagggcctgaacatgcacaaggtcagcaagaagtgcatctaccgctaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccggtcctacaacgaggaggccaagaagctggtgggcaccagcaaggtgaccgagctcgacgccggccaggtgaacctgctggggcagaccatcgagagcgcgatcatcgccatccgcaagcagcggacctacgccacgatgcacttcctcgagtccgtgttcctgggccgccactgcgactactacaaggtcttcgagcacaacagcgggtactcccaggccaagtggcggctgctcgccaagaccaaccacttcgacatctgcagccgccactccacccaccacttctgccggtgcatgagcgacggcaccaagtgcgagaacgggaaccgcgacttcgcgggcgagatgaacacgacctaccactccaagcgggacttcttcaagcacgacttcaacctgttctgcaccctgctcgagaacgccttccccggcaccacggagagcctgtactaccagctgctctccaagcgcaacaccaccggggccagcaagctgctgggcaagctcatcaccaagttcgggaacaacaacctgttcgtgggcatctggaagttcgggcagttcctgctctccctgccctacgtgaacaacacggagctgagcgccctccagtccagcaagatcctggagtccccggagcccctgctccgcagcgcgtccggccggcaggagagcctgagctccgccacccccggcgaggccagcaaggagtgccgcaacgccaagaagatctcctgcatcagcccccggttcggggtcccgatggagaacctgaccgcctgcggcgagtcccccaactacaagatctacaagacccccacgcgcatctacaagagcaacaacaagggggagatctggtgcgcgggcgacgtgcactgcttccaggagttcacccccgtgctccaggaggtcgtggacaagctgaagaagatgacctgcttcctgaccgagccggaggccgaggaggacgccttctccatcgccatcgccatgtgcaagatcctcgacaagggcgtgtgcacgatcaacagcgagcggtggaacatcatcaagtgcgactccgggctgatgtactacaccgaccagcgcgacggccaggacaccgggaacgacttcggcgagtactgcatcagccacaactgcaagaccgagcggttccccatcaacccctccatcatcagcgactgcatctgggagtaccactcccgcaagagccggtacatctccacgctgaacctcgagagcctggaggagttcaagcgcgcgatctccgagaagctgagccacaccctcatcgtctaccagttcaagcccacctccaacctgccgcacatgaagcccgtgtacaagtacatcaccgcccagggggtggagaacagcgacggcatcgacagcgccttcatcacggcctccatgcccgccctgagcggcacctccatcgggtacaacgtcatgagcaaggacaacttccccctcttcgacatcatcatcttcatcaagtccgcggtgatcaagaccacctacaaccacatctacgacacgggcccgaccatcgggatcaacgtgatgcacgacgagcactgcaccggccagtgccccatcgagatcccccacaaggagaactggctgaccttcagccaggagcggacgtcccgctgggggtgcgaggagttcggctgcctggccatcaacaccggctgcgtcttcgggagctgccaggacatcatccggccggagaccaaggtgtaccgcaaggccatcgaggagtccgtgctcctgaccgtctgcgtgacctaccccggcaacacgttctgcaccgagatcaacgccatcgagcccaagatcaccgacgagctggagctccagttcaagaccgtggacacgaagaccctgcccaacctgctcgcggtccagaaccacaagctgtacagcgggcagatcaacgacctgggctccttcgcccaggggtgcggcaacatccagaagaccaacctcagcgtgatcggcaccgggacggccaagttcgactacatctgccacggcgcctcccggaaggacatcgtggtccgccggtgctacaacaacaactacgagagctgcaagctgctgaaggaggagccgtccctcatcttcagcgacaaccacgagaccatcgaggtggccaacatccgccacctcctgggggagctccagttcaagctgatgctgggcgacctccggtacaagtccttcgcggagaaccccgagctggagatcgaggcccgctgcgtggggtgccccagctgcttctccagctacagctgcaacttccgcatctccagctccatcgacaccgtctgcgccatcgacggcccctgcaccatcttccacaaccggctgatcatcagcccgacgaagcaggactacggcatcaagatgtcctgcaaggagaagcccaaccccgtggagaagttcaacatctgcaagcgcgtgtacagcgtcctcttcaccaccatcgacaagaacgacaagatcgagatcaacaccggggaccagacgtccttcatccaggagaaggacgaccggtgcaagacctggctgtgccgcgtgcgggacgagggcatcagcgtgatcttcgagcccatcaaggccttcttcgggtcctacttcagcatcgccttctacgtcgtgatcggcatcatcgcgctgttcatcatcatctacatcttcctcccgatggtgttcaagctgaaggacatcctgaagaagaacgagctcctgtacctgcaggagatgaagtacaagtga

SEQ ID NO: 12517 - RNA, 4305 nt, synthetic construct
  misc_feature 1..4305: note = derived and/or modified CDS sequence (opt1) from ANADV(EIV-18715Yak)__KT313757.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcccctgctgcgggctggcctaccaccccttcaccaactgcggcagccactgcgtgtgcgggctcaagttcgaggcctccgaccgcatgcggatccaccgcgagagcggcctgtgccagggctacaagagcctgcgggtggcccgcctcctgtgcaagtccaaggggagctccctgatcatcagcatcctcctgtccgtcctgatcctcagcttcgtgaccccgatcgagggcaccctgacgaactaccccgagtccaagaagtacagcctggaggagatcgccgacgtgatcgaggggttcatcgcggagaagggcatcaaggagtacatcgtcctctacacctccatcttcggcgccctgctgctcctgatcgccctgatcatcaccgtgagcctcaaccggatcaccgagtacctgacgaacctgaacgtgatctactgccacgagtgctccatgtaccacagcaagaagaacatcaagtacatcggggacttcaccaacaagtgcggcttctgcacgtgcggggagctcgaggaccaggagggcctgaacatgcacaaggtctccaagaagtgcatctaccgctaccagctgacctggagcaaggtgatcatgaccatcctcatctgcctgctgatcgcccagaacaccgtcctgatcgtggccgcgaacgacgactgctgggccaagcagtccctcgagatcgagtgcgtggggcccctgcagcaggtcgacgcctgcgaggacaagagctcccggagctacaacggcgaggccaagaagctggtgggcacctcccgcgtgaccgagctcgacgccgggcaggtcaacctgctgggccagaccatcgagagcgcgatcatcgccatccggaagcagcgcacgtacgccaccatgcacttcctcgagagcgtgttcctggggcggcactgcgactactacaaggtgttcgagcacaactccggctacagccaggccaagtggcgcctgctcgccaagaccaaccacttcgacatctgctcccggcacagcacccaccacttctgccgctgcatgtccgacgggacgaagtgcgagaacggcaactgggacttcgcgggcgagatgaacaccacctaccacagcaagcgggacttcttcaagcacgacttctccctgttctgcaccctgctcgagaacgccttccccgggacgaccgagagcctgtactaccagctgctctccaagcgcaacaccaccggcgccagcaagctgctggggaagctcatcacgaagttcggcaacaacaacctgttcgtcgggatctggaagttcggccagttcctgctctccctgccgtacgtgaacaacaccgagctgagcgccctccagtccagcaagatcctggagtcccccgagcccctgctccgcagcgcgtccggccggcaggagagcctgagctccgccacccccggggaggccagcaaggagtgccgcaacgccaagaagatctcctgcatcagcccgcggttcggcgtgcccatggagaacctgaccgcctgcggggagtcccccaactacaagatctacaagacgcccacccgcatctacaagagcaacaacaagggcgagatctggtgcgcgggcgacgtccactgcttccaggagttcaccccggtgctccaggaggtggtcgacaagctgaagaagatgacctgcttcctgacggagcccgaggccgaggaggacgccttctccatcgccatcgccatgtgcaagatcctcgacaagggggtgtgcaccatcaacagcgagcggtggaacatcatcaagtgcgactccggcctgatgtactacaccgaccagcgcgacgggcaggacaccggcaacgacttcggggagtactgcatcagccacaactgcaagacggagcggttccccatcaacccctccatcatcagcgactgcgtgtgggagtaccactcccgcaagagccggtacatctccaccctgaacctcgagagcctggaggagttcaagcgcgcgatctccgagaagctgagccacaccctcgtcgtgtaccagttcaagccgacctccaacctgccccacatgaagcccgtgtacaagtacatcacggcccagggcgtcgagaacagcgacggcatcgacagcgccttcatcaccgcctccatgcccgccctgagcgggacctccatcggctacaacgtgatgagcaaggacaacttccccctcttcgacatcatcatcttcatcaagtccgcggtgatcaagaccacgtacaaccacatctacgacaccgggccgaccatcggcatcaacgtcatgcacgacgagcactgcaccgggcagtgccccatcgagatcccgcacaaggagaactggctgacgttcagccaggagcggacctcccgctggggctgcgaggagttcggctgcctggccatcaacaccgggtgcgtgttcggcagctgccaggacatcatccggcccgagaccaaggtgtaccgcaaggccatcgaggagtccgtcctcctgaccgtgtgcgtgacgtaccccgggaacaccttctgcaccgagatcaacgccatcgagcccaagatcaccgacgagctggagctccagttcaagacggtcgacaccaagaccctgccgaacctgctcgcggtgcagaaccacaagctgtacagcggccagatcaacgacctggggtccttcgcccagggctgcggcaacatccagaagaccaacctcagcgtgatcgggacgggcaccgccaagttcgactacatctgccacggggcctcccggaaggacatcgtcgtgcgccggtgctacaacaacaactacgagagctgcaagctgctgaaggaggagccctccctcatcttcagcgacaaccacgagaccatcgaggtggccaacatccgccacctcctgggcgagctccagttcaagctgatgctgggggacctccggtacaagtccttcgcggagaaccccgagctggagatcgaggcccgctgcgtcggctgccccagctgcttctccagctacagctgcaacttccgcatctccagctccatcgacaccgtgtgcgccatcgacggcccgtgcacgatcttccacagccggctgatcatctccagcaccaagcaggactacgggatcaagatgtcctgcaaggagaagcccaaccccgtggagaagttcaacatctgcaagcgcgtctacagcgtcctcttcaccaccatcgacaagaacgacaagatcgagatcaacacgggcgaccagacctccttcatccaggagaaggacgaccggtgcaagacctggctgtgccgcgtgcgggacgaggggatcagcgtgatcttcgagcccatcaaggccttcttcggctcctacttcagcatcgccttctacgtggtgatcggcatcatcgcgctgttcatcatcatctacatcttcctcccgatggtcttcaagctgaaggacatcctgaagaagaacgagctcctgtacctgcaggagatgaagtacaagtga

SEQ ID NO: 12518 - RNA, 4305 nt, synthetic construct
  misc_feature 1..4305: note = derived and/or modified CDS sequence (opt1) from ANADV(EIV-23263Tyum)__KT313760.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcacgtacctcaagaacgacaccggcatcttcgcccactccaaggtgctgcggaactggatcatcaaggactggaagaactgcaaccccgtgcccaccgccgggggcagcatcaacgtgatcgaggtcaacgccgacctgtccctcagcaccaagacgtacgtgtgctcccgcgactgcaccatcaccgtggacaaggaggacgcccagatcatcttccagaccgacaagctgaaccacttcgaggtcagcgggacgaccctgtccagcggctggttcaagaccaaggcgtccgtgaccctcgaccggacgtgcgagcacatcaaggtgacctgcggcaagaagaccctgcagttccacgcctgcttcaagcaccacatgagctgcatccgcttcttccacaacaccatcctgcccgggacgatggccgtctccatctgccagaacatcgagctcatcatcatcaccagcctgaccctgatcatcttcatcctcatggtgatcctgaccaagacgtacatctgctacgtgctgatgccgctgttcatgcccgtcgcctacctgtacggctgggcgtacaaccggtcctgcaagaagtgcagctgctgcgggctggcctaccaccccttcaccaactgcggctcccactgcgtgtgcgggctcaagttcgaggccagcgaccgcatgcggatccaccgcgagagcggcctgtgccagggctacaagtccctgcgggtggcccgcctcctgtgcaagagcaaggggtccagcctgatcatctccatcctcctgagcgtcctgatcctctccttcgtgacccccatcgagggcaccctgacgaactacccggagagcaagaagtactccctggaggagatcgccgacgtgatcgaggggttcatcgcggagcggggcatcaaggagtacatcgtcctctacaccagcatcttcggcgccctgctgctcctgatcgccctgatcatcaccgtgtccctcaaccgcatcaccgagtacctgacgaacctgaacgtgatctactgccacgagtgcagcatgtaccactccaagaagaacatcaagtacatcggggacttcaccaacaagtgcggcttctgcacgtgcggggagctcgaggaccaggagggcctgaacatgcacaaggtcagcaagaagtgcatctaccggtaccagctgacctggtccaaggtgatcatgaccatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccgctcctacaacggcgaggcccggaagctggtgggcaccagcaaggtgaccgagctcgacgccggccaggtgaacctgctggggcagaccatcgagagcgcgatcatcgccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaactgggacttcgcgggcgagatgaacaccacctaccactccaagcgcgacttcttcaagcacgacttcaagctgttctgcaccctgctcgagaacgccttccccgggacgaccgagagcctgtactaccagctgctctccaagcgcaacaccaccggcgccagcaagctgctggggaagctcatcacgaagttcggcaacaacaacctgttcgtggggatctggaagttcggccagttcctgctctccctgccctacgtgaacaacaccgagctgagcgccctccagtccagcaagatcctggagtccccggagcccctgctccggagcgcgtccggccgccaggagagcctgagctccgccacccccggggaggccagcaaggagtgccggaacgccaagaagatctcctgcatcagcccccgcttcggcgtcccgatggagaacctgaccgcctgcggggagtcccccaactacaagatcttcaagacgcccacccggatctacaagagcaacaacaagggcgagatctggtgcgcgggcgacgtgcactgcttccaggagttcacccccatcctccaggaggtggtcgacaagctgaagaagatgacctgcttcctgacggagccggaggccgaggaggacgccttctccatcgccatcgccatgtgcaagatcctcgacaagggggtgtgcaccatcaacagcgagcgctggaacatcatcaagtgcgactccggcctgatgtactacaccgaccagcgggacgggcaggacaccggcaacgacttcggggagtactgcatcagccacaactgcaagacggagcgcttccccatcaacccctccatcatcagcgactgcatctgggagtaccactcccgcaagagccggtacatctccaccctgaacctcgagagcctggaggagttcaagcgggcgatctccgagaagctgagccacaccctcgtggtctaccagttcaagcccacctccaacctgccgcacatgaagcccgtgtacaagtacatcacggcccagggcgtggagaacagcgacggcatcgacagcgccttcatcaccgcctccatgcccgccctgagcgggacctccatcggctacaacgtcatgagcaaggacaacttccccctcttcgacatcatcatcttcatcaagtccgcggtgatcaagaccacgtacaaccacatctacgacaccgggccgaccatcggcatcaacgtgatgcacgacgagcactgcaccgggcagtgccccatcgagatcccccacaaggagaactggctgacgttcagccaggagcgcacctcccggtggggctgcgaggagttcggctgcctggccatcaacaccgggtgcgtcttcggcagctgccaggacatcatccgcccggagaccaaggtgtaccggaaggccatcgaggagtccgtgctcctgaccgtctgcgtgacgtaccccgggaacaccttctgcaccgagatcaacgccatcgagcccaagatcaccgacgagctggagctccagttcaagacggtggacaccaagaccctgcccaacctgctcgcggtccagaaccacaagctgtacagcggccagatcaacgacctggggtccttcgcccagggctgcggcaacatccagaagaccaacctcagcgtgatcgggacgggcaccgccaagttcgactacatctgccacggggcctcccgcaaggacatcgtggtccggcgctgctacaacaacaactacgagagctgcaagctgctgaaggaggagccgtccctcatcttcagcgacaaccacgagaccatcgaggtggccaacatccggcacctcctgggcgagctccagttcaagctgatgctgggggacctccgctacaagtccttcgcggagaaccccgagctggagatcgaggcccgctgcgtgggctgccccagctgcttctccagctacagctgcaacttccggatctccagctccatcgacaccgtctgcgccatcgacggcccctgcacgatcttccacaaccgcctgatcatcagctccaccaagcaggactacgggatcaagatgagctgcaaggagaagccgaaccccgtggagaagttcaacatctgcaagcgggtgtactccgtcctcttcaccaccatcgacaagaacgacaagatcgagatcaacacgggcgaccagaccagcttcatccaggagaaggacgaccgctgcaagacctggctgtgccgggtgcgcgacgaggggatctccgtgatcttcgagcccatcaaggccttcttcggcagctacttctccatcgccttctacgtcgtgatcggcatcatcgcgctgttcatcatcatctacatcttcctccccatggggttcaagctgaaggacatcctgaagaagaacgagctcctgtacctgcaggagatgaagtacaagtga

SEQ ID NO: 12519 - RNA, 4305 nt, synthetic construct
  misc_feature 1..4305: note = derived and/or modified CDS sequence (opt1) from BATV(804992)__FJ436801.1__GP
  source 1..4305: mol_type = other RNA
atgctgctcctgctggtgctcctgatcccctgctgcgtcagcgcctccccggtgatcacccgctgcttccacggcgggcagctgatcgccgagcgcaagagccaggcggccatctccgagttctgcctcaaggacgacgtgagcaccatcaagtccgagatcatctacgagaagaacgacacgggcctgttcgcccacaacaaggtcctgcgcaactggatcatcaaggactggaagaactgcaaccccgtgcccaccgccgggggcagcatcaacgtgatcgaggtcaacaccgacctctccctgaccacgaagacctacgtgtgcagccgggactgcaccatcaccgtggacaaggaggacgcccagatcatcttccagacggagaagctgaaccacttcgaggtctccgggaccaccctcagctccggctggttcaagaccaaggcgagcgtgacgctggaccggacctgcgagcacatcaaggtgacctgcggcaagaagaccctgcagttccacgcctgcttcaagcaccacatgtcctgcatccggttcttccacgggacgatcctccccggcaccatggccaccagcatctgccagaacatcgagctgatcatcatcatctccctgaccctcatcatcttcatcctgatggtcatcctgacgaagacctacatctgctacctcctgatgccgctgttcatgcccatcgcctacttctacgggtggagctacaacaagtcctgcaagaagtgcccctgctgcggcctcgcgtaccaccccttcaccaactgcgggagccactgcgtgtgcggcctgaagttcgaggcctccgaccgcatgcggatccaccgcgagagcggcctgtgccaggggtacaagagcctccgggtggcccgcctgctgtgcaagtccaagggcagctccctcatcatcagcatcctgctgtccatgctcatcctgagcttcgtcaccccgatcgaggggacgctgaccaactaccccgagtcccggaagtacgacctcgaggagatcgccgacgtgctggagggcttcgtggtcgagaagggcatcaaggagtacgtggtgttctacaccagcatcttcggggccctgttcctcctgatggcgctgatcgtcatcatcgccctcaaccgcgtgaccgagtacctgacgaacatcaacgtgctgtactgccacgagtgctccatgtaccacagcaagaagaacatcaagtacatcggcgacttcaccaacaagtgcgggttctgcacgtgcggcgagctcgaggaccaggaggggctgaagatccacaaggtctcccggaagtgcatctacaagtaccagctgacctggagcaaggtgatcatgatgatcctcgtctgcctgctgatcgcccagaacaccatcctgatcgtggccgcctccgacgactgctggaccaagaagtccctcgagatggagtgcatcggccccctgcagcaggtcgacacgtgcgacgacaagacctcccgcagctactccggcgaggcgaagaagctggtgcgggccagcaagatctccgacctcgacgccgcccaggtggggctgctgggcagcaccatcgagagcgccatcgcgtccatccgccggcagcgcacctacagcaccatgcacctcctggagtccgtgttcctggggaagcactgcgactactacaaggtcttcgagcacaacagcggctactcccaggccaagtggcggctcaccgccaagacccaccacttcgacatctgcagccgccactccacgcaccacttctgccggtgcatcagcgacgggaccaagtgccagaacggcgactgggacttcgccggcgagatgaactccatctaccagagcaagaaggacttcttcaagcacgacttcaagctgttctgcaccctggtggagaacgccttccccgggaccacggagtccctcttctacgagatgctgagcaagaagaacaccaccggcatcaccaagctgctcgacaagctgacgaagaagttcgggaacaacaacatgttcgtgggcatctggaagttcgggcagtacctgatgtccctcccgtacgtcaacgagaccagcctgtcccccatccagctggcgaaggtgctcgaggtgaccgaccagcaccaccgcagcgtctccggccgccaggagagcctggccagcgccacccccggctccaagagctccgagtgcgaccacgccaagaaggtgagctgcatcagcccccggttcggggcgccgatggagggcctgatggcctgcgggaacagccccaactacaagatctacaagacgcccgccaagctctacaagtccaacaacaagggcgaggtgtggtgcagcggcgacgtccactgcttccaggagctgacccccgcctcccaggagagcgtggaccgcatcaagcagatgacctgcttcctgaccgagccggaggtgaacgacgacgtcttctccatcgccatcgcgatgtgcaaggtgcaggacaagggggtgtgcacgatcaacgaggaccggtggaacatcatcaagtgcgacagcggcctcatctactacaccgaccagcgcgaggggcaggacaccggcaacgacttcggggagtactgcctgtcccacagctgccggatcgagcgcttccccatcaaccccgccatcatctccgactgcctgtgggagtaccacagccggaagtccaagtacatcaccagcctcgacctggagtccctggaggagttcaagcgcgccatcagcgagaagctcagccacacgctggtcgtgtacaacttcaagcccaccgccaacctgccgcacatcaagcccgtgtacaagtacatcaccgtccagggcgtggagaactccgacggcgtggacagcgcctacatcaccgcgtccatgcccgccctcagcgggacgtccatcggctacaacatcatgagccgggacaacttccccctgttcgacatcatcatcttcatcaagtccgccatcatcaaggccacctacaaccacatctacgacaccgggccgaccatcggcatcaacgtcatgcacgacgagcactgcacggggcagtgccccaccgacatcccccacaaggagaactggatcaccttcgcccaggagcgcaccagccggtggggctgcgaggagttcggctgcctggcggtgaacacggggtgcgtgttcggctcctgccaggacatcatccgcccggagaccaaggtctaccggaaggccgtggaggagagcgtgctcctgaccgtctgcatcacctaccccgggaagacgttctgcaccgagatcaacgccatcgagcccaagatcaccgacgagctggagctccagttcaagaccgtggacaccaagacgctgcccaacatcctggccgtgcagaaccacaagctctactccggccagatcaacgacctggggagcttctcccagggctgcggcaacatccagaagaccaacagctccatcatcgggaccggcaccgcgaagttcgactacgtctgccacggggccagccgcaaggacatcatcgtgcggcgctgctacaacaacaactacgagtcctgcaagctgctcaaggaggagcagagcctgatgttcgccgacaaccacgagacgatcgacgtggccaacgtccggcacctcctgggcgacctgcagttcaagctgatgctcggggacctgcgctacaagtccttcgccgagaacccggacctggagatcgaggcgaagtgcgtgggctgccccagctgcttcaccagctactcctgcagcttcaagatcgtgtccaacatcgacaccgtctgcagcatcgagggcccctgcaccacgttccacaaccggctcatgatcacctccaccaagcaggactacgggatcaagatgagctgcaagaccaagcccggcctgacggaggagttccagatctgcaagaagacctacaccgtgctgttcgccaccgtggagaagaacgacaagatcgagatctccacgggggaccagaccagcttcatccaggagcgcgacgaccgctgcaagacctggctctgccgggtccgcgacgagggcatctccgtgatcttcgagccgatccgggccttcttcggcagctacttctccatcgccttctacatcgtgatcgggatcatcgtcctgttcctggtgatctacatcttcctccccatgatgttcaagctgcgcgacgtgctgaagcggaacgagtacctctacctgcaggagatcaagcacaagtga

SEQ ID NO: 12520 - RNA, 4305 nt, synthetic construct
  misc_feature 1..4305: note = derived and/or modified CDS sequence (opt1) from BATV(8627-11)__FJ436799.1__GP
  source 1..4305: mol_type = other RNA
atgctgctcctgctggtgctcctgatcccctgctgcgtcagcgcctccccggtgatcacccgctgcttccacggcgggcagctgatcgccgagcgcaagagccaggcggccatctccgagttctgcctcaaggacgacgtgagcaccatcaagtccgagatcatctacgagaagaacgacacgggcctgttcgcccacaacaaggtcctgcgcaactggatcatcaaggactggaagaactgcaaccccgtgcccaccgccgggggcagcatcaacgtgatcgaggtcaacaccgacctctccctgaccacgaagacctacgtgtgcagccgggactgcaccatcaccgtggacaaggaggacgcccagatcatcttccagacggagaagctgaaccacttcgaggtctccgggaccaccctcagctccggctggttcaagaccaaggcgagcgtgacgctggaccggacctgcgagcacatcaaggtgacctgcggcaagaagaccctgcagttccacgcctgcttcaagcaccacatgtcctgcatccggttcttccacgggacgatcctccccggcaccatggccaccagcatctgccagaacatcgagctgatcatcatcatctccctgaccctcatcatcttcatcctgatggtcatcctgacgaagacctacatctgctacctcctgatgccgctgttcatgcccatcgcctacttctacgggtggagctacaacaagtcctgcaagaagtgcccctgctgcggcctcgcgtaccaccccttcaccaactgcgggagccactgcgtgtgcggcctgaagttcgaggcctccgaccgcatgcggatccaccgcgagagcggcctgtgccaggggtacaagagcctccgggtggcccgcctgctgtgcaagtccaagggcagctccctcatcatcagcatcctgctgtccatgctcatcctgagcttcgtcaccccgatcgaggggacgctgaccaactaccccgagtcccggaagtacgacctcgaggagatcgccgacgtgctggagggcttcgtggtcgagaagggcatcaaggagtacgtggtgttctacaccagcatcttcggggccctgttcctcctgatggcgctgatcgtcatcatcgccctcaaccgcgtgaccgagtacctgacgaacatcaacgtgctgtactgccacgagtgctccatgtaccacagcaagaagaacatcaagtacatcggcgacttcaccaacaagtgcgggttctgcacgtgcggcgagctcgaggaccaggaggggctgaagatccacaaggtctcccggaagtgcatctacaagtaccagctgacctggagcaaggtgatcatgatgatcctcgtctgcctgctgatcgcccagaacaccatcctgatcgtggccgcctccgacgactgctggaccaagcgcagcctcgagatggagtgcatcggccccctgcagcaggtcgacacgtgcgacgacaagacctcccggagctactccggcgaggcgaagaagctggtgcgcgccagcaagatctccgacctcgacgccgcccaggtggggctgctgggcagcaccatcgagagcgccatcgcgtccatccggcgccagcggacctacagcaccatgcacctcctggagtccgtgttcctggggaagcactgcgactactacaaggtcttcgagcacaacagcggctactcccaggccaagtggcgcctcaccgccaagacccaccacttcgacatctgcagccggcactccacgcaccacttctgccgctgcatcagcgacgggaccaagtgccagaacggcgactgggacttcgccggcgagatgaactccacctaccagagcaagaaggacttcttcgagcacgacttcaagctgttctgcaccctggtggagaacgccttccccgggacgaccgagtccctcttctacgagatgctgagcaagaagaacaccaccggcatcacgaagctgctcgacaagctgaccaagaagttcgggaacaacaacatgttcgtgggcatctggaagttcgggcagtacctgatgtccctcccgtacgtcaacgagaccagcctgtcccccacccagctggcgaaggtgctcgaggtgacggaccagcaccaccgcagcgtctccggccggcaggagagcctggccagcgccacccccggctccaagagctccgagtgcgaccacgccaagaaggtgagctgcatcagcccccgcttcggggtgccgatggagggcctgatggcgtgcgggaactcccccaactacaagatctacaagacccccgccaagctctacaagtccaacaacaagggcgaggtctggtgcagcggcaacgtgcactgcttccaggagctgaaccccgcctcccaggagagcgtggaccggatcaagcagatgacctgcttcctgacggagccggaggtcaacgacgacgtgttctccatcgccatcgccatgtgcaaggtgcaggacaagggggtctgcaccatcaacaaggaccgctggaacatcatcaagtgcgacagcggcctcatctactacaccgaccagcgggaggggcaggacaccggcaacgacttcggggagtactgcctgtcccacagctgccgcatcgagcggttccccatcaaccccgcgatcatctccgactgcctgtgggagtaccacagccgcaagtccaagtacatcacgagcctcgacctggagtccctggaggagttcaagcgggccatcagcgagaagctcagccacaccctggtggtgtacaacttcaagcccaccgccaacctgccgcacatcaagcccgtctacgagtacatcaccgtgcagggcgtggagaactccgacggcgtcgacagcgcctacatcacggcctccatgcccgcgctcagcgggacctccatcggctacaacatcatgagccgcgacaacttccccctgttcgacatcatcatcttcatcaagtccgccatcatcaaggccacctacaaccacatctacgacaccgggccgacgatcggcatcaacgtgatgcacgacgagcactgcaccgggcagtgccccaccgacatcccccacaaggagaactggatcaccttcgcccaggagcggacgagccgctggggctgcgaggagttcggctgcctggccgtgaacaccgggtgcgtcttcggctcctgccaggacatcatccggccggagaccaaggtgtaccgcaaggcggtggaggagagcgtcctcctgaccgtgtgcatcacgtaccccgggaagaccttctgcaccgagatcaacgccatcgagcccaagatcaccgacgagctggagctccagttcaagaccgtggacacgaagaccctgcccaacatcctggccgtccagaaccacaagctctactccggccagatcaacgacctggggagcttctcccagggctgcggcaacatccagaagaccaacagctccatcatcgggaccggcacggccaagttcgactacgtgtgccacggggcgagccggaaggacatcatcgtgcgccggtgctacaacaacaactacgagtcctgcaagctgctcaaggaggagcagagcctgatgttcgccgacaaccacgagaccatcgacgtcgccaacgtgcgccacctcctgggcgacctgcagttcaagctgatgctcggggacctgcggtacaagtccttcgccgagaacccggacctggagatcgaggccaagtgcgtgggctgccccagctgcttcaccagctactcctgcagcttcaagatcgtctccaacatcgacaccgtgtgcagcatcgagggcccctgcacgaccttccacaaccgcctcatgatcacctccacccgccaggactacgggatcaagatgagctgcaagacgaagcccggcctgaccgaggagttccagatctgcaagaagacctacaccgtgctgttcgcgacggtcgagaagaacgacaagatcgagatctccaccggggaccagaccagcttcatccaggagcgggacgaccgctgcaagacctggctctgccgggtgcgcgacgagggcatctccgtgatcttcgagccgatccgggccttcttcggcagctacttctccatcgccttctacatcgtcatcgggatcatcgtgctgttcctggtgatctacatcttcctccccatgatgttcaagctgcgcgacgtcctgaagcggaacgagtacctctacctgcaggagatcaagcacaagtga

SEQ ID NO: 12521 - RNA, 4305 nt, synthetic construct
  misc_feature 1..4305: note = derived and/or modified CDS sequence (opt1) from BATV(Chittoor/IG-20217)__JX846599.1__GP
  source 1..4305: mol_type = other RNA
atgctgctcctgctggtgctcctgatcccctgctgcgtcagcgcctccccggtgatcacccgctgcttccacggcgggcagctgatcgccgagcgcaagagccaggcggccatctccgagttctgcctcaaggacgacgtgagcaccatcaagtccgagatcatctacgagaagaacgacacgggcctgttcgcccacaacaaggtcctgcgcaactggatcatcaaggactggaagaactgcaaccccgtgcccaccgccgggggcagcatcaacgtgatcgaggtcaacaccgacctctccctgaccacgaagacctacgtgtgcagccgggactgcaccatcaccgtggacaaggaggacgcccagatcatcttccagacggagaagctgaaccacttcgaggtctccgggaccaccctcagctccggctggttcaagaccaaggcgagcgtgacgctggaccggacctgcgagcacatcaaggtgacctgcggcaagaagaccctgcagttccacgcctgcttcaagcaccacatgtcctgcatccggttcttccacgggacgatcctccccggcaccatggccaccagcatctgccagaacatcgagctgatcatcatcatctccctgaccctcatcatcttcatcctgatgatcatcctgacgaagacctacatctgctacctcctgatgccgctgttcatgcccatcgcctacttctacgggtggagctacaacaagtcctgcaagaagtgcccctgctgcggcctcgcgtaccaccccttcaccaactgcgggagccactgcgtctgcggcctgaagttcgaggcctccgaccgcatgcggatccaccgcgagagcggcctgtgccaggggtacaagagcctccgggtggcccgcctgctgtgcaagtccaagggcagctccctcatcatcagcatcctgctgtccatgctcatcctgagcttcgtgaccccgatcgaggggacgctgaccaactaccccgagtcccggaagtacgacctcgaggagatcgccgacgtcctggagggcttcgtggtggagaagggcatcaaggagtacgtcgtgttctacaccagcatcttcggggccctgttcctcctgatggcgctgatcgtgatcatcgccctcaaccgcgtcaccgagtacctgacgaacatcaacgtgctgtactgccacgagtgctccatgtaccacagcaagaagaacatcaagtacatcggcgacttcaccaacaagtgcgggttctgcacgtgcggcgagctcgaggaccaggaggggctgaagatccacaaggtgtcccggaagtgcatctacaagtaccagctgacctggagcaaggtcatcatgatgatcctcgtgtgcctgctgatcgcccagaacaccatcctgatcgtcgccgcctccgacgactgctggaccaagaagtccctcgagatggagtgcatcggccccctgcagcaggtcgacacgtgcgacgacaagacctcccgcagctactccggcgaggcgaagaagctggtgcgggccagcaagatctccgacctcgacgccgcccaggtggggctgctgggcagcaccatcgagagcgccatcgcgtccatccgccggcagcgcacctacagcaccatgcacctcctggagtccgtgttcctggggaagcactgcgactactacaaggtgttcgagcacaacagcggctactcccaggccaagtggcggctcaccgccaagacccaccacttcgacatctgcagccgccactccacgcaccacttctgccggtgcatcagcgacgggaccaagtgccagaacggcgactgggacttcgccggcgagatgaactccacctaccagagcaagcgcgacttcttcgagcacgacttcaagctgttctgcaccctgatcgagaacgccttccccgggacgaccgagtccctcttctacgagatgctgagcaagaagaacaccaccggcatcacgaagctgctcgacaagctgaccaagaagttcgggaacaacaacatgttcgtcggcatctggaagttcgggcagtacctgatctccctcccgtacgtgaacgagaccagcctgtcccccacccagctggcgaaggtgctcgaggtcacggaccagcaccaccgcagcatctccggccggcaggagagcctggccagcgccacccccggctccaagagctccgagtgcgaccacgccaagaaggcgagctgcatcagcccccgcttcggggtgccgatggagggcctgatggcctgcgggaacagccccaactacaagatctacaagacccccgccaagctctacaagtccaacaacaagggcgaggtgtggtgcagcggcaacttccactgcttccaggagctgatccccgcctcccaggagagcgtcgaccggatcaagcagatgacctgcttcctgacggagccggaggtgaacgacgacgtgttctccatcgccatcgcgatgtgcaaggtccaggacaagggggtgtgcaccatcaacaaggaccgctggaacgtgatcaagtgcgacagcggcctcatctactacaccgaccagcgggaggggcaggacaccggcaacgacttcggggagtactgcctgtcccacagctgccgcatcgagcggttccccatcaaccccgccatcatctccgactgcctgtgggagtaccacagccgcaagtccaagtacatcacgagcctcgacctggagtccctggaggagttcaagcgggccatcagcgagaagctcagccacaccctgatcgtctacaacttcaagcccaccgccaacctgccgcacatcaagcccgtgtacaagtacatcaccgtgcagggcgtcgagaactccgacggcgtggacagcgcctacatcacggcgtccatgcccgccctcagcgggacctccatcggctacaacatcatgagccgcgacaacttccccctgttcgacatcatcatcttcatcaagtccgccatcatcaaggccacctacaaccacatctacgacaccgggccgacgatcggcatcaacgtgatgcacgacgagcactgcaccgggcagtgccccaccgacatcccccacaaggagaactggatcaccttcgcccaggagcggacgagccgctggggctgcgaggagttcggctgcctggcggtcaacaccgggtgcgtgttcggctcctgccaggacatcatccggccggagaccaaggtgtaccgcaaggccgtcgaggagagcgtgctcctgaccgtgtgcatcacgtaccccgggaagaccttctgcaccgagatcaacgccatcgagcccaagatcaccgacgagctggagctccagttcaagaccgtcgacatcaagacgctgcccaacatcctggccgtgcagaaccacaagctctactccggccagatcaacgacctggggagcttctcccagggctgcggcaacatccagaagaccaacagctccatcatcgggaccggcaccgcgaagttcgactacgtgtgccacggggccagccggaaggacatcatcgtccgccggtgctacaacaacaactacgagtcctgcaagctgctcaaggaggagcagagcctgatgttcgccgacaaccacgagacgatcgacgtggccaacgtgcgccacctcctgggcgacctgcagttcaagctgatgctcggggacctgcggtacaagtccttcgccgagaacccggacctggagatcgaggcgaagtgcgtcggctgccccagctgcttcaccagctactcctgcagcttcaagatcgtgtccaacatcgacaccgtgtgcagcatcgagggcccctgcaccacgttccacaaccgcctcatgatcacctccaccaagcaggactacgggatcaagatgagctgcaagaccaagcccggcctgacggaggagttccagatctgcaagaagacctacaccgtcctgttcgccaccgtggagaagaacgacaagatcgagatctccacgggggaccagaccagcttcatccaggagcgcgacgaccggtgcaagacctggctctgccgcgtgcgggacgagggcatctccgtcatcttcgagccgatccgcgccttcttcggcagctacttctccatcgccttctacatcgtgatcgggatcatcgtgctgttcctggtcatctacatcttcctccccatgatgttcaagctgcgggacgtgctgaagcgcaacgagtacctctacctgcaggagatcaagcacaagtga

SEQ ID NO: 12522 - RNA, 4305 nt, synthetic construct
  misc_feature 1..4305: note = derived and/or modified CDS sequence (opt1) from BATV(41.3)__KM507322.1__GP
  source 1..4305: mol_type = other RNA
atgctgctgttcctgatcctgctcatcccctgctacgccagcgcctccccggtggtcacccgctgcttccacggcgggcagctgatcgcggagagccggtcccccaccgccgtgagcgagttctgcctgaaggacgacgtgtccacgatcaagagcgagatcatctacgtcaagaacgacaccggcctcttcgcccacaacaaggtgctgcgcaactggatcatcaaggactggaagaactgcaaccccgtgcccaccgccgggggctccatcaacgtcatcgaggtgaacaccgacctgagcctctccacgaagacctacgtgtgcagccgggactgcaccatcaccgtcgacaaggaggacgcccagatcatcttccagacggagaagctgaaccacttcgaggtgtccgggaccaccctgagctccggctggttcaagaccaaggcgagcgtgacgctcgaccggacctgcgagcacatcaaggtgacctgcggcaagaagaccctgcagttccacgcctgcttcaagcaccacatgtcctgcatccggttcttccacagcacgatcctgccggggaccatggccacctccatctgccagaacatcgagctcatcatcatcatcagcctgaccctgctcatcttcatcctgatggccatcctgacgaagacctacatctgctacctcctgatgcccctgttcatgcccatcgcgtacctctacggctggtcctacaaccgcagctgcaagaagtgcagctgctgcgggctggcctaccaccccttcaccaactgcggctcccactgcgtgtgcgggctgaagttcgaggccagcgaccggatgcgcatccaccgggagtccggcctctgccagggctacaagagcctgcgcgtggcccggctgctctgcaagtccaaggggagctccctgatcatcagcatcctgctctccatgctgatcctgagcttcgtcaccccgatcgagggcacgctcaccaactaccccgagtcccgcaagtacgacctggaggagatcgccgacgtgctggaggggttcatcaccgagaagggcatcaaggagtacgtggtcttctacaccagcatcttcggcgggctgttcctgctgctcgcgctgatcatcatcatcgccctgaaccgggtgacggagtacctcaccaacatcaacgtgttctactgccacgagtgctccatgtaccacagcaagaagaacatcaagtacatcggcgacttcaccaacaagtgcgggttctgcacgtgcggcgagctggaggaccaggaggggctgaagatccacaaggtctcccgcaagtgcatctacaagtaccagctcacctggagcaagatcatcatgatcatcctggtgtgcctgctgatcgcccagaacaccatcctcatcgtggccgcctccaacgactgctgggcgaagaagtccctggagatggagtgcatcggccccctgcagcaggtcgagagctgcgacgacaaggccagccggagctactccggcgaggccaagaagctcgtgcgcgccagcaagatctccgacctggacgccgcgcaggtcgggctgctcggcagcaccatcgagtccgccatcgccagcatccggaagcagcgcacctaccccacgatgcacctcctggagtccgtgttcctcgccaagcactgcgactactacaagagcttcgagcacaactccgggtacagccaggccaagtggcggctgaccgcgaagacccaccacttcgacatctgctcccgccacagcacccaccacttctgccggtgcatctccgacggcaccaagtgccagaacggggactgggacttcgccggcgagatgaacagcacgtaccagtccaagaaggacttcttcgagcacgacttcaagctgttctgcaccctcctggagaacgccttcccgggcaccaccgagagcttctactaccagatgctgcagaagaagaacacgaccggggtggtcaagctcctggacgagctgaccaagaagttcggcaacaacaacatgttcgtggggatctggaagttcggccagtacctcatgtccctgccctacatcaacgagaccagcctgacgcccctccagctgagcaagatcctggaggcctccaaccagcaccaccgcagcatctccgggcgccaggagagcctcgcgaacgccgcctccggcggcaagagcaaggagtgcgaccacgccaagaaggtgtcctgcatcagcccccggttcggggtcccgatggagggcctgatcgcctgcgggtccagccccaactacaagatctacaagatgcccaccaagctgtacaagtccaacaacaagggcgaggtgtggtgcagcggcgacgtgcactgcttccaggagctcaaccccgcgtcccaggagagcgtcgaccgcatcaagcagatgacctgcttcctgaccgagccggagacgaacgaggacgtgttctccatcgccatcagcatgtgcaaggtgcaggacaagggggtctgcaccatcaacgaggagcggtggaacgtgatcaagtgcgactccggcctgatctactacaccgaccagcgcgacgggcaggacaccggcaacgacttcggggagtactgcctcagccacaactgccggatcgagcgcttccccatcaaccccacgatcatcaacgactgcctgtgggagtaccactcccgcaagagcaagtacatcaccagcctggacctcgagtccctggaggagttcaagcgcgccatcagcgagaagctgtcccacaccctcatcgtgtacaacttcaagcccaccgccaacctgccgcacatcaagcccgtctacaagtacatcacggtgcagggcgtggagaacagcgacggcgtcgactccgcctacatcaccgcgagcatgcccgccctgtccgggaccagcatcggctacaacatcatgtccaaggacaacttccccctcttcgacatcatcatcttcatcaagagcgccgtgatcaaggccacctacaaccacatctacgacacggggccgaccatcggcatcaacgtgatgcacgacgagcactgcaccgggcagtgccccaccgacatcccccacaaggagaactggatcacgttctcccaggagcggaccagccgctggggctgcgaggagttcggctgcctggccgtcaacaccgggtgcgtgttcggctcctgccaggacatcatccggccggagaccaaggtgtaccgcaaggcgatcgaggagagcgtcctgctcacggtgtgcatcacctaccccgggaagaccttctgcaccgagatcaacgccatcgagcccaagatcacggacgagctggagctgcagttcaagaccgtggacaccaagaccctccccaacatcctggccgtccagaaccacaagctgtactccggccagatcaacgacctcgggagcttctcccagggctgcggcaacatccagaagaccaacagctccatcatcgggacgggcaccgccaagttcgactacgtgtgccacggggcgagccggaaggacatcatcgtgcgccggtgctacaacaacaactacgagagctgccgcctgctgaaggaggagcagtccctcatgttcgccgacaaccacgagaccatcgacgtcgccaacgtgcggcacctcctgggcgacctccagttcaagctgatgctgggggacctccgctacaagagcttcgccgaggacccggacctggagatcgaggccaagtgcgtgggctgcccctcctgcttcaccagctactcctgcaacttccggatcgtcagcaacatcgacacggtgtgctccatcgagggcccctgcaccaccttccacaaccgcctgatgatcaccagcacgaagcaggactacgggatcaagatgtcctgcaagggcaagcccgggagcaccgaggagttccagatctgcaagaagacctacaccgtcctcttcacgaccgtcgagaagaacgacaagatcgagatcaacaccggcgaccagacctccttcatccaggagcgcgacgaccggtgcaagacgtggctgtgccgcgtgcgggacgagggcatcagcgtgatcttcgagccgatccgcgcgttcttcgggtcctacttcagcatcgccttctacatcgtcgtgggcatcatcgtgctgttcctcatgatctacatcttcctgcccatggccttcaagctgcgggacgtcctcaagcgcaacgagtacctgtacctgcaggagatcaagcacaagtga

SEQ ID NO: 12523 - RNA, 4305 nt, synthetic construct
  misc_feature 1..4305: note = derived and/or modified CDS sequence (opt1) from BATV(EIV-1217Astr)__KT313699.1__GP
  source 1..4305: mol_type = other RNA
atgctgctgttcctgatcctgctcatcccctgctacgccagcgcctccccggtggtcacccgctgcttccacggcgggcagctgatcgcggagagccggtcccccaccgccgtgagcgagttctgcctgaaggacgacgtgtccacgatcaagagcgagatcatctacgtcaagaacgacaccggcctcttcgcccacaacaaggtgctgcgcaactggatcatcaaggactggaagaactgcaaccccgtgcccaccgccgggggctccatcaacgtcatcgaggtgaacaccgacctgagcctctccacgaagacctacgtgtgcagccgggactgcaccatcaccgtcgacaaggaggacgcccagatcatcttccagacggagaagctgaaccacttcgaggtgtccgggaccaccctgagctccggctggttcaagaccaaggcgagcgtgacgctcgaccggacctgcgagcacatcaaggtgacctgcggcaagaagaccctgcagttccacgcctgcttcaagcaccacatgtcctgcatccgcttcttccacgggacgatcctgccgggcaccatggccaccagcatctgccagaacatcgagctcatcatcatcatctccctgaccctgctcatcttcatcctgatggccatcctgacgaagacctacatctgctacctcctgatgcccctgttcatgcccatcgcgtacctctacgggtggagctacaaccgctcctgcaagaagtgcagctgctgcggcctggcctaccaccccttcaccaactgcgggagccactgcgtctgcggcctgaagttcgaggcctccgaccggatgcgcatccaccgggagagcggcctctgccaggggtacaagtccctgcgcgtggcccggctgctctgcaagagcaagggctccagcctgatcatctccatcctgctcagcatgctgatcctgtccttcgtcaccccgatcgaggggacgctcaccaactaccccgagagccgcaagtacgacctggaggagatcgccgacgtgctggagggcttcgtgaccgagaagggcatcaaggagtacgtcgtgttctacacctccatcttcgggggcctcttcctgctgctcgcgctgatcatcatcatcgccctgaaccgggtgacggagtacctcaccaacatcaacgtcttctactgccacgagtgcagcatgtaccactccaagaagaacatcaagtacatcggggacttcaccaacaagtgcggcttctgcacgtgcggggagctggaggaccaggagggcctgaagatccacaaggtgagccgcaagtgcatctacaagtaccagctcacctggtccaagatcatcatgatcatcctggtgtgcctgctgatcgcccagaacaccatcctcatcgtcgccgccagcaacgactgctgggcgaagaagtccctggagatggagtgcatcggccccctgcagcagatggagagctgcgacgacaaggcctcccggagctacagcggggaggccaagaagctcgtgcgcgcctccaagatcagcgacctggacgccgcgcaggtcggcctgctcgggtccaccatcgagagcgccatcgcctccatccggaagcagcgcacctaccccacgatgcacctcctggagagcgtgttcctcgccaagcactgcgactactacaagtccttcgagcacaacagcggctactcccaggccaagtggcggctgaccgcgaagacccaccacttcgacatctgcagccgccactccacccaccacttctgccggtgcatcagcgacgggaccaagtgccagaacggcgactgggacttcgccggcgagatgaactccacgtaccagagcaagaaggacttcttcaagcacgacttcaagctgttctgcaccctcctggagaacgccttcccggggaccaccgagtccttctactaccagatgctgcagaagaagaacacgaccggcgtggtcaagctcctggacgagctgaccaagaagttcgggaacaacaacatgttcgtgggcatctggaagttcgggcagtacctcatgagcctgccctacatcaacgagacctccctgacgcccctccagctgagcaagatcctggaggccagcgaccagcaccaccgctccatcagcggccgccaggagtccctcgcgaacgccgccagcggcgggaagtccaaggagtgcgaccacgccaagaaggtgagctgcatcagcccccggttcggcgtcccgatggaggggctgatcgcctgcggcggctcccccaactacaagatctacaagatgcccaccaagctgtacaagtccaacaacaagggggaggtgtggtgcagcggcgacgtgcactgcttccaggagctcaaccccgcgctgcaggagtccgtcgaccgcatcaagcagatgacctgcttcctgaccgagccggagacgaacgaggacgtgttcagcatcgccatctccatgtgcaaggtgcaggacaagggggtctgcaccatcaacgaggagcggtggaacgtgatcaagtgcgacagcggcctcatctactacaccgaccagcgcgacgggcaggacaccggcaacgacttcggcgagtactgcctgtcccacaactgccggatcgagcgcttccccatcaaccccacgatcatcaacgactgcctgtgggagtaccacagccggaagtccaagtacatcaccagcctcgacctggagtccctggaggagttcaagcgcgccatcagcgagaagctcagccacaccctgatcgtgtacaacttcaagcccaccgccaacctgccgcacatcaagcccgtctacaagtacatcacggtgcagggggtggagaactccgacggcgtcgacagcgcctacatcaccgcgtccatgcccgccctcagcgggacctccatcggctacaacatcatgagcaaggacaacttccccctgttcgacatcatcatcttcatcaagtccgccgtgatcaaggccacctacaaccacatctacgacacggggccgaccatcggcatcaacgtgatgcacgacgagcactgcaccggccagtgccccaccgacatcccccacaaggagaactggatcacgttcagccaggagcggacctcccgctgggggtgcgaggagttcggctgcctggccgtcaacaccgggtgcgtgttcggcagctgccaggacatcatccggccggagaccaaggtgtaccgcaaggcgatcgaggagtccgtcctcctgacggtgtgcatcacctaccccgggaagaccttctgcaccgagatcaacgccatcgagcccaagatcacggacgagctggagctccagttcaagaccgtggacaccaagaccctgcccaacatcctggccgtccagaaccacaagctctacagcggccagatcaacgacctgggctccttcagccaggggtgcggcaacatccagaagaccaactccagcatcatcgggacgggcaccgccaagttcgactacgtgtgccacggggcgtcccggaaggacatcatcgtgcgccggtgctacaacaacaactacgagagctgccgcctgctcaaggaggagcagtccctgatgttcgccgacaaccacgagaccatcgacgtcgccaacgtgcggcacctcctgggcgacctgcagttcaagctgatgctcggcgacctgcgctacaagagcttcgccgaggacccggacctggagatcgaggccaagtgcgtggggtgccccagctgcttcacctcctacagctgcaacttccggatcgtctccaacatcgacacggtgtgcagcatcgagggcccctgcaccaccttccacaaccgcctcatgatcacctccacgaagcaggactacgggatcaagatgagctgcaagggcaagcccggctccaccgaggagttccagatctgcaagaagacctacaccgtgctgttcacgaccgtcgagaagaacgacaagatcgagatcaacaccggggaccagaccagcttcatccaggagcgcgacgaccggtgcaagacgtggctgtgccgcgtgcgggacgagggcatctccgtggtcttcgagccgatccgcgcgttcttcgggagctacttctccatcgccttctacatcgtggtgggcatcatcgtcctcttcctggtgatctacatcttcctgcccatggccttcaagctccgggacgtgctgaagcgcaacgagtacctgtacctccaggagatcaagcacaagtga

SEQ ID NO: 12524 - RNA, 4305 nt, synthetic construct
  misc_feature 1..4305: note = derived and/or modified CDS sequence (opt1) from BATV(EIV-12497Bl)__KT313692.1__GP
  source 1..4305: mol_type = other RNA
atgctgctgttcctgatcctgctcatcccctgctacgccagcgcctccccggtggtcacccgctgcttccacggcgggcagctgatcgcggagagccggtcccccaccgccgtgagcgagttctgcctgaaggacgacgtgtccacgatcaagagcgagatcatctacgtcaagaacgacaccggcctcttcgcccacaacaaggtgctgcgcaactggatcatcaaggactggaagaactgcaaccccgtgcccaccgccgggggctccatcaacgtcatcgaggtgaacaccgacctgagcctctccacgaagacctacgtgtgcagccgggactgcaccatcaccgtcgacaaggaggacgcccagatcatcttccagacggagaagctgaaccacttcgaggtgtccgggaccaccctgagctccggctggttcaagaccaaggcgagcgtgacgctcgaccggacctgcgagcacatcaaggtgacctgcggcaagaagaccctgcagttccacgcctgcttcaagcaccacatgtcctgcatccgcttcttccacgggacgatcctgccgggcaccatggccaccagcatctgccagaacatcgagctcatcatcatcacctccctgacgctgctcatcttcatcctgatggccatcctgaccaagacctacatctgctacctcctgatgcccctgttcatgcccatcgcgtacctctacgggtggagctacaaccgctcctgcaagaagtgcagctgctgcggcctggcctaccaccccttcaccaactgcgggagccactgcgtctgcggcctgaagttcgaggcctccgaccggatgcgcatccaccgggagagcggcctctgccaggggtacaagtccctgcgcgtggcccggctgctctgcaagagcaagggctccagcctgatcatctccatcctgctcagcatgctgatcctgtccttcgtcacgccgatcgaggggaccctcaccaactaccccgagagccgcaagtacgacctggaggagatcgccgacgtgctggagggcttcatcaccgagaagggcatcaaggagtacgtggtcttctacacgtccatcttcgggggcctcttcctgctgctcgcgctgatcatcatcatcgccctgaaccgggtgaccgagtacctcaccaacatcaacgtgttctactgccacgagtgcagcatgtaccactccaagaagaacatcaagtacatcggggacttcaccaacaagtgcggcttctgcacgtgcggggagctggaggaccaggagggcctgaagatccacaaggtcagccgcaagtgcatctacaagtaccagctcacctggtccaagatcatcatgatcatcctggtgtgcctgctgatcgcccagaacaccatcctcatcgtggccgccagcaacgactgctgggcgaagaagtccctggagatggagtgcatcggccccctgcagcaggtcgagagctgcgacgacaaggcctcccggagctacagcggggaggccaagaagctcgtgcgcgcctccaagatcagcgacctggacgccgcgcaggccggcctgctcgggtccaccatcgagagcgccatcgcctccatccggaagcagcgcacgtaccccaccatgcacctcctggagagcgtcttcctcgccaagcactgcgactactacaagtccttcgagcacaacagcggctactcccaggcgaagtggcggctgaccgccaagacccaccacttcgacatctgcagccgccactccacccaccacttctgccggtgcatcagcgacgggacgaagtgccagaacggcgactgggacttcgccggcgagatgaactccacctaccagagcaagaaggacttcttcgagcacgacttcaagctgttctgcaccctcctggagaacgccttcccggggaccacggagtccttctactaccagctgctccagaagaagaacaccaccggcgtggtgaagctgctggacgagctcaccaagaagttcgggaacaacaacatgttcgtcggcatctggaagttcgggcagtacctgatgagcctgccctacatcaacgagacgtccctcacgcccctgcagctgagcaagatcctcgaggcgagcgaccagcaccaccgctccatcagcggccgccaggagtccctggccagcgccgcctccggcggcaagagcaaggagtgcgaccacgccaagaaggtgtcctgcatcagcccccggttctccgtgccgatggaggggctgatcgcgtgcgggagctcccccaactacaagatctaccgcatgcccaccaagctctacaagagcaacaacaagggcgaggtctggtgctccggcgacgtgcactgcttccaggagctgaaccccgccagccaggagtccgtggaccggatcaagcagatgatctgcttcctgaccgagccggaggtcaacgaggacgtgttcagcatcgccatctccatgtgcaaggtgcaggacaagggggtctgcaccatcaacgaggagcgctggaacgtgatcaagtgcgacagcggcctcatctactacaccgaccagcgggacgggcaggacaccggcaacgacttcggggagtactgcctgtcccacaactgccgcatcgagcggttccccatcaaccccaccatcatcaacgactgcctgtgggagtaccacagccgcaagagcaagtacatcacgtccctcgacctggagagcctggaggagttcaagcgggccatctccgagaagctcagccacaccctgatcgtgtacaacttcaagcccaccgccaacctgccgcacatcaagcccgtctacaagtacatcaccgtgcagggcgtggagaactccgacggcgtcgacagcgcgtacatcacggcctccatgcccgccctcagcgggacctccatcggctacaacatcatgagccgcgacaacttccccctgttcgacatcatcatcttcatcaagtccgccgtgatcaaggccacctacaaccacatctacgacaccgggccgacgatcggcatcaacgtgatgcacgacgagcactgcaccgggcagtgccccaccgacatcccccacaaggagaactggatcaccttcagccaggagcggacgtcccgctggggctgcgaggagttcggctgcctggcggtcaacaccgggtgcgtgttcggcagctgccaggacatcatccggccggagaccaaggtgtaccgcaaggccgtcgaggagtccgtgctcctgaccgtgtgcatcacgtaccccgggaagaccttctgcaccgagatcaacgccatcgagcccaagatcaccgacgagctggagctccagttcaagacggtcgacaccaagaccctgcccaacatcctggccgtgcagaaccacaagctctacagcggccagatcaacgacctggggtccttcagccagggctgcggcaacatccagaagaccaactccagcatcatcgggaccggcacggcgaagttcgactacgtgtgccacggggccagccggaaggacatcatcgtccgccggtgctacaacaacaactacgagtcctgccgcctgctcaaggaggagcagagcctgatgttcgccgacaaccacgagaccatcgacgtggccaacgtgcggcacctcctgggcgacctgcagttcaagctgatgctcggggacctgcgctacaagtccttcgccgaggacccgggcctggagatcgaggcgaagtgcgtcggctgccccagctgcttcacctcctacagctgcaacttccgcatcgtgtccaacatcgacaccgtgtgcagcatcgaggggccctgcacgaccttccacaaccggctcatgatcacctccaccaagcaggactacggcatcaagatgagctgcaaggggaagcccggctccacggaggagttccagatctgcaagaagacctacaccgtcctgttcaccacgatcgagaagaacgacaagatcgagatcaacaccggcgaccagaccagcttcgtgcaggagcgcgacgaccggtgcaagacctggctgtgccgcgtgcgggacgaggggatctccgtcatcttcgagccgatccgcgccttcttcggcagctacttctccatcgccttctacatcgtggtggggatcatcgtcctcttcctggtgatctacatcttcctgcccatggccttcaagctccgggacgtgctgaagcgcaacgagtacctgtacctccaggagatcaagcacaagtga

SEQ ID NO: 12525 - RNA, 4305 nt, synthetic construct
  misc_feature 1..4305: note = derived and/or modified CDS sequence (opt1) from BATV(EIV-12845Ms)__KT313690.1__GP
  source 1..4305: mol_type = other RNA
atgctgctgttcctgatcctgctcatcccctgctacgccagcgcctccccggtggtcacccgctgcttccacggcgggcagctgatcgcggagaaccggagccccaccgccgtgtccgagttctgcctgaaggacgacgtgagcacgatcaagtccgagatcatctacgtcaagaacgacaccggcctcttcgcccacaacaaggtgctgcgcaactggatcatcaaggactggaagaactgcaaccccgtgcccaccgccgggggcagcatcaacgtcatcgaggtgaacaccgacctgtccctcagcacgaagacctacgtgtgctcccgggactgcaccatcaccgtcgacaaggaggacgcccagatcatcttccagacggagaagctgaaccacttcgaggtgagcgggaccaccctgtccagcggctggttcaagaccaaggcgtccgtgacgctcgaccggacctgcgagcacatcaaggtgacctgcggcaagaagaccctgcagttccacgcctgcttcaagcaccacatgagctgcatccggttcttccactccacgatcctgccggggaccatggccaccagcatctgccagaacatcgagctcatcatcatcatctccctgaccctgctcatcttcatcctgatggccatcctgacgaagacctacatctgctacctcctgatgcccctgttcatgcccatcgcgtacctctacggctggagctacaaccgctcctgcaagaagtgcagctgctgcgggctggcctaccaccccttcaccaactgcggcagccactgcgtgtgcgggctgaagttcgaggcctccgaccggatgcgcatccaccgggagagcggcctctgccagggctacaagtccctgcgcgtggcccggctgctctgcaagagcaaggggtccagcctgatcatctccatcctgctcagcatgctgatcctgtccttcgtcaccccgatcgagggcacgctcaccaactaccccgagagccgcaagtacgacctggaggagatcgccgacgtgctggaggggttcatcaccgagaagggcatcaaggagtacgtggtcttctacacctccatcttcggcgggctgttcctgctgctcgcgctgatcatcatcatcgccctgaaccgggtgacggagtacctcaccaacatcaacgtgttctactgccacgagtgcagcatgtaccactccaagaagaacatcaagtacatcggcgacttcaccaacaagtgcgggttctgcacgtgcggcgagctggaggaccaggaggggctgaagatccacaaggtcagccgcaagtgcatctacaagtaccagctcacctggtccaagatcatcatgatcatcctggtgtgcctgctgatcgcccagaacaccatcctcatcgtggccgccagcaacgactgctgggcgaagaagtccctggagatggagtgcatcggccccctgcagcaggtcgagagctgcgacgacaaggcctcccggagctacagcggcgaggccaagaagctcgtgcgcgcctccaagatcagcgacctggacgccgcgcaggtcgggctgctcggctccaccatcgagagcgccatcgcctccatccggaagcagcgcacctaccccacgatgcacctcctggagagcgtgttcctcgccaagcactgcgactactacaagtccttcgagcacaacagcgggtactcccaggccaagtggcggctgaccgcgaagacccaccacttcgacatctgcagccgccactccacccaccacttctgccggtgcatcagcgacggcaccaagtgccagaacggggactgggacttcgccggcgagatgaactccacgtaccagagcaagaaggacttcttcgagcacgacttcaagctgttctgcaccctcctggagaacgccttcccgggcaccaccgagtccttctactaccagatgctgcagaagaagaacacgaccggggtggtcaagctcctggacgagctgaccaagaagttcggcaacaacaacatgttcgtggggatctggaagttcggccagtacctcatgagcctgccctacatcaacgagacctccctgacgcccctccagctgagcaagatcctggaggccagcgaccagcaccaccgctccatcagcgggcgccaggagtccctcgcgaacgccgccagcggctccaagagcaaggagtgcgaccacgccaagaaggtgtcctgcatcagcccccggttcggcgtcccgatggaggggctgatcgcctgcggctccagccccaactacaagatctacaagatgcccaccaagctgtacaagtccaacaacaagggggaggtgtggtgcagcggcgacgtgcactgcttccaggagctcaaccccgcgtcccaggagagcgtcgaccgcatcaagcagatgacctgcttcctgaccgagccggagacgaacgaggacgtgttctccatcgccatcagcatgtgcaaggtgcaggacaagggcgtctgcaccatcaacgaggagcggtggaacgtgatcaagtgcgactccgggctgatctactacaccgaccagcgcgacggccaggacaccgggaacgacttcggcgagtactgcctcagccacaactgccggatcgagcgcttccccatcaaccccacgatcatcaacgactgcctgtgggagtaccactcccgcaagagcaagtacatcaccagcctggacctcgagtccctggaggagttcaagcgcgccatcagcgagaagctgtcccacaccctcatcgtgtacaacttcaagcccaccgccaacctgccgcacatcaagcccgtctacaagtacatcacggtgcagggggtggagaacagcgacggcgtcgactccgcctacatcaccgcgagcatgcccgccctgtccggcaccagcatcgggtacaacatcatgtccaaggacaacttccccctcttcgacatcatcatcttcatcaagagcgccgtgatcaaggccacctacaaccacatctacgacacgggcccgaccatcgggatcaacgtgatgcacgacgagcactgcaccggccagtgccccaccgacatcccccacaaggagaactggatcacgttctcccaggagcggaccagccgctgggggtgcgaggagttcggctgcctggccgtcaacaccggctgcgtgttcgggtcctgccaggacatcatccggccggagaccaaggtgtaccgcaaggcgatcgaggagagcgtcctgctcacggtgtgcatcacctaccccggcaagaccttctgcaccgagatcaacgccatcgagcccaagatcacggacgagctggagctgcagttcaagaccgtggacaccaagaccctccccaacatcctggccgtccagaactacaagctgtactccgggcagatcaacgacctcggcagcttctcccaggggtgcggcaacatccagaagaccaacagctccatcatcggcacggggaccgccaagttcgactacgtgtgccacggcgcgagccggaaggacatcatcgtgcgccggtgctacaacaacaactacgagagctgccgcctgctgaaggaggagcagtccctcatgttcgccgacaaccacgagaccatcgacgtcgccaacgtgcggcacctcctgggggacctccagttcaagctgatgctgggcgacctccgctacaagagcttcgccgaggacccggacctggagatcgaggccaagtgcgtggggtgcccctcctgcttcaccagctactcctgcaacttccggatcgtcagcaacatcgacacggtgtgctccatcgagggcccctgcaccaccttccacaaccgcctgatgatcaccagcacgaagcaggactacggcatcaagatgtcctgcaaggggaagcccggcagcaccgaggagttccagatctgcaagaagacctacaccgtcctcttcacgaccgtcgagaagaacgacaagatcgagatcaacaccggggaccagacctccttcatccaggagcgcgacgaccggtgcaagacgtggctgtgccgcgtgcgggacgagggcatcagcgtgatcttcgagccgatccgcgcgttcttcggctcctacttcagcatcgccttctacatcgtcgtggggatcatcgtgctgttcctcgtcatctacatcttcctgcccatggccttcaagctgcgggacgtgctcaagcgcaacgagtacctgtacctgcaggagatcaagcacaagtga

SEQ ID NO: 12526 - RNA, 4305 nt, synthetic construct
  misc_feature 1..4305: note = derived and/or modified CDS sequence (opt1) from BATV(EIV-2077Astr)__KT313702.1__GP
  source 1..4305: mol_type = other RNA
atgctgctgttcctgatcctgctcatcccctgctacgccagcgcctccccggtggtcacccgctgcttccacggcgggcagctgatcgcggagagccggtcccccaccgccgtgagcgagttctgcctgaaggacgacgtgtccacgatcaagagcgagatcatctacgtcaagaacgacaccggcctcttcgcccacaacaaggtgctgcgcaactggatcatcaaggactggaagaactgcaaccccgtgcccaccgccgggggctccatcaacgtcatcgaggtgaacaccgacctgagcctctccacgaagacctacgtgtgcagccgggactgcaccatcaccgtcgacaaggaggacgcccagatcatcttccagacggagaagctgaaccacttcgaggtgtccgggaccaccctgagctccggctggttcaagaccaaggcgagcgtgacgctcgaccggacctgcgagcacatcaaggtgacctgcggcaagaagaccctgcagttccacgcctgcttcaagcaccacatgtcctgcatccgcttcttccacgggacgatcctgccgggcaccatggccaccagcatctgccagaacatcgagctcatcatcatcatctccctgaccctgctcatcttcatcctgatggccatcctgacgaagacctacatctgctacctcctgatgcccctgttcatgcccatcgcgtacctctacgggtggagctacaaccgctcctgcaagaagtgcagctgctgcggcctggcctaccaccccttcaccaactgcgggagccactgcgtctgcggcctgaagttcgaggcctccgaccggatgcgcatccaccgggagagcggcctctgccaggggtacaagtccctgcgcgtggcccggctgctctgcaagagcaagggctccagcctgatcatctccatcctgctcagcatgctgatcctgtccttcgtcaccccgatcgaggggacgctcaccaactaccccgagagccgcaagtacgacctggaggagatcgccgacgtgctggagggcttcgtgaccgagaagggcatcaaggagtacgtcgtgttctacacctccatcttcgggggcctcttcctgctgctcgcgctgatcatcatcatcgccctgaaccgggtgacggagtacctcaccaacatcaacgtcttctactgccacgagtgcagcatgtaccactccaagaagaacatcaagtacatcggggacttcaccaacaagtgcggcttctgcacgtgcggggagctggaggaccaggagggcctgaagatccacaaggtgagccgcaagtgcatctacaagtaccagctcacctggtccaagatcatcatgatcatcctggtgtgcctgctgatcgcccagaacaccatcctcatcgtcgccgccagcaacgactgctgggcgaagaagtccctggagatggagtgcatcggccccctgcagcagatggagagctgcgacgacaaggcctcccggagctacagcggggaggccaagaagctcgtgcgcgcctccaagatcagcgacctggacgccgcgcaggtcggcctgctcgggtccaccatcgagagcgccatcgcctccatccggaagcagcgcacctaccccacgatgcacctcctggagagcgtgttcctcgccaagcactgcgactactacaagtccttcgagcacaacagcggctactcccaggccaagtggcggctgaccgcgaagacccaccacttcgacatctgcagccgccactccacccaccacttctgccggtgcatcagcgacgggaccaagtgccagaacggcgactgggacttcgccggcgagatgaactccacgtaccagagcaagaaggacttcttcgagcacgacttcaagctgttctgcaccctcctggagaacgccttcccggggaccaccgagtccttctactaccagatgctgcagaagaagaacacgaccggcgtggtcaagctcctggacgagctgaccaagaagttcgggaacaacaacatgttcgtgggcatctggaagttcgggcagtacctcatgagcctgccctacatcaacgagacctccctgacgcccctccagctgagcaagatcctggaggccagcgaccagcaccaccgctccatcagcggccgccaggagtccctcgcgaacgccgccagcggcgggaagtccaaggagtgcgaccacgccaagaaggtgagctgcatcagcccccggttcggcgtcccgatggaggggctgatcgcctgcggcggctcccccaactacaagatctacaagatgcccaccaagctgtacaagtccaacaacaagggggaggtgtggtgcagcggcgacgtgcactgcttccaggagctcaaccccgcgctgcaggagtccgtcgaccgcatcaagcagatgacctgcttcctgaccgagccggagacgaacgaggacgtgttcagcatcgccatctccatgtgcaaggtgcaggacaagggggtctgcaccatcaacgaggagcggtggaacgtgatcaagtgcgacagcggcctcatctactacaccgaccagcgcgacgggcaggacaccggcaacgacttcggcgagtactgcctgtcccacaactgccggatcgagcgcttccccatcaaccccacgatcatcaacgactgcctgtgggagtaccacagccggaagtccaagtacatcaccagcctcgacctggagtccctggaggagttcaagcgcgccatcagcgagaagctcagccacaccctgatcgtgtacaacttcaagcccaccgccaacctgccgcacatcaagcccgtctacaagtacatcacggtgcagggggtggagaactccgacggcgtcgacagcgcctacatcaccgcgtccatgcccgccctcagcgggacctccatcggctacaacatcatgagcaaggacaacttccccctgttcgacatcatcatcttcatcaagtccgccgtgatcaaggccacctacaaccacatctacgacacggggccgaccatcggcatcaacgtgatgcacgacgagcactgcaccggccagtgccccaccgacatcccccacaaggagaactggatcacgttcagccaggagcggacctcccgctgggggtgcgaggagttcggctgcctggccgtcaacaccgggtgcgtgttcggcagctgccaggacatcatccggccggagaccaaggtgtaccgcaaggcgatcgaggagtccgtcctcctgacggtgtgcatcacctaccccgggaagaccttctgcaccgagatcaacgccatcgagcccaagatcacggacgagctggagctccagttcaagaccgtggacaccaagaccctgcccaacatcctggccgtccagaaccacaagctctacagcggccagatcaacgacctgggctccttcagccaggggtgcggcaacatccagaagaccaactccagcatcatcgggacgggcaccgccaagttcgactacgtgtgccacggggcgtcccggaaggacatcatcgtgcgccggtgctacaacaacaactacgagagctgccgcctgctcaaggaggagcagtccctgatgttcgccgacaaccacgagaccatcgacgtcgccaacgtgcggcacctcctgggcgacctgcagttcaagctgatgctcggcgacctgcgctacaagagcttcgccgaggacccggacctggagatcgaggccaagtgcgtggggtgccccagctgcttcacctcctacagctgcaacttccggatcgtctccaacatcgacacggtgtgcagcatcgagggcccctgcaccaccttccacaaccgcctcatgatcacctccacgaagcaggactacgggatcaagatgagctgcaagggcaagcccggctccaccgaggagttccagatctgcaagaagacctacaccgtgctgttcacgaccgtcgagaagaacgacaagatcgagatcaacaccggggaccagaccagcttcatccaggagcgcgacgaccggtgcaagacgtggctgtgccgcgtgcgggacgagggcatctccgtggtcttcgagccgatccgcgcgttcttcgggagctacttctccatcgccttctacatcgtggtgggcatcatcgtcctcttcctggtgatctacatcttcctgcccatggccttcaagctccgggacgtgctgaagcgcaacgagtacctgtacctccaggagatcaagcacaagtga

SEQ ID NO: 12527 - RNA, 4305 nt, synthetic construct
  misc_feature 1..4305: note = derived and/or modified CDS sequence (opt1) from BATV(Italy-2009)__KC168047.1__GP
  source 1..4305: mol_type = other RNA
atgctgctgttcctgatcctgctcatcccctgctacgccagcgcctccccggtggtcacccgctgcttccacggcgggcagctgatcgcggagagccggtcccccaccgccgtgagcgagttctgcctgaaggacgacgtgtccacgatcaagagcgagatcatctacgtcaagaacgacaccggcctcttcgcccacaacaaggtgctgcgcaactggatcatcaaggactggaagaactgcaaccccgtgcccaccgccgggggctccatcaacgtcatcgaggtgaacaccgacctgagcctctccacgaagacctacgtgtgcagccgggactgcaccatcaccgtcgacaaggaggacgcccagatcatcttccagacggagaagctgaaccacttcgaggtgtccgggaccaccctgagctccggctggttcaagaccaaggcgagcgtgacgctcgaccggacctgcgagcacatcaaggtgacctgcggcaagaagaccctgcagttccacgcctgcttcaagcaccacatgtcctgcatccgcttcttccacagcacgatcctgccggggaccatggccacctccatctgccagaacatcgagctcatcatcatcatcagcctgaccctgctcatcttcatcctgatggccatcctgacgaagacctacatctgctacctcctgatgcccctgttcatgcccatcgcgtacctctacggctggtcctacaaccgcagctgcaagaagtgcagctgctgcgggctggcctaccaccccttcaccaactgcggctcccactgcgtgtgcgggctgaagttcgaggccagcgaccggatgcgcatccaccgggagtccggcctctgccagggctacaagagcctgcgcgtggcccggctgctctgcaagtccaaggggagctccctgatcatcagcatcctgctctccatgctgatcctgagcttcgtcaccccgatcgagggcacgctcaccaactaccccgagtcccgcaagtacgacctggaggagatcgccgacgtgctggaggggttcatcaccgagaagggcatcaaggagtacgtggtcttctacaccagcatcttcggcgggctgttcctgctgctcgcgctgatcatcatcatcgccctgaaccgggtgacggagtacctcaccaacatcaacgtgttctactgccacgagtgctccatgtaccacagcaagaagaacatcaagtacatcggcgacttcaccaacaagtgcgggttctgcacgtgcggcgagctggaggaccaggaggggctgaagatccacaaggtctcccgcaagtgcatctacaagtaccagctcacctggagcaagatcatcatgatcatcctggtgtgcctgctgatcgcccagaacaccatcctcatcgtggccgcctccaacgactgctgggcgaagaagtccctggagatggagtgcatcggccccctgcagcgggtcgagagctgcgacgacaaggccagccgcagctactccggcgaggccaagaagctcgtgcgggccagcaagatctccgacctggacgccgcgcaggtcgggctgctcggcagcaccatcgagtccgccatcgccagcatccgcaagcagcggacctaccccacgatgcacctcctggagtccgtgttcctcgccaagcactgcgactactacaagagcttcgagcacaactccgggtacagccaggccaagtggcgcctgaccgcgaagacccaccacttcgacatctgctcccggcacagcacccaccacttctgccgctgcatctccgacggcaccaagtgccagaacggggactgggacttcgccggcgagatgaacagcacgtaccagtccaagaaggacttcttcgagcacgacttcaagctgttctgcaccctcctggagaacgccttcccgggcaccaccgagagcttctactaccagatgctgcagaagaagaacacgaccggggtggtcaagctcctggacgagctgaccaagaagttcggcaacaacaacatgttcgtggggatctggaagttcggccagtacctcatgtccctgccctacatcaacgagaccagcctgacgcccctccagctgagcaagatcctggaggcctccaaccagcaccaccgcagcatctccgggcggcaggagagcctcgcgaacgccgcctccggcggcaagagcaaggagtgcgacaacgccaagaaggtgtcctgcatcagcccccgcttcggggtcccgatggagggcctgatcgcctgcgggtccagccccaactacaagatctacaagatgcccaccaagctgtacaagtccaacaacaagggcgaggtgtggtgcagcggcgacgtgcactgcttccaggagctcaaccccgcgtcccaggagagcgtcgaccggatcaagcagatgacctgcttcctgaccgagccggagacgaacgaggacgtgttctccatcgccatcagcatgtgcaaggtgcgcgacaagggggtctgcaccatcaacgaggagcggtggaacgtgatcaagtgcgactccggcctgatctactacaccgaccagcgcgacgggcaggacaccggcaacgacttcggggagtactgcctcagccacaactgccggatcgagcgcttccccatcaaccccgccatcatcaacgactgcctgtgggagtaccactcccggcgcagcaagtacatcacgagcctggacctcgagtccctggaggagttcaagcgggccatcagcgagaagctgtcccacaccctcatcgtgtacaacttcaagcccaccgccaacctgccgcacatcaagcccgtctacaagtacatcaccgtgcagggcgtggagaacagcgacggcgtcgactccgcgtacatcacggccagcatgcccgccctgtccgggaccagcatcggctacaacatcatgtccaaggacaacttccccctcttcgacatcatcatcttcatcaagagcgccgtgatcaaggccacctacaaccacatctacgacaccgggccgacgatcggcatcaacgtgatgcacgacgagcactgcaccgggcagtgccccaccgacatcccccacaaggagaactggatcaccttctcccaggagcgcacgagccggtggggctgcgaggagttcggctgcctggcggtcaacaccgggtgcgtgttcggctcctgccaggacatcatccgcccggagaccaaggtgtaccggaaggccatcgaggagaacgtcctgctcaccgtgtgcatcacgtaccccgggaagaccttctgcaccgagatcaacgccatcgagcccaagatcaccgacgagctggagctgcagttcaagacggtggacaccaagaccctccccaacatcctggccgtccagaaccacaagctgtacagcggccagatcaacgacctcgggtccttcagccagggctgcggcaacatccagaagaccaactccagcatcatcgggaccggcacggcgaagttcgactacgtgtgccacggggcctcccgcaaggacatcatcgtgcggcgctgctacaacaacaactacgagagctgccggctgctgaaggaggagcagagcctcatgttcgccgacaaccacgagaccatcgacgtcgccaacgtgcgccacctcctgggcgacctccagttcaagctgatgctgggggacctccgctacaagtccttcgccgaggacccggacctggagatcgaggcgaagtgcgtgggctgccccagctgcttcacctcctacagctgcaacttccggatcgtctccaacatcgacaccgtgtgcagcatcgagggcccctgcacgaccttccacaaccgcctgatgatcacctccaccaagcaggactacgggatcaagatgagctgcaagggcaagcccgggtccacggaggagttccagatctgcaagaagacctacaccgtcctcttcaccacggtcgagaagaacgacaagatcgagatcaacaccggcgaccagaccagcttcatccaggagcgggacgaccgctgcaagacctggctgtgccgggtgcgcgacgagggcatctccgtgatcttcgagccgatccgggccttcttcgggagctacttctccatcgccttctacatcgtcgtgggcatcatcgtgctgttcctcatgatctacatcttcctgcccatggccttcaagctgcgcgacgtcctcaagcggaacgagtacctgtacctgcaggagatcaagcacaagtga

SEQ ID NO: 12528 - RNA, 4305 nt, synthetic construct
  misc_feature 1..4305: note = derived and/or modified CDS sequence (opt1) from BATV(MM2222)__AB257763.1__GP
  source 1..4305: mol_type = other RNA
atgctgctcctgctggtgctcctgatcagctgctgcgtctccgccagccccgtgatcacccgctgcttccacggcgggcagctgatcgccgagcggaagtcccagaccgcgatcagcgagttctgcctcaaggacgacgtgtccacgatcaagagcgagatcatctacgagaagaacgacaccggcctgttcgcccacaacaaggtcctgcgcaactggatcatcaaggactggaagaactgcaacccggtgcccaccgccgggggctccatcaacgtgatcgaggtcaacaccgacctcagcctgacgaccaagacctacgtgtgctcccgggactgcaccatcacggtggacaaggaggacgcccagatcgtcttccagaccgagaagctgaaccacttcgaggtgagcgggaccaccctctccagcggctggttcaagacgaaggcctccgtgaccctggaccggacctgcgagcacatcaaggtgacctgcggcaagaagacgctgcagttccacgcgtgcttcaagcaccacatgagctgcatccgcttcttccacgggaccatcctccccggcaccatggccacctccatctgccagaacatcgagctgatcatcatcatcagcctgacgctcatcatcttcatcctgatggtgatcctgaccaagacctacatctgctacctcctgatgcccctgttcatgccgatcgcctacttctacgggtggtcctacaacaagagctgcaagaagtgcccctgctgcggcctcgcctaccaccccttcaccaactgcgggtcccactgcgtgtgcggcctgaagttcgaggcgagcgaccgcatgcggatccaccgcgagagcggcctgtgccaggggtacaagtccctccgggtcgcccgcctgctgtgcaagagcaagggctccagcctcatcatctccatcctgctgagcatgctcatcctgtccttcgtgacgcccatcgaggggaccctgaccaactacccggagagccggaagtacaacctcgaggagatcgccgacgtgctggagggcttcgtcgtggagaagggcatcaaggagtacgtggtcttctacacctccatcttcggggccctgttcctcctgatggccctgatcgtgatcatcgcgctcaaccgcgtgacggagtacctgaccaacatcaacgtcctgtactgccacgagtgcagcatgtaccactccaagaagaacatcaagtacatcggcgacttcaccaacaagtgcgggttctgcacgtgcggcgagctcgaggaccaggaggggctgaagatccacaaggtgagccggaagtgcatctacaagtaccagctgacctggtccaagatcatcatgatgatcctcgtctgcctgctgatcgcccagaacaccatcctgatcgtggccgccagcgacgactgctggaccaagaagtccctcgagatggagtgcatcggccccctgcagcaggtcgacacgtgcgaggacaagaccagccgctcctacagcggcgaggccaagaagctggtccgggcgtccaagatcagcgacctcgacgccgcccaggtggggctgctgggcagcaccatcgagtccgccatcgccagcatccgccggcagcgcacctactccaccatgcacctcctggagagcgtgttcctggggaagcactgcgactactacaaggtcttcgagcacaactccggctacagccaggcgaagtggcggctcaccgccaagacgcaccacttcgacatctgctcccgccacagcacccaccacttctgccggtgcatctccgacgggaccaagtgccagaacggcgactgggacttcgccggcgagatgaacagcatctaccagtccaagcgcgacttcttcaagcacgacttcaagctgttctgcaccctgatcgaggacgccttccccgggacgaccgagagcctcttctacgagatgctgtccaagaagaacaccaccggcatcacgaagctgctcgacaagctgaccaagaagttcgggaacaacaacatgttcgtgggcatctggaagttcgggcagtacctgatgagcctcccctacgtgaacgagacctccctgagcccgacccagctggccaaggtcctcgaggtgacggaccaccaccaccgctccatcagcggccggcaggagagcctggcgtccgccaccagcggctccaagagctccgagtgcgaccacgccaagaaggtgagctgcatcagcccccgcttcggggtccccatggagggcctgatcgcctgcgggaactcccccaactacaagatctacaagaccccggcgaagctctacaagtccaacaacaagggcgaggtgtggtgcagcggcgacgtgcactgcttccaggagctgatccccgcctcccaggagagcgtcgaccggatcaagcagatgacctgcttcctgacggagcccgaggtgaacgacgacgtgttctccatcgccatcagcatgtgcaaggtccaggacaagggggtgtgcaccatcaacgaggaccgctggaacgtgatcaagtgcgactccggcctcatctactacaccgaccagcgggaggggcaggacaccggcaacgacttcggggagtactgcctgagccactcctgccgcatcgagcggttccccatcaacccgacgatcatcagcgactgcctgtgggagtaccactcccgcaagagcaagtacatcaccagcctcgacctggagtccctggaggagttcaagcgggccatcagcgagaagctctcccacaccctgatcgtctacaacttcaagcccaccgccaacctgccccacatcaagcccgtgtacaagtacatcacggtgcagggcgtcgagaacagcgacggcgtggactccgcgtacatcaccgccagcatgccggccctctccgggaccagcatcggctacaacatcatgtcccgcgacaacttccccctgttcgacatcatcatcttcatcaagagcgccatcatcaaggccacctacaaccacatctacgacacggggcccaccatcggcatcaacgtgatgcacgacgagcactgcaccgggcagtgccccaccgacatcccgcacaaggagaactggatcacgttcgcgcaggagcggacctcccgctggggctgcgaggagttcggctgcctggccgtcaacaccgggtgcgtgttcggcagctgccaggacatcatccggcccgagaccaaggtgtaccgcaaggccgtcgaggagtccgtgctcctgacggtgtgcatcacctaccccgggaagaccttctgcaccgagatcaacgccatcgagccgaagatcaccgacgagctggagctccagttcaagacggtcgacaccaagaccctgcccaacatcctggccgtgcagaaccacaagctctacagcggccagatcaacgacctggggtccttcagccagggctgcggcaacatccagaagaccaactccagcatcatcgggacgggcaccgcgaagttcgactacgtgtgccacggggcctcccggaaggacatcatcgtccgccggtgctacaacaacaactacgagagctgcaagctgctcaaggaggagcagagcctgatgttcgccgacaaccacgagaccatcgacgtggccaacgtgcgccacctcctcggcgacctgcagttcaagctgatgctcggggacctgcggtacaagtccttcgcggagaaccccgacctggagatcgaggccaagtgcgtcggctgccccagctgcttcacctcctacagctgctccttcaagatcgtgagcaacatcgacacggtgtgctccatcgagggcccgtgcaccaccttccacaaccgcctcatgatcaccagcacgaagcaggactacgggatcaagatgtcctgcaagaccaagcccggccccatcgaggagttccagatctgcaagaagacctacaccatcctgttcacgaccgtcgagaagaacgacaagatcgagatcagcaccggggaccagacctccttcatccaggagaaggacgaccgctgcaagacgtggctgtgccgggtgcgcgacgagggcatcagcgtgatcttcgagcccatccgggccttcttcggctcctacttcagcatcgccttctacatcgtcatcgggatcatcgtgctgttcctggtgatctacatcttcctgccgatgatgttcaagctccgcgacgtcctgaagcggaacgagtacctgtacctccaggagatcaagcacaagtga

SEQ ID NO: 12529 - RNA, 4305 nt, synthetic construct
  misc_feature 1..4305: note = derived and/or modified CDS sequence (opt1) from BATV(MM2222)__AY772534.1__GP
  source 1..4305: mol_type = other RNA
atgctgctcctgctggtgctcctgatcagctgctgcgtctccgccagccccgtgatcacccgctgcttccacggcgggcagctgatcgccgagcggaagtcccagaccgcgatcagcgagttctgcctcaaggacgacgtgtccacgatcaagagcgagatcatctacgagaagaacgacaccggcctgttcgcccacaacaaggtcctgcgcaactggatcatcaaggactggaagaactgcaacccggtgcccaccgccgggggctccatcaacgtgatcgaggtcaacaccgacctcagcctgacgaccaagacctacgtgtgctcccgggactgcaccatcacggtggacaaggaggacgcccagatcgtcttccagaccgagaagctgaaccacttcgaggtgagcgggaccaccctctccagcggctggttcaagacgaaggcctccgtgaccctggaccggacctgcgagcacatcaaggtgacctgcggcaagaagacgctgcagttccacgcgtgcttcaagcaccacatgagctgcatccgcttcttccacgggaccatcctccccggcaccatggccacctccatctgccagaacatcgagctgatcatcatcatcagcctgacgctcatcatcttcatcctgatggtgatcctgaccaagacctacatctgctacctcctgatgcccctgttcatgccgatcgcctacttctacgggtggtcctacaacaagagctgcaagaagtgcccctgctgcggcctcgcctaccaccccttcaccaactgcgggtcccactgcgtgtgcggcctgaagttcgaggcgagcgaccgcatgcggatccaccgcgagagcggcctgtgccaggggtacaagtccctccgggtcgcccgcctgctgtgcaagagcaagggctccagcctcatcatctccatcctgctgagcatgctcatcctgtccttcgtgacgcccatcgaggggaccctgaccaactacccggagagccggaagtacaacctcgaggagatcgccgacgtgctggagggcttcgtcgtggagaagggcatcaaggagtacgtggtcttctacacctccatcttcggggccctgttcctcctgatggccctgatcgtgatcatcgcgctcaaccgcgtgacggagtacctgaccaacatcaacgtcctgtactgccacgagtgcagcatgtaccactccaagaagaacatcaagtacatcggcgacttcaccaacaagtgcgggttctgcacgtgcggcgagctcgaggaccaggaggggctgaagatccacaaggtgagccggaagtgcatctacaagtaccagctgacctggtccaagatcatcatgatgatcctcgtctgcctgctgatcgcccagaacaccatcctgatcgtggccgccagcgacgactgctggaccaagaagtccctcgagatggagtgcatcggccccctgcagcaggtcgacacgtgcgaggacaagaccagccgctcctacagcggcgaggccaagaagctggtccgggcgtccaagatcagcgacctcgacgccgcccaggtggggctgctgggcagcaccatcgagtccgccatcgccagcatccgccggcagcgcacctactccaccatgcacctcctggagagcgtgttcctggggaagcactgcgactactacaaggtcttcgagcacaactccggctacagccaggcgaagtggcggctcaccgccaagacgcaccacttcgacatctgctcccgccacagcacccaccacttctgccggtgcatctccgacgggaccaagtgccagaacggcgactgggacttcgccggcgagatgaacagcatctaccagtccaagcgcgacttcttcaagcacgacttcaagctgttctgcaccctgatcgaggacgccttccccgggacgaccgagagcctcttctacgagatgctgtccaagaagaacaccaccggcatcacgaagctgctcgacaagctgaccaagaagttcgggaacaacaacatgttcgtgggcatctggaagttcgggcagtacctgatgagcctcccctacgtgaacgagacctccctgagcccgacccagctggccaaggtcctcgaggtgacggaccaccaccaccgctccatcagcggccggcaggagagcctggcgtccgccaccagcggctccaagagctccgagtgcgaccacgccaagaaggtgagctgcatcagcccccgcttcggggtccccatggagggcctgatcgcctgcgggaactcccccaactacaagatctacaagaccccggcgaagctctacaagtccaacaacaagggcgaggtgtggtgcagcggcgacgtgcactgcttccaggagctgatccccgcctcccaggagagcgtcgaccggatcaagcagatgacctgcttcctgacggagcccgaggtgaacgacgacgtgttctccatcgccatcagcatgtgcaaggtccaggacaagggggtgtgcaccatctccgaggaccgctggaacgtgatcaagtgcgacagcggcctcatctactacaccgaccagcgggaggggcaggacaccggcaacgacttcggggagtactgcctgtcccacagctgccgcatcgagcggttccccatcaacccgacgatcatctccgactgcctgtgggagtaccacagccgcaagagcaagtacatcacctccctcgacctggagagcctggaggagttcaagcgggccatctccgagaagctcagccacaccctgatcgtctacaacttcaagcccaccgccaacctgccccacatcaagcccgtgtacaagtacatcacggtgcagggcgtcgagaactccgacggcgtggacagcgcgtacatcaccgcctccatgccggccctcagcgggacctccatcggctacaacatcatgagccgcgacaacttccccctgttcgacatcatcatcttcatcaagtccgccatcatcaaggccacctacaaccacatctacgacacggggcccaccatcggcatcaacgtgatgcacgacgagcactgcaccgggcagtgccccaccgacatcccgcacaaggagaactggatcacgttcgcgcaggagcggaccagccgctggggctgcgaggagttcggctgcctggccgtcaacaccgggtgcgtgttcggctcctgccaggacatcatccggcccgagaccaaggtgtaccgcaaggccgtcgaggagagcgtgctcctgacggtgtgcatcacctaccccgggaagaccttctgcaccgagatcaacgccatcgagccgaagatcaccgacgagctggagctccagttcaagacggtcgacaccaagaccctgcccaacatcctggccgtgcagaaccacaagctctactccggccagatcaacgacctggggagcttctcccagggctgcggcaacatccagaagaccaacagctccatcatcgggacgggcaccgcgaagttcgactacgtgtgccacggggccagccggaaggacatcatcgtccgccggtgctacaacaacaactacgagagctgcaagctgctcaaggaggagcagtccctgatgttcgccgacaaccacgagaccatcgacgtggccaacgtgcgccacctcctcggcgacctgcagttcaagctgatgctcggggacctgcggtacaagagcttcgcggagaaccccgacctggagatcgaggccaagtgcgtcggctgcccctcctgcttcaccagctactcctgcagcttcaagatcgtgtccaacatcgacacggtgtgcagcatcgagggcccgtgcaccaccttccacaaccgcctcatgatcacctccacgaagcaggactacgggatcaagatgagctgcaagaccaagcccggccccatcgaggagttccagatctgcaagaagacctacaccatcctgttcacgaccgtcgagaagaacgacaagatcgagatctccaccggggaccagaccagcttcatccaggagaaggacgaccgctgcaagacgtggctgtgccgggtgcgcgacgagggcatctccgtgatcttcgagcccatccgggccttcttcggcagctacttctccatcgccttctacatcgtcatcgggatcatcgtgctgttcctggtgatctacatcttcctgccgatgatgttcaagctccgcgacgtcctgaagcggaacgagtacctgtacctccaggagatcaagcacaagtga

SEQ ID NO: 12530 - RNA, 4305 nt, synthetic construct
  misc_feature 1..4305: note = derived and/or modified CDS sequence (opt1) from BATV(MM2222)__JX846596.1__GP
  source 1..4305: mol_type = other RNA
atgctgctcctgctggtgctcctgatcagctgctgcgtctccgccagccccgtgatcacccgctgcttccacggcgggcagctgatcgccgagcggaagtcccagaccgcgatcagcgagttctgcctcaaggacgacgtgtccacgatcaagagcgagatcatctacgagaagaacgacaccggcctgttcgcccacaacaaggtcctgcgcaactggatcatcaaggactggaagaactgcaacccggtgcccaccgccgggggctccatcaacgtgatcgaggtcaacaccgacctcagcctgacgaccaagacctacgtgtgctcccgggactgcaccatcacggtggacaaggaggacgcccagatcgtcttccagaccgagaagctgaaccacttcgaggtgagcgggaccaccctctccagcggctggttcaagacgaaggcctccgtgaccctggaccggacctgcgagcacatcaaggtgacctgcggcaagaagacgctgcagttccacgcgtgcttcaagcaccacatgagctgcatccgcttcttccacgggaccatcctccccggcaccatggccacctccatctgccagaacatcgagctgatcatcatcatcagcctgacgctcatcatcttcatcctgatggtgatcctgaccaagacctacatctgctacctcctgatgcccctgttcatgccgatcgcctacttctacgggtggtcctacaacaagagctgcaagaagtgcccctgctgcggcctcgcctaccaccccttcaccaactgcgggtcccactgcgtgtgcggcctgaagttcgaggcgagcgaccgcatgcggatccaccgcgagagcggcctgtgccaggggtacaagtccctccgggtcgcccgcctgctgtgcaagagcaagggctccagcctcatcatctccatcctgctgagcatgctcatcctgtccttcgtgacgcccatcgaggggaccctgaccaactacccggagagccggaagtacaacctcgaggagatcgccgacgtgctggagggcttcgtcgtggagaagggcatcaaggagtacgtggtcttctacacctccatcttcggggccctgttcctcctgatggccctgatcgtgatcatcgcgctcaaccgcgtgacggagtacctgaccaacatcaacgtcctgtactgccacgagtgcagcatgtaccactccaagaagaacatcaagtacatcggcgacttcaccaacaagtgcgggttctgcacgtgcggcgagctcgaggaccaggaggggctgaagatccacaaggtgagccggaagtgcatctacaagtaccagctgacctggtccaagatcatcatgatgatcctcgtctgcctgctgatcgcccagaacaccatcctgatcgtggccgccagcgacgactgctggaccaagaagtccctcgagatggagtgcatcggccccctgcagcaggtcgacacgtgcgaggacaagaccagccgctcctacagcggcgaggccaagaagctggtccgggcgtccaagatcagcgacctcgacgccgcccaggtggggctgctgggcagcaccatcgagtccgccatcgccagcatccgccggcagcgcacctactccaccatgcacctcctggagagcgtgttcctggggaagcactgcgactactacaaggtcttcgagcacaactccggctacagccaggcgaagtggcggctcaccgccaagacgcaccacttcgacatctgctcccgccacagcacccaccacttctgccggtgcatctccgacgggaccaagtgccagaacggcgactgggacttcgccggcgagatgaacagcatctaccagtccaagcgcgacttcttcaagcacgacttcaagctgttctgcaccctgatcgaggacgccttccccgggacgaccgagagcctcttctacgagatgctgtccaagaagaacaccaccggcatcacggagctgctcgacaagctgaccaagaagttcgggaacaacaacatgttcgtgggcatctggaagttcgggcagtacctgatgagcctcccctacgtgaacgagacctccctgagcccgacccagctggccaaggtcctcgaggtgacggaccaccaccaccgctccatcagcggccggcaggagagcctggcgtccgccaccagcggctccaagagctccgagtgcgaccacgccaagaaggtgagctgcatcagcccccgcttcggggtccccatggagggcctgatcgcctgcgggaactcccccaactacaagatctacaagaccccggcgaagctctacaagtccaacaacaagggcgaggtgtggtgcagcggcgacgtgcactgcttccaggagctgatccccgcctcccaggagagcgtcgaccggatcaagcagatgacctgcttcctgacggagcccgaggtgaacgacgacgtgttctccatcgccatcagcatgtgcaaggtccaggacaagggggtgtgcaccatcaacgaggaccgctggaacgtgatcaagtgcgactccggcctcatctactacaccgaccagcgggaggggcaggacaccggcaacgacttcggggagtactgcctgagccactcctgccgcatcgagcggttccccatcaacccgacgatcatcagcgactgcctgtgggagtaccactcccgcaagagcaagtacatcaccagcctcgacctggagtccctggaggagttcaagcgggccatcagcgagaagctctcccacaccctgatcgtctacaacttcaagcccaccgccaacctgccccacatcaagcccgtgtacaagtacatcacggtgcagggcgtcgagaacagcgacggcgtggactccgcgtacatcaccgccagcatgccggccctctccgggaccagcatcggctacaacatcatgtcccgcgacaacttccccctgttcgacatcatcatcttcatcaagagcgccatcatcaaggccacctacaaccacatctacgacacggggcccaccatcggcatcaacgtgatgcacgacgagcactgcaccgggcagtgccccaccgacatcccgcacaaggagaactggatcacgttcgcgcaggagcggacctcccgctggggctgcgaggagttcggctgcctggccgtcaacaccgggtgcgtgttcggcagctgccaggacatcatccggcccgagaccaaggtgtaccgcaaggccgtcgaggagtccgtgctcctgacggtgtgcatcacctaccccgggaagaccttctgcaccgagatcaacgccatcgagccgaagatcaccgacgagctggagctccagttcaagacggtcgacaccaagaccctgcccaacatcctggccgtgcagaaccacaagctctacagcggccagatcaacgacctggggtccttcagccagggctgcggcaacatccagaagaccaactccagcatcatcgggacgggcaccgcgaagttcgactacgtgtgccacggggcctcccggaaggacatcatcgtccgccggtgctacaacaacaactacgagagctgcaagctgctcaaggaggagcagagcctgatgttcgccgacaaccacgagaccatcgacgtggccaacgtgcgccacctcctcggcgacctgcagttcaagctgatgctcggggacctgcggtacaagtccttcgcggagaaccccgacctggagatcgaggccaagtgcgtcggctgccccagctgcttcacctcctacagctgctccttcaagatcgtgagcaacatcgacacggtgtgctccatcgagggcccgtgcaccaccttccacaaccgcctcatgatcaccagcacgaagcaggactacgggatcaagatgtcctgcaagaccaagcccggccccatcgaggagttccagatctgcaagaagacctacaccatcctgttcacgaccgtcgagaagaacgacaagatcgagatcagcaccggggaccagacctccttcatccaggagaaggacgaccgctgcaagacgtggctgtgccgggtgcgcgacgagggcatcagcgtgatcttcgagcccatccgggccttcttcggctcctacttcagcatcgccttctacatcgtcatcgggatcatcgtgctgttcctggtgatctacatcttcctgccgatgatgttcaagctccgcgacgtcctgaagcggaacgagtacctgtacctccaggagatcaagcacaagtga

SEQ ID NO: 12531 - RNA, 4305 nt, synthetic construct
  misc_feature 1..4305: note = derived and/or modified CDS sequence (opt1) from BATV(MS50)__JX846605.1__GP
  source 1..4305: mol_type = other RNA
atgaagatgctgaccctcatcatcatcgtgagctgctgggtcgccaccctgcagaaccccctgatctcccgctgcttccacggcgggcagctcatcgccgagaagaagtccctgacgagcatcagcgagttctgcatcaaggacgacgtgtccatgctcaagagcgaggtgatctaccagaagaacgacaccggcatctacgggcactccaaggtcttccggcactggaccatcgcggactggaagtactgcaacccggtgcccaccgccggcgggagcatcaacgtgatcgagctcgacaagaacctgaacctgatcgccaagaactacgtctgcacgcgcgactgcaccatcaccgtggacaaggagaacgcccagatcgtgttccagaccgacaagctcaaccacttcgaggtcacgggcaccaccatctccaccggctggttcaagacgaaggccagcgtggcgctggaccggacctgcgagcacatcaaggtgtcctgcgggaagaagaccctgcagttccacgcctgcttcaagcagcacatgagctgcgtccgcttcctccaccggtccatgctgcccggcagcatggccaactccatctgccagaacatcgagctgatcatcatcatcaccctcacgctggtgatcttcatcctgatgctcatcgccacccgcttctacatctgctacctgctgatccccgtgttcatgccgatcgcgtacgcctacgggtgggcctacaaccggagctgcaagaagtgctcctgctgcggcctcgcctaccaccccttcaccaactgcgggagctactgcgtctgcggcgcccgcttcgagacctccgaccggatgcgcctgcaccgggagagcggcctgtgccaggggttcaagagcctccgcatggcgcggcgcctgtgcaagtccaagggcagctccctggtgatcagcatcctcctggccacgctgatcctctccttcgtgacccccatcgaggggaccatgaccaactaccccacgaacgagaagtacagcctggacgagatcgccgacgtcctgaagtggaaggagcaggagtccgagtacaagtactacgccatcctctacgccagcatcatcggcgcgtgcttcaccgtgctgttcgccggcaccgccctggccctcaacatcgtgctggagctgctcaccaagatcaacgtcatctactgcgaggagtgctccatgtaccacagcaagtccaacatcaagtacatcggggacttcacgaacaagtgcggcttctgcacgtgcgggctgctggaggacccggacggcgtggtggtccacaaggtgaagcggagctgcacctaccagtacaagctcacctgggtcaagaccatcatgatcgtgctgtccatcctgttcctcctgcagaacatcatcgtgatcgtcgccgcggacagcgactgctggaccaacgaggagctgaagcccgagtgcgtggggcccctcatcgcccccgccgactgcaccgagaaggacaagaagacctacctgacggaggccgccgcgctggtgaagaccaagaagatctcccaggtcgacgccgacaacgtggagatcctgggcaagaccatcgagagcgccatcaaggccatcgagaagcagaagacctaccaccgcatgcacctcctggaggcggtgttcctgaacaagcactgcgactactacaagctgttcgagcacaactccggctacagccaggtcaagtggcggatgctggccaagacccagcacttcgacatctgcgccttcgccaaggagtccaagttctgcaagtgcatggccgggggcgcgtgcgccgaggacagctgggacttcgacacgaccatgaacagcacctacacctccaagggggacaacttcaagcacgacatgagcctgttcctcaagatcttcgaggccgccttcccgggcacgtcctacgtgtacatgctgaacaagatcaaggagaagaagccctaccagagcgtgaccatgatcgacaagatcaagaccaagtaccccaacaacaagatgctggtcgcctacctcgagttcgggaagtgcctgatgggcgtgggccacgcgtccaccttcgagctgcagcagagccagctcgagcgcctgtaccagcccgccgagctgtcccggagcgtggggcagctcacgtccctgagcaacgcccaggtcggcaccatcaccaaggagtgctccaagtacaaggacatcagctgcctgtccccgcgcttcgggatccccatggagaacatggtggcctgcggcgacagccccaactacaagatctacaagaagcccatcaaggtgtacaaggcccacgaccgggtcgagacctggtgcatcaaggaccagcactgcctcgtggactacacgccggcggaggccgacgtggtcaagaagctgaagaccatgaagtgctggctgaacgaccccgggaccgagaccgacgcctacacgaccgccatcaagtcctgccgcatcatggacaagggcgtgtgcaccgtgaacggccagaagtggagcatcatcaagtgcgactccgacctcctgtactacaccgaccacatcgagggggaggacacgggcaacgacatcgggcactactgcatcagcgtcggctgcaagaccgaccgctaccccatcaaccccgacatcgtgaccgactgcacctgggagttcaagagccggaagtccagctacatcggcaagatctccatgcagagcctggaggactacaagaaggcgctcacggacaagctgacccacaccctggagacctactccttcgccccgacggccgacctcccccacatcaagcccatctacaagtacatcaccgcccagggggtggagaacagcgacggcatcgagggggcctacatcaccgcgaccatccccgccctgggcgggacgtccatcggctacagcgtccagtccaaggacggcttcccgctgctcgacctgatcatctacatcaaggccgccgtgatccgcagcacctacatccacctgtacgacaccgggcccaccatctccatcaacacgaagcacgacgagaagtgcaccggccagtgccccgccgagatcgagcacgaggcgaactggctcaccttcagccaggagcggacctcccgctgggggtgcgaggagttcggctgcctggccatcaacaccgggtgcgtgttcggcagctgccaggacgtcatccggccggagacgaaggtgtaccgcaagtccgtggaggaggaggtcgtgctgaccgtgtgcatcaactaccccggcaacaccttctgcaccgagatcaacgccatcgagcccaagatcacggaggaggtcgagctccagttcaagaccgtggacaccaagaccctgcccacgctgctcgccgtgaccaaccacaagctgttcagcgggcagatcaacgacctgggcaccttcgggcagatgtgcggcaacgtccagaagaccaactccagcatcctcgggtccggcacgccgaagttcgactacacgtgccacggcgccagccggaaggacatcatcgtgcgcaagtgctacaacaacaactacgacagctgcaagctgctgaaggaggagaagcagctcgtgttcaacgacgaccacgagaccatcaccgtcgtgaacaaccggcacctggtgggggagctggcgatcaagctcatcctgggcgacatccagtacaagctgttcaccgagaagctcgacctgcagatcgacgccaagtgcgtcgggtgccccgactgcttcgagtcctacgcctgcaacttccagatcgtgagcaacatcgacaccgtgtgcgccatcaacggcccctgcgacatcttccacaaccgcatctccatccggagcacccagcagaactacggggtcaagatgtcctgcaagcgcacccccgaccagaacgagaagttcgtgatctgcggccgggagtacagcgtgttcttccacacggtccagaagaacgacaagatcgagatcaacaccggcgaccagacctcctacatcaaggagatggacacccgctgcaagacgtggctgtgccgggtgcgcgacgaggggctcagcgtcatcttcgagccgatcaaggcgttcttcggctcctacttcagcatcgccttctacatcgtgctgttcatcatcatcgccttcctggtgatctacatcttcatgcccatgttcatgaagctccgggacatcctgaagcagaacgagaagctgtacctccaggagatcaagcagaagtga

SEQ ID NO: 12532 - RNA, 4305 nt, synthetic construct
  misc_feature 1..4305: note = derived and/or modified CDS sequence (opt1) from BATV(NM/12)__KJ187039.1__GP
  source 1..4305: mol_type = other RNA
atgctgctcctgctggtgctcctgatcccctgctgcgtcagcgcctccccggccatcacccgctgcttccacggcgggcagctgatcgcggagcgcaagagccagaccgccatctccgagttctgcctcaaggacgacgtgagcacgatcaagtccgagatcatctacgagaagaacgacaccggcctgttcgcccacaacaaggtgctgcggaactggatcatcaaggactggaagaactgcaaccccgtccccaccgccgggggcagcatcaacgtgatcgaggtgaacaccgacctctccctgacgaccaagacctacgtctgcagccgggactgcaccatcacggtggacaaggaggacgcccagatcatcttccgcaccgagaagctgaaccacttcgaggtgtccgggaccaccctcagctccggctggttcaagacgaaggcgagcgtcaccctggaccggacctgcgagcacatcaaggtgacctgcggcaagaagacgctgcagttccacgcctgcttcaagcaccacatgtcctgcatccgcttcttccacgggaccatcctccccggcaccatggccaccagcatctgccagaacatcgagctgatcatcatcatctccctgacgctcatcatcttcatcctgatggtgatcctgacccggacctacatctgctacctcctgatgccgctgttcatgcccatcgcctacttctacgggtggagctacaacaagtcctgcaagaagtgccagtgctgcggcctcgcgtaccaccccttcaccaactgcgggagccactgcgtctgcggcctgaagttcgaggcctccgaccgcatgcggatccaccgcgagagcggcctgtgccaggggtacaagagcctccgggtggcccgcctgctgtgcaagtccaagggcagctccctcatcatcagcatcctgctgtccatgctcatcctgagcttcgtgacgcccatcgaggggaccctgaccaactacccggagtcccggaagtacgacctcgaggagatcgccgacgtcctggagggcttcgtggtggagaagggcatcaaggagtacgtcgtgttctacaccagcatcttcggggccctgttcctcctgatggcgctgatcatcatcatcgccctcaaccgcgtgacggagtacctgaccaacatcaacgtcttctactgccacgagtgctccatgtaccacagcaagaagaacatcaagtacatcggcgacttcaccaacaagtgcgggttctgcacgtgcggcgagctggaggaccaggaggggctcaagatccacaaggtgtcccggaagtgcatctacaagtaccagctgacctggagcaagatcatcatgatgatcctggtgtgcctcctgatcgcccagaacaccatcctgatcgtcgccgcctccgacgactgctggaccaagcgcagcctggagatgggctgcatcggccccctccagcaggtcgacacgtgcgacgacaagacctcccggagctactccggggaggcgaagaagctggtgcgcgccagcaagatctccgacctggacgccgcccaggtgggcctcctggggagcaccatcgagagcgccatcgcgtccatccggaagcagcgcacctacagcaccatgcacctcctggagtccgtgttcctgggcaagcactgcgactactacaaggtcttcgagcacaacagcgggtactcccaggccaagtggcggctgaccgccaagacgcaccacttcgacatctgcagccgccactccacccaccacttctgccgctgcatcagcgacggcaccaagtgccagaacggcgactgggacttcgcctccgagatgaacagcacctaccagtccaagcgggacttcttcgagcacgacttcaagcagttctgcacgctcatcgagaacgccttccccgggaccaccgagagcctgttctacgagatgctgtccaagaagaacaccacgggcatcaccaagctcctggacaagctgaccaagaagttcgggaacaacaacatgttcgtgggcatctggaagttcgggcagtacctcatgagcctgccctacgtgaacgagacctccctgagcccgacgcagctcgcgaaggtcctggaggtgaccgaccaccaccaccgctccatcagcggccggcaggagagcctggcctccgccgcccccggcagcaagtccagcgagtgcgaccacgcgcgccgggtgtcctgcatcagcccccgcttcggggtccccatcgagggcctcaccgcctgcgggtccagcccgaactacaagatctacaagacccccgccaagctgtacaagtccaacaacaagggcgaggtgtggtgcagcggcgacgtgcactgcctgcaggagctcatccccgcgccccaggagtccgtcgaccggatcaagcagatgacgtgcttcctgaccgagccgggggtgaacgacgacatcttcagcatcgccatctccatgtgcaaggtgcaggacaagggcgtctgcaccatcaacgaggaccgctggaacgtggtgaagtgcgaccgggggctgatctactacaccgaccagcgcgagggccaggacacggggaacgacttcggcaagtactgcctcagccactcctgccggatcgagcgcttccccatcaaccccgccatcatcaacgactgcctgtgggagtaccacagccggaagtccaagtacatcaccagcctggacctcgagtccctggaggagttcaagcgcgccatcagcgagaagctgagccacaccctcatcgtccacaacttcaagcccaccgccaacctgccgcacatcaagcccgtgtacaagtacatcacggtgcagggcgtcgagaactccgacggggtggacagcgcctacatcaccgcctccatgcccgcgctgagcggcacctccatcgggtacaacatcatgagccgggacaacttccccctcttcgacatcatcatcttcatcaagtccgccatcatcaaggccacctacaaccacatctacgacacgggcccgaccatcgggatcaacgtgatccacgacgagcactgcaccggccagtgccccaccgacatcccccacaaggagaactggatcacgttcgcccaggagcgcaccagccggtggggctgcgaggagttcgggtgcctggccatcaacaccggctgcgtcttcgggtcctgccaggacatcatccgcccggagaccaaggtgtaccggaaggcggtggaggagagcgtcctgctcacggtgtgcatcacctaccccggcaagaccttctgcaccgagatcaacgccatcgagcccaagatcaccgacgagctggagctgcagttcaagacggtggacaccaagaccctccccaacatcctggccgtccagaaccacaagctgtactccgggcagatcaacgacctcggcagcttctcccagggctgcgggaacatccagaagaccaacagctccatcatcggcacggggaccgccaagttcgactacgtgtgccacggcgcgagccgcaaggacatcatcgtgcgccggtgctacaacaacaactacgagtcctgcaagctgctgaaggaggagcagagcctcatgttcgccgacaaccacgagaccatcgacgtcgccaacgtgcgccacctcctgggggacctgcagttcaagctgatgctgggcgacctccggtacaagtccttcgccgagaacccggacctggagatcgaggccaagtgcgtgggctgccccagctgcttcaccagctactcctgcagcttcaagatcgtctccaacatcgacacggtgtgcagcatcgaggggccctgcaccatcttccactcccgcctgatgatcaccagcaccaagcaggactacggcatcaagatgtcctgcaagacgaagcccgggccgaccgaggagttccagatctgcaagaagacctacaccatcctcttcacgaccatcgagaagaacgacaagatcgagatcagcaccggcgaccagacctccttcatccaggagcgggacgaccgctgccggacgtggctgtgccgcgtgcgggacgagggcatcggggtcatcttcgagcccatccgcgcgttcttcggcagctacttctccatcgccttctacatcgtgatcgggatcatcatcctgttcctcgtgatctacatcttcctgcccatggtcttcaagctgcgggacgtgctcaagcgcaacgagtacctgtacctgcaggagatcaagcacaagtga

SEQ ID NO: 12533 - RNA, 4305 nt, synthetic construct
  misc_feature 1..4305: note = derived and/or modified CDS sequence (opt1) from BATV(ON-1/E/94)__AB257764.1__GP
  source 1..4305: mol_type = other RNA
atgctgctgttcctggtgctgctcatcagctgctacgtctccgccagccccgtgatcacccgctgcttccacggcgggcagctgatcgccgagcggaagtcccagaccgcgatcagcgagttctgcctgaaggacgacgtgtccacgatcaagagcgagatcatctacgagaagaacgacaccggcctcttcgcccactccaaggtcctgcgcaactggatcatcaaggactggaagaactgcaacccggtgcccaccgccgggggcagcatcaacgtgatcgaggtcaacgccgacctgtccctcgccaccaagacgtacgtgtgcagccgggactgcaccatcaccgtggacaaggaggacgcgcagatcgtcttccagaccgagaagctgaaccacttcgaggtgtccgggacgaccctgagctccggctggttcaagaccaaggccagcgtgaccctcgaccgcacgtgcgagcacatcaaggtgacctgcggcaagaagaccctgcagttccacgcctgcttcaagcaccacatgtcctgcatccggttcttccacgggaccatcctgcccggcacgatggccaccagcatctgccagaacatcgagctcatcatcatcatctccctgaccctgatcatcttcatcctcatggtcatcctgaccaagacgtacatctgctacctgctcatgcccctgttcatgccgatcgcgtacttctacgggtggagctacaacaagtcctgcaagaagtgcagctgctgcggcctggcctaccaccccttcaccaactgcgggagccactgcgtgtgcggcctcaagttcgaggcctccgaccgcatgcggatccaccgcgagagcggcctgtgccaggggtacaagtccctgcgggtcgcccgcctcctgtgcaagagcaagggctccagcctgatcatctccatcctcctgagcatgctgatcctctccttcgtgacccccatcgaggggaccctgacgaactaccccgagagccggaagtacgacctggaggagatcgccgacgtgctcgagggcttcgtcgtggagaagggcatcaaggagtacgtggtcttctacacctccatcttcggggcgctgttcctgctcatggccctgatcgtgatcatcgccctgaaccgcgtgaccgagtacctcaccaacatcaacgtcctgtactgccacgagtgcagcatgtaccactccaagaagaacatcaagtacatcggcgacttcacgaacaagtgcgggttctgcacgtgcggcgagctggaggaccaggaggggctcaagatccacaaggtgagccggaagtgcatctacaagtaccagctgacctggtccaagatcatcatgatcatcctggtctgcctcctgatcgcccagaacaccatcctgatcgtggccgcgagcgacgactgctggaccaagaagtccctggagatggagtgcgtgggcccgctccagcaggtcgacacgtgcgaggacaagaccagccgctcctacagcggcgaggccaagaagctggtgcgggccagcaagatctccgacctggacgccgcccaggtggggctcctgggcagcaccatcgagtccgcgatcgccagcatccgcaagcagcggacctactccaccatgcacctcctcgagagcgtcttcctggggaagcactgcgactactacaaggtgttcgagcacaactccggctacagccaggccaagtggcgcctgaccgccaagacccaccacttcgacatctgctcccggcacagcacccaccacttctgccgctgcatctccgacgggacgaagtgccagaacggcgactgggacttcgccggcgagatgaacagcacctaccagtccaagcgggacttcttcgagcacgacttcaagctgttctgcaccctgatcgagaacgcgttccccgggaccacggagagcctgttctacgagatgctctccaagaagaacaccaccggcatcaccaagctgctggacaagctcacgaagaagttcgggaacaacaacatgttcgtgggcatctggaagttcgggcagtacctgatgagcctgccctacgtcaacgagacctccctcagccccacccagctggccaaggtgctggaggtgaccgaccacctccaccgcagcatctccggccgccaggagctgctgacgagcgccaccccgggctccaagagctccgagtgcgaccacgccaagaaggtcagctgcatcagcccccggttcggggtgcccatggagggcctcatcgcgtgcgggaactccccctcctacaagatctacaagaccccgaccaagctgtacaagagcaacaacaagggcgaggtgtggtgctccggcgacgtccactgcttccaggagctgatccccgccagccaggagtccgtggaccgcatcaagcagatgacgtgcttcctcaccgagcccgaggtgagcgacgacgtcttctccatcgccatcagcatgtgcaaggtgcaggacaagggggtgtgcaccatcaacgaggaccggtggaacgtcatcaagtgcgactccggcctgatctactacaccgaccagcgcgaggggcaggacacgggcaacgacctgggggagtactgcctcagccactcctgccggatcgagcgcttccccatcaacccgatcatcatcagcgactgcctgtgggagtaccacagccggaagtccaagtacatcaccagcctggacctcgagtccctggaggagttcaagcgcgccatcagcgagaagctgtcccacaccctcatcgtgtacaacttcaagcccaccgccaacctgccccacatcaagcccgtgtacaagtacatcacggtccagggcgtggagaacagcgacggcgtggactccgcgtacatcaccgccagcatgccggccctgtccgggaccagcatcggctacaacatcatgtcccgggacaacttccccctcttcgacatcatcatcttcatcaagagcgccatcatcaaggccacctacaaccacatctacgacacggggcccaccatcggcatcaacgtcatgcacgacgagcactgcaccgggcagtgccccaccgacatcccgcacaaggagaactggatcacgttcgcgcaggagcgcacctcccggtggggctgcgaggagttcggctgcctggccgtgaacaccgggtgcgtgttcggcagctgccaggacatcatccgccccgagaccaaggtctaccggaaggccgtggaggagtccgtgctgctcacggtctgcatcacctaccccgggaagaccttctgcaccgagatcaacgccatcgagccgaagatcaccgacgagctggagctgcagttcaagacggtggacaccaagaccctccccaacatcctggccgtgcagaaccacaagctgtacagcggccagatcaacgacctcgggtccttcagccagggctgcggcaacatccagaagaccaactccagcatcatcgggacgggcaccgcgaagttcgactacgtctgccacggggccagccgcaaggacatcgtggtgcggcgctgctacaacaacaactacgagtcctgcaagctgctgaaggaggagcagagcctcatgttcgccgacaaccacgagaccatcgacgtcgccaacgtgcggcacctcctgggcgacctccagttcaagctgatgctgggggacctccgctacaagtccttcgcggagaaccccgacctggagatcgaggccaagtgcgtgggctgccccagctgcttcacctcctacagctgctccttcaagatcgtcagcaacatcgacacggtgtgctccatcgagggcccgtgcaccaccttccacaaccggctgatgatcaccagcacgaagcaggactacgggatcaagatgtcctgcaagaccaagcccggccccaccgaggagttccagatctgcaagaagacctacacgatcctcttcaccaccgtggagaagaacgacaagatcgagatcagcaccggggaccagacgtccttcatccaggagaaggacgaccgctgcaagacctggctgtgccgcgtccgggacgagggcatcagcgtgatcttcgagcccatccgcgccttcttcggctcctacttcagcatcgccttctacatcgtgatcgggatcatcgtcctgttcctcgtgatctacatcttcctgccgatgatcttcaagctgcgggacgtgctcaagcgcaacgagtacctgtacctgcaggagatcaagcacaagtga

SEQ ID NO: 12534 - RNA, 4305 nt, synthetic construct
  misc_feature 1..4305: note = derived and/or modified CDS sequence (opt1) from BATV(ON-7/B/01)__AB257765.1__GP
  source 1..4305: mol_type = other RNA
atgctgctcctgctggtgctcctgatcccctgctgcgtcagcgcctccccggtgatcacccgctgcttccacggcgggcagctgatcgccgagcgcaagagccaggcggccatctccgagttctgcctcaaggacgacgtgagcaccatcaagtccgagatcatctacgagaagaacgacacgggcctgttcgcccacaacaaggtcctgcgcaactggatcatcaaggactggaagaactgcaaccccgtgcccaccgccgggggcagcatcaacgtgatcgaggtcaacaccgacctctccctgaccacgaagacctacgtgtgcagccgggactgcaccatcaccgtggacaaggaggacgcccagatcatcttccagacggagaagctgaaccacttcgaggtctccgggaccaccctcagctccggctggttcaagaccaaggcgagcgtgacgctggaccggacctgcgagcacatcaaggtgacctgcggcaagaagaccctgcagttccacgcctgcttcaagcaccacatgtcctgcatccggttcttccacgggacgatcctccccggcaccatggccaccagcatctgccagaacatcgagctgatcatcatcatctccctgaccctcatcatcttcatcctgatggtcatcctgacgaagacctacatctgctacctcctgatgccgctgttcatgcccatcgcctacttctacgggtggagctacaacaagtcctgcaagaagtgcccctgctgcggcctcgcgtaccaccccttcaccaactgcgggagccactgcgtgtgcggcctgaagttcgaggcctccgaccgcatgcggatccaccgcgagagcggcctgtgccaggggtacaagagcctccgggtggcccgcctgctgtgcaagtccaagggcagctccctcatcatcagcatcctgctgtccatgctcatcctgagcttcgtcaccccgatcgaggggacgctgaccaactaccccgagtcccggaagtacgacctcgaggagatcgccgacgtgctggagggcttcatcgtggagaagggcatcaaggagtacgtcgtgttctacaccagcatcttcggggccctgttcctcctgatcgcgctgatcgtgatcatcgccctcaaccgcgtcaccgagtacctgacgaacatcaacgtgctgtactgccacgagtgctccatgtaccacagcaagaagaacatcaagtacatcggcgacttcaccaacaagtgcgggttctgcacgtgcggcgagctcgaggaccaggaggggctgaagatccacaaggtgtcccggaagtgcatctacaagtaccagctgacctggagcaaggtcatcatgatgatcctcgtgtgcctgctgatcgcccagaacaccatcctgatcgtcgccgcctccgacgactgctggaccaagaagtccctcgagatgggctgcatcggccccctgcagcaggtcgacacgtgcgacgacaaggcgtcccgcagctactccggggaggccaagaagctggtgcgggccagcaagatctccgacctcgacgccgcccaggtgggccagctggggagcaccatcgagagcgcgatcgcctccatccgccggcagcgcacctacagcaccatgcacctcctggagtccgtgttcctgggcaagcactgcgactactacaaggtgttcgagcacaacagcgggtactcccaggccaagtggcggctgaccgccaagacccaccacttcgacatctgcagccgccactccacccaccacttctgccggtgcatcagcgacggcacgaagtgccagaacggcgactgggacttcgccggggagatgaactccacctaccagagcaagcgcgacttcttcgagcacgacttcaacctcttctgcaccctgatcgagaacgcgttccccggcaccacggagtccctgttctacgagatgctcagcaagaagaacaccaccgggatcaccaagctgctggacaagctcacgaagaagttcggcaacaacaacatgttcgtcgggatctggaagttcggccagtacctgatctccctgccgtacgtgaacgagaccagcctctcccccacccagctggccaaggtgctggtcgtgaccgaccagcaccaccgcagcatctccggccggcaggagagcctcgccagcgccacgcccgggtccaagagctccgagtgcggccacgcgaagaaggtgagctgcatcagcccccgcttcggggtcccgatggagggcctgatggcctgcggcagctcccccaactacaagatctacaagacccccgccaagctgtacaagagcaacaacaagggggaggtgtggtgctccggcgacgtgcactgcttccaggacctcatccccgccagccaggagtccgtcgaccggatcaagcagatgacctgcttcctgaccgagccggaggtgaacgacgacgtgttcagcatcgccatcgcgatgtgcaaggtccaggacaagggggtgtgcacgatcaacgaggaccgctggaacctgatcaagtgcgactccggcctcatctactacaccgaccagcgggaggggcaggacaccggcaacgacttcggcgagtactgcctgagccacaactgcaagatggagcgcttccccatcaaccccgccatcatctccgactgcctgtgggagtaccacagccggaagtccaagtacatcaccagcctcgacctggagtccctggaggagttcaagcgcgccatcagcgagaagctcagccacacgctggtggtctacaacttcaagcccaccgccaacctgccgcacatcaagcccgtgtacaagtacatcaccgtgcagggggtcgagaactccgacggcgtggacagcgcctacatcaccgcgtccatgcccgccctcagcgggacgtccatcggctacaacatcatgagccgggacaacttccccctgttcgacatcatcatcttcatcaagtccgccatcatcaaggccacctacaaccacatctacgacaccgggccgaccatcggcatcaacgtgatgcacgacgagcactgcacgggccagtgccccaccgacatcccccacaaggagaactggatcaccttcgcccaggagcgcaccagccggtgggggtgcgaggagttcggctgcctggcggtcaacacggggtgcgtgttcggctcctgccaggacatcatccgcccggagaccaaggtgtaccggaaggccgtcgaggagagcgtgctcctgaccgtgtgcatcacctaccccgggaagacgttctgcaccgagatcaacgccatcgagcccaagatcaccgacgagctggagctccagttcaagaccgtcgacaccaagacgctgcccaacatcctggccgtgcagaaccacaagctctactccggccagatcaacgacctgggcagcttctcccaggggtgcggcaacatccagaagaccaacctgagcatcatcgggaccggcaccgcgaagttcgactacgtgtgccacggggcctcccgcaaggacatcatcgtccggcgctgctacaacaacaactacgagagctgcaagctcctgaaggaggagcagtccctgatgttcgccgacaaccacgagacgatcgacgtggccaacgtgcggcacctcctgggcgacctgcagttcaagctcatgctgggcgacctgcgctacaagagcttcgccgagaacccggacctcgagatcgaggcgaagtgcgtcgggtgcccctcctgcttcaccagctacagctgcaacttcaagatcgtgtccaacatcgacaccgtgtgcagcatcgagggcccctgcaccacgttccacaaccggctgatgatcacctccgccaagcaggactacgggatcaagatgagctgcaagaccaagcccggcctgaccgaggagttccagatctgcaagaagacgtacaccgtcctcttcgccaccgtggagaagaacgacgagatcgagatctccaccggcgaccagacgagcttcatccaggagcgcgacgaccgctgcaagacctggctgtgccgggtgcgcgacgaggggatctccgtcatcttcgagccgatccgggccttcttcggcagctacttctccatcgccttctacatcgtgatcgggatcatcgtgctgttcctcgtcatctacatcttcctgcccatggtgttcaagctgcgcgacgtgctcaagcggaacgagtacctgtacctgcaggagatcaagcacaagtga

SEQ ID NO: 12535 - RNA, 4305 nt, synthetic construct
  misc_feature 1..4305: note = derived and/or modified CDS sequence (opt1) from BATV(UgMP-6830)__DQ436460.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacaacaaggtgctgcggaactggatcatcaaggactggaagaactgcaaccccgtccccaccgccgggggcagcatcaacgtgatcgaggtgaacacggacctctccctgaccaccaagacctacgtctgcagccgcgactgcacgatcaccgtggacaaggaggacgcccagatcatcttccagaccgagaagctgaaccacttcgaggtgtccgggaccacgctcagctccggctggttcaagaccaaggccagcgtcaccctggaccggacctgcgagcacatcaaggtgacgtgcggcaagaagaccctgcagttccacgcgtgcttcaagcaccacatgtcctgcatccgcttcttccacgggaccatcctccccggcaccatggccacgagcatctgccagaacatcgagctgatcatcatcatctccctgaccctcatcatcttcatcctgatggtgatcctgaccaagacctacatctgctacctcctgatgccgctgttcatgcccatcgcctacttctacgggtggagctacaacaagtcctgcaagaagtgcagctgctgcggcctcgcctaccaccccttcacgaactgcgggtcccactgcgtctgcggcctgaagttcgaggcgagcgaccggatgcgcatccaccgggagagcggcctgtgccaggggtacaagtccctccgcgtggcccggctgctgtgcaagagcaagggctccagcctcatcatctccatcctgctgagcatgctcatcctgtccttcgtgacccccatcgaggggaccctgaccaactacccggagagccgcaagtacgacctcgaggagatcgccgacgtcctggagggcttcatcgtggagaagggcatcaaggagtacgtggtcttctacacgtccatcttcggggccctgttcctcctgatggccctggtgatcatcatcgcgctcaacaaggtgaccgagtacctgaccaacatcaacgtcctgtactgccacgagtgcagcatgtaccactccaagaagaacatcaagtacatcggcgacttcaccaacaagtgcgggttctgcacgtgcggcgagctcgaggaccaggaggggctgaagatccacaaggtgagccggaagtgcatctacaagtaccagctgacctggtccaagatcatcatgatgatcctcgtctgcctgctgatcgcccagaacaccatcctgatcgtggccgccagcgacgactgctggaccaagaagtccctcgagatggagtgcatcggccccctgcagcaggtcgacacgtgcgacgacaagagctcccgcagctactccggcgaggccaagaagctggtgcgggcgagcaagatcagcgacctcaacgccgcccaggtggggctgctgggctccaccatcgagagcgccatcgcctccatccgcaagcagcggacctacagcaccatgcacctcctggagtccgtgttcctggggaagcactgcgactactacaaggcgttcgagcacaacagcggctactcccaggccaagtggcgcctcaccgccaagacgcaccacttcgacatctgcagccggcactccacccaccacttctgccgctgcatcagcgacgggaccaagtgccagaacggcgactgggacttcgccggcgagatgaactccacctaccagagcaagaaggacttcttcgagcacgacctgaagctgttctgcacgctcgtcgagaacgccttccccgggaccaccgagtccctgttctacgagatgctgagcaagaagaacaccacgggcgtgaagaagctcctggacaagctgaccaagaagttcgggaacaacaacatgttcgtgggcatctggaagttcgggcagtacctcatgtccctgccctacgtcaacgagaccagcctgaccccggcgcagctcgccaagatcctggaggtgacggaccagcaccaccggtccatcagcggccgccaggagagcctggcctccgccacccccggcagcaagtccaaggagtgcgggcacgcgaagaaggtgagctgcatcagcccccggttcggcgtccccatggaggggctcctggcctgcggcgacagcccgaactacaagatctacaagacccccgccaagctgtacaagtccaacaacaagggcgaggtgtggtgcagcggggacgtgcactgctcccaggagctcagccccgcctcccaggagagcgtcgaccgcatcaagcagatcacgtgcttcctgaccgagcccgaggtgtccgacgacgtgttcagcatcgccatctccacgtgcaaggtccaggacaagggcgtgtgcaccgtgaacgaggaccgctggaacgtcatcaagtgcgacagcgggctgatctactacaccgaccagcgggacggccaggacaccgggaacgacttcggcgagtactgcctctcccacagctgccgcatcgagcggttcccgatcaaccccgcgatcatctccgactgcctgtgggagtaccacagccgcaagagcaagtacatcacctccctggacctcgagagcctggaggagttcaagcgggccatctccgagaagctgagccacaccctcatcgtgtacaacttcaagcccaccgccaacctgccccacatcaagccgatctacaagtacatcacggtgcagggcgtcgagaactccgacggggtggacagcgcctacatcaccgcctccatgcccgcgctgagcggcacctccatcgggtacaacatcatgagccgcgacaacttccccctcttcgacatcatcatcttcatcaagtccgccatcatcaaggccacctacaaccacatctacgacacgggccccaccatcgggatcaacgtgatgcacgacgagcactgcaccggccagtgcccgaccgacatcccccacaaggagaactggatcacgttcgcccaggagcggaccagccgctggggctgcgaggagttcgggtgcctggccgtcaacaccggctgcgtgttcgggtcctgccaggacatcatccggcccgagaccaaggtgtaccgcaaggcggtcgaggagagcgtgctgctcacggtgtgcatcacctacccgggcaagaccttctgcaccgagatcaacgccatcgagcccaagatcaccgacgagctggagctgcagttcaagacggtcgacaccaagaccctccccaacatcctggccgtgcagaaccacaagctgtactccgggcagatcaacgacctcggcagcttctcccagggctgcgggaacatccagaagaccaacagctccatcatcggcacggggaccgccaagttcgactacgtgtgccacggcgcgagccggaaggacatcatcgtccgccggtgctacaacaacaactacgagagctgcaagctgctgaaggaggagcagtccctcatgttcgccgacaaccacgagaccatcgacgtggccaacgtgcgccacctcctgggggacctgcagttcaagctgatgctgggcgacctccggtacaagagcttcgccgagaaccccgacctggagatcgaggccaagtgcgtcggctgcccgtcctgcttcaccagctactcctgcagcttcaagatcgtgtccaacatcgacacggtgtgcagcatcgaggggccctgcaccaccttccacaaccgcctgatgatcacctccacgaagcaggactacggcatcaagatgagctgcaagaccaagcccgaggagaccgaggagttccagatctgcaagaagacctacacggtcctcttcaccaccgtggagaagaacgacaagatcgagatctccaccggggaccagacgagcttcatccaggagcgggacgaccgctgcaagacctggctgtgccgggtgcgcgacgagggcatctccgtcatcttcgagcccatccgcgcgttcttcggcagctacttctccatcgccttctacgtggtggtcagcatcatcgtgctgttcctcgccatctacatcttcctgccgatggtgttcaagctgcgggacgtcctcaagaagaacgagtacctgtacctgcaggagatcaagcacaagtga

SEQ ID NO: 12536 - RNA, 4305 nt, synthetic construct
  misc_feature 1..4305: note = derived and/or modified CDS sequence (opt1) from BATV(ZJ2014)__KU746870.1__GP
  source 1..4305: mol_type = other RNA
atgctggtgctcctggtcctgctcatcccctgctgcgtgagcgcctccccggccatcacccgctgcttccacggcgggcagctgatcgcggagcgcaagagccagaccgccatctccgagttctgcctgaaggacgacgtgagcacgatcaagtccgagatcatctacgagaagaacgacaccggcctcttcgcccacaacaaggtcctgcgcaactggatcatcaaggactggaagaactgcaaccccgtgcccaccgccgggggcagcatcaacgtgatcgaggtcaacaccgacctgtccctcacgaccaagacctacgtgtgcagccgggactgcaccatcacggtggacaaggaggacgcccagatcatcttccagaccgagaagctgaaccacttcgaggtctccgggaccaccctgagctccggctggttcaagacgaaggcgagcgtgaccctcgaccggacctgcgagcacatcaaggtgacctgcggcaagaagacgctgcagttccacgcctgcttcaagcaccacatgtcctgcatccggttcttccacgggaccatcctgcccggcaccatggccaccagcatctgccagaacatcgagctcatcatcatcatctccctgacgctgatcatcttcatcctcatggtcatcctgacccgcacctacatctgctacctgctcatgccgctgttcatgcccatcgcctacttctacgggtggagctacaacaagtcctgcaagaagtgccagtgctgcggcctggcgtaccaccccttcaccaactgcgggagccactgcgtgtgcggcctcaagttcgaggcctccgaccggatgcgcatccaccgggagagcggcctgtgccaggggtacaagagcctgcgcgtggcccggctcctgtgcaagtccaagggcagctccctgatcatcagcatcctcctgtccatgctgatcctcagcttcgtcacgcccatcgaggggaccctgaccaactacccggagtcccgcaagtacgacctggaggagatcgccgacgtgctcgagggcttcgtggtcgagaagggcatcaaggagtacgtggtgttctacaccagcatcttcggggccctgttcctgctcatggcgctgatcgtcatcatcgccctgaaccgggtgacggagtacctcaccaacatcaacgtgttctactgccacgagtgctccatgtaccacagcaagaagaacatcaagtacatcggcgacttcaccaacaagtgcgggttctgcacgtgcggcgagctggaggaccaggaggggctgaagatccacaaggtctcccgcaagtgcatctacaagtaccagctcacctggagcaagatcatcatgatgatcctggtgtgcctgctcatcgcccagaacaccatcctgatcgtcgccgcctccgacgactgctggaccaagaagtccctggagatgggctgcatcggccccctgcagcaggtcgacacgtgcgacgacaagaccagccggagctactccggggaggcgaagaagctcgtgcgcgccagcaagatctccgacctggacgccgcccaggtgggcctgctcgggagcaccatcgagagcgccatcgcgtccatccggaagcagcgcacctacagcaccatgcacctcctggagtccgtgttcctgggcaagtactgcgactactacaaggtgttcgagcacaacagcgggtactcccaggccaagtggcggctgaccgccaagacgcaccacttcgacatctgcagccgccactccacccaccacttctgccggtgcatcagcgacggcaccaagtgccagaacggcgactgggacttcgcctccgagatgaacagcacctaccagtccaagcgcgacttcttcgagcacgacttcaaggtcttctgcacgctgatcgagaacgccttccccgggaccaccgagagcctcttctacgagatgctgtccaagaagaacaccacgggcatcaccaagctgctcgacaagctgaccaagaagttcgggaacaacaacatgttcgtgggcatctggaagttcgggcagtacctgatgagcctcccctacgtgaacgagacctccctgagcccgacgcagctggcgaaggtcctcgaggtgaccgaccaccaccaccgctccatcagcggccggcaggagagcctggcctccgccgcccccggcagcaagtccagcgagtgcgaccacgcgaagaaggtgtcctgcatcagcccccgcttcggggtccccatcgagggcctgaccgcctgcgggtccagcccgaactacaagatctacaagacccccgccaagctctacaagtccaacagcaagggcgaggtgtggtgctccggcgacgtgcactgcctgcaggagctgatccccgccagccaggagtccgtcgaccggatcaagcagatgacgtgcttcctcaccgagcccggggtgaacgacgacatcttcagcatcgccatctccatgtgcaaggtgcaggacaagggcgtctgcaccatcaacgaggaccgctggaacgtggtgaagtgcgacagcgggctgatctactacaccgaccagcgggagggccaggacacggggaacgacttcggcgagtactgcctgtcccacagctgccgcatcaagcggttcccgatcaaccccgcgatcatcaacgactgcctctgggagtaccactcccgcaagagcaagtacatcaccagcctggacctggagtccctcgaggagttcaagcgggccatcagcgagaagctgtcccacaccctgatcgtctacaacttcaagcccaccgccaacctcccccacatcaagccggtgtacaagtacatcacggtgcagggcgtcgagaacagcgacggggtggactccgcctacatcaccgccagcatgcccgcgctgtccggcaccagcatcgggtacaacatcatgtcccgcgacaacttccccctgttcgacatcatcatcttcatcaagagcgccatcatcaaggccacctacaaccacatctacgacacgggccccaccatcgggatcaacgtgatccacgacgagcactgcaccggccagtgcccgaccgacatcccccacaaggagaactggatcacgttcgcccaggagcggacctcccgctggggctgcgaggagttcgggtgcctcgccatcaacaccggctgcgtcttcgggagctgccaggacatcatccggcccgagaccaaggtgtaccgcaaggcggtggaggagtccgtcctgctgacggtgtgcatcacctacccgggcaagaccttctgcaccgagatcaacgccatcgagcccaagatcaccgacgagctcgagctgcagttcaagacggtggacaccaagaccctgcccaacatcctcgccgtccagaaccacaagctgtacagcgggcagatcaacgacctgggctccttcagccagggctgcgggaacatccagaagaccaactccagcatcatcggcacggggaccgccaagttcgactacgtgtgccacggcgcgtcccggaaggacatcatcgtgcgccggtgctacaacaacaactacgagagctgcaagctcctgaaggaggagcagagcctgatgttcgccgacaaccacgagaccatcgacgtcgccaacgtgcgccacctcctgggggacctgcagttcaagctcatgctgggcgacctgcggtacaagtccttcgccgagaaccccgacctcgagatcgaggccaagtgcgtgggctgcccgagctgcttcacctcctacagctgctccttcaagatcgtcagcaacatcgacacggtgtgctccatcgacgggccctgcaccatcttccacaaccgcctgatgatcaccagcaccaagcaggactacggcatcaagatgtcctgcaagacgaagcccgggcccaccgaggagttccagatctgcaagaagacctacaccatcctgttcacgaccatcgagaagaacgacaagatcgagatcagcaccggcgaccagacctccttcatccaggagcgcgacgaccggtgccgcacgtggctctgccgggtgcgcgacgagggcatcagcgtcatcttcgagccgatccgggcgttcttcgggtcctacttcagcatcgccttctacatcgtgatcggcatcatcatcctgttcctggtgatctacatcttcctccccatggtcttcaagctgcgcgacgtgctgaagcggaacgagtacctctacctgcaggagatcaagcacaagtga

SEQ ID NO: 12537 - RNA, 4305 nt, synthetic construct
  misc_feature 1..4305: note = derived and/or modified CDS sequence (opt1) from CVV__AF082576.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggcctccctgctcgggaacagcatcgactccgccatcaaggccatccgggcgcagaagacctaccccaccatgcacctcctggagacgatcttcctcatgaagaactgcgactactacaccagcttcaaccacaactccggctacagccaggccaagtggcgcctgatcgccaagaccgggcacttcgacatctgctcccggcacagcacccaccacttctgccagtgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggcgagcaaggtgctcggcaagctgatcaccaagtacgggaacaacaacatgttcgtcggcatctggaagttcggccagtacctgctcacgctgccctacatcaacaacaccgagctgtcccagaaccgccggctcaccatcctggccacccaggagctgctcagccgcagccactccgggcggcaggagagcatgtccaacgccatccagggcagcatcacgaaggagtgccacaacgccaagggggtgggctgcatctccccgcagttcggcatccccatcgggaacctgaccgcgtgcggcgacagccccaactacaagatctacaagacccccgagaagctgtacaagtccaacaacaagggggaggtgtggtgcagcaacgacgtccactgcctcaacgacttcgagccggccgacgaggaggtggtgaacaagatcaagaagctgacctgcttcctgacggacgtctccgtggaggtggacatcttcagcgtcgccgcctccacgtgcaagatggccgacaagggcgtgtgcaccgtgaacggggcgaagtggaacatcatcaagtgcgacagcggcctctactacttcaccgaccaccgcgagggccaggacaccgggaacgacttcggcgagtactgcatctcccacagctgcaacaccgagcgcttccccatcaaccccgacaccctgaaggactgcacctgggagttccactcccgcaagagcaagtacatctccacgatcagcctggagtccctcgaggagttccggcgggccatggccgagaagctgagccacaccctgaccatctacaacttcaagcccaccgccaacctcccgcacatccgccccacgtacaagttcatcaccgccaacggggtcgagaacagcgacggcatcgagtccgcgtacatcctgagctccatccccgccctcgggggcatcagcgtgggctacaacgtgcagaccaaggacaacttccccctgctggacatcatcgtcttcatcaagtccgccgtgatccggaccacgtacaaccacatctacgacaccgggccgaccatcggcatcaacacccagcacgacgagcactgcaccgggccctgccccgccgtggtcccccacaaggagaactggatgacgttcagccaggagcgcacctcccggtggggctgcgaggagttcgggtgcctggccatcaacaccggctgcgtgttcggcagctgccaggacatcatccacccggagaccaaggtgtaccgcaaggcggtcgaggaggaggtggtgctcacggtctgcatcaacttccccgggaacaactactgcaccgagatcaacgccatcgagcccaagatcaccgacgagatcgagctgcagttcaagaccgtggacacgaagaccctgccgaacctcctggccgtgcagaaccacaagctgtactccggccagatcaacgacctcgggagcttctcccagggctgcgggaacgtccagaagaccaaccacagcatcctgggcatgggcaccgtgaagttcgactacgtgtgccacggggcctcccggaaggacgtcatcgtgcgccggtgctacaacaacaacttcgacagctgcaagctgctcaaggaggagacgtccctgatcttcgcggacaaccacgagaccctggaggtggcccacaccaagcacctcatcggcgagctgcagttcaagatcatgctgggggacatccgctacaagagcttcgccgagtcccccgagctcgagatcgacgccaagtgcgtcggctgccccagctgcttcgagtcctacagctgcaacttccagatcgtgagcaacatcgacaccgtgtgctccgtcgagggcccctgcacgctgttccacaaccggatcatcatcagcgccaacaagcagtcctacgggctgaagatgagctgccagaccaagccgaaccagaacgaggagttcatcatctgcaaccgcaagtactccgtgctgttcaccaccatcgacaagaacgacaagatcgaggtgaacacgggcgaccagaccagctacatctacgagaaggactcccggtgcaagacctggctgtgccgcgtccgggacgaggggatcagcgtgctgttcgagcccctcaaggcgttcttcggctcctacttcagcatcatcttctacgtggtcgtggggatcatcgtgctgttcctgatcatctacatcttcctccccatgttcttcaagctgaaggacgtcctgaagcgcaacgagtacctctacctgcaggagctgaagcacaagtga

SEQ ID NO: 12538 - RNA, 4305 nt, synthetic construct
  misc_feature 1..4305: note = derived and/or modified CDS sequence (opt1) from CVV(Montgomery County/VA/2015 4b)__KX583998.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacaccaagaacgacaccgggctgttcggccacaacaaggtgttccggagctggaccatcaaggactggaagctgtgcaacccgatccccacggccgggggcaccatcaacgtcatcgaggtgaacaaggacctctccctgatgaccaagacctacatctgcagccgcgactgcacgatcaccatcgacaaggaggaggcccagatcatcttccagaccgacaagctgaaccacttcgaggtgtccggcaccacgctcaacagcgggtggttcaagtccaaggccagcgtcaccctggaccggacctgcgagcacgtgaaggtgacctgcggcaagaagtccctgcagttccacgcgtgcttcaagcaccacatgagctgcgtccgcttcttccacaacacgatcctccccgggaacatgatcaactccatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagagctgcaagaagtgcaactgctgcggcctggcgtaccaccccttcacgaactgcggctcccactgcgtgtgcgggctgaagttcgaggccagcgaccggatgcgcatccaccgggagagcggcctctgccaggggtacaagtccctgcgcatcgcccggctgctctgcaagagcaagggctccagcctggtcatctccggcctgctcagcatgctgatcctgtccttcgtgacccccatcgaggggaccatcaccagctaccccgagtcccgcaagtacacgctcgaggagatcaccgacgtggtcgagggcctggtgagcgagcagaacatcaaggagtacatcgtgttctacacctccctgttcgggagcctcatcctgctgctcgccttcatcatgtccatcaccctgagcaagatcacgtccatcctggcccggcgcaacgtcatctactgcgaggagtgcagcatgtaccactccaagcggggcatcaagtacaacggggacttcaccaacaagtgcggcttctgcacgtgcaacgagcaggaggacgcggagggcctcgtgatccacaaggtgagcaagcgctgcacctacaagtaccagctgaagtgggccaaggtcctgatggtgaccctcgtgctgctgctgatcgcccagaacaccatcctcatcgtcgccgccgggaccgactgctgggcgaagaagtccctggacatggactgcatcggcccgatgctggacatcgggagctgcaccaacaagaacacgcggaactacgacaccgaggcccagaagctcgtgagccagtccaaggtcagccagctggacgccgaccaggcctccctgctcggcaacagcatcgactccgccatcaaggcgatccgcgcccagaagacctaccccaccatgcacctcctggagaccatcttcctcatgaagaactgcgactactacacgagcttcaaccacaactccgggtacagccaggccaagtggcggctgatcgccaagaccggccacttcgacatctgctcccgccacagcacccaccacttctgccggtgcatcaacgacggcaccaagtgccagaacggggactgggacttcgccggcgagatgaacgagacgtacaactccaagaacgacttctacagccacgacctgaacctcttctacaccatcttcgagaacgcgttccccgggaccaccgagtccctgttctaccagctgatccagaagaagaacacgaccggcgccagcaagatcctcgggaagctgatcaccaagtacggcaacaacaacatgttcgtgggcgtgtggaagttcgggcagtacctgctcaccctgccctacatcaacaacacggagctgtcccagaaccgccggcagaccatcctcgccacccaggagagcctgtcccgcagccacagcggccgccaggagtccatgagctccgccatccaggggagcgtcaccaaggagtgccacaacgcgaaggacgtgggctgcatctccccgcggttcggcatccccatcgggaacctgacggcctgcggcgacagccccaactacaagatctacaagacccccgagaagctctacaagtccaacaacaagggggaggtgtggtgcagcaacgacgtccactgcctgaacgacttcgagccggccgacgaggaggtggtgaacaaggtcaagaagctgacctgcttcctcaccgacgtgtccgtgaagacggacatcttcagcgtcgccgtgtccacgtgcaagatggccgacaaggggacctgcaccgtgaaggacgcgaagtggaacatcatcaagtgcgacagcggcctgtactacttcaccgaccaccgcgagggccaggacaccggcaacgacttcggggagtactgcatctcccacagctgcaacaccgagcggttccccatcaaccccgacatcctgaaggactgcacctgggagttccactcccgcaagagcaagtacatctccacgatcagcctcgagtccctggaggagttccggcgcgccatgaccgagaagctgagccacaccctcaccatctacaacttcaagcccacggccaacctgccgcacatccggcccacctacaagttcatcaccgccaacggcgtcgagaacagcgacgggatcgagtccgcctacatcctgagctccatccccgcgctcggcgggatcagcgtgggctacaacgtgcagaccaaggacaacttccccctgctggacatcatcgtcttcatcaagtccgccgtgatccgcacgacctacaaccacatctacgacaccggcccgaccatcgggatcaacacccagcacgacgagcactgcacgggcccctgccccgccgtggtcccccacaaggagaactggatcaccttcagccaggagcggacctcccgctgggggtgcgaggagttcggctgcctcgccatcaacaccgggtgcgtgttcggcagctgccaggacatcatccacccggagacgaaggtgtaccggaaggccgtcgaggaggaggtggtgctgaccgtctgcatcaacttccccggcaacaactactgcaccgagatcaacgcggtggagcccaagatcaccgacgagatcgagctgcagttcaagacggtggacaccaagaccctcccgaacctgctggccgtccagaaccgcaagctctactccgggcagatcaacgacctgggcagcttctcccaggggtgcggcaacgtgcagaagaccaaccacagcatcctggggatgggcacggccaagttcgactacgtgtgccacggcgcctcccggaaggacgtcatcgtgcgccggtgctacaacaacaacttcgacagctgccgcctcctgaaggaggagacctccctgatcttcgcggacaaccacgagaccctcgaggtggcccacaccaagcacctgatcggggagctgcagttcaagatcatgctcggcgacatccggtacaagagcttcgccgagtcccccgagctggagatcgacgccaagtgcgtcgggtgccccagctgcttcgagtcctacagctgcaacttccagatcgtgacgaacatcgacaccgtgtgcagcgtcgagggcccctgcaccctgttccacaaccgcatcatcatctccgccaacaagcagagctacggcctcaagatgtcctgccagaccaagccgaaccagaacgaggagttcatcatctgcaaccggaagtacagcgtgctgttcacgaccatcgacaagaacgacaagatcgaggtgaacaccggggaccagacctcctacatctacgagaaggacagccgctgcaagacgtggctgtgccgcgtccgggacgagggcatctccgtgctgttcgagcccctgaaggcgttcttcgggagctacttctccatcatcttctacgtggtcgtgggcatcatcgtgctgttcctcatcatctacatcttcctgcccatgttcttcaagctgaaggacgtcctcaagcgcaacgagtacctgtacctgcaggagctcaagcacaagtga

SEQ ID NO: 12539 - RNA, 4305 nt, synthetic construct
  misc_feature 1..4305: note = derived and/or modified CDS sequence (opt1) from CVV(Montgomery County/VA/2015 K)__KX583999.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacaccaagaacgacaccgggctgttcggccacaacaaggtgttccggagctggaccatcaaggactggaagctgtgcaacccgatccccacggccgggggcaccatcaacgtcatcgaggtgaacaaggacctctccctgatgaccaagacctacatctgcagccgcgactgcacgatcaccatcgacaaggaggaggcccagatcatcttccagaccgacaagctgaaccacttcgaggtgtccggcaccacgctcaacagcgggtggttcaagtccaaggccagcgtcaccctggaccggacctgcgagcacgtgaaggtgacctgcggcaagaagtccctgcagttccacgcgtgcttcaagcaccacatgagctgcgtccgcttcttccacaacacgatcctccccgggaacatgatcaactccatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagagctgcaagaagtgcaactgctgcggcctggcgtaccaccccttcacgaactgcggctcccactgcgtgtgcgggctgaagttcgaggccagcgaccggatgcgcatccaccgggagagcggcctctgccaggggtacaagtccctgcgcatcgcccggctgctctgcaagagcaagggctccagcctggtcatctccggcctgctcagcatgctgatcctgtccttcgtgacccccatcgaggggaccatcaccagctaccccgagtcccgcaagtacacgctcgaggagatcaccgacgtggtcgagggcctggtgagcgagcagaacatcaaggagtacatcgtgttctacacctccctgttcgggagcctcatcctgctgctcgccttcatcatgtccatcaccctgagcaagatcacgtccatcctggcccggcgcaacgtcatctactgcgaggagtgcagcatgtaccactccaagcggggcatcaagtacaacggggacttcaccaacaagtgcggcttctgcacgtgcaacgagcaggaggacgcggagggcctcgtgatccacaaggtgagcaagcgctgcacctacaagtaccagctgaagtgggccaaggtcctgatggtgaccctcgtgctgctgctgatcgcccagaacaccatcctcatcgtcgccgccgggaccgactgctgggcgaagaagtccctggacatggactgcatcggcccgatgctggacatcgggagctgcaccaacaagaacacgcggaactacgacaccgaggcccagaagctcgtgagccagtccaaggtcagccagctggacgccgaccaggcctccctgctcggcaacagcatcgactccgccatcaaggcgatccgcgcccagaagacctaccccaccatgcacctcctggagaccatcttcctgatgaagaactgcgactactacacgagcttcaaccacaactccgggtacagccaggccaagtggcggctgatcgccaagaccggccacttcgacatctgctcccgccacagcacccaccacttctgccggtgcatcaacgacggcaccaagtgccagaacggggactgggacttcgccggcgagatgaacgagacgtacaactccaagaacgacttctacagccacgacctgaacctcttctacaccatcttcgagaacgcgttccccgggaccaccgagtccctgttctaccagctgatccagaagaagaacacgaccggcgccagcaagatcctcgggaagctgatcaccaagtacggcaacaacaacatgttcgtgggcgtgtggaagttcgggcagtacctgctcaccctgccctacatcaacaacacggagctgtcccagaaccgccggcagaccatcctcgccacccaggagagcctgtcccgcagccacagcggccgccaggagtccatgagctccgccatccaggggagcgtcaccaaggagtgccacaacgcgaaggacgtgggctgcatctccccgcggttcggcatccccatcgggaacctgacggcctgcggcgacagccccaactacaagatctacaagacccccgagaagctctacaagtccaacaacaagggggaggtgtggtgcagcaacgacgtccactgcctgaacgacttcgagccggccgacgaggaggtggtgaacaaggtcaagaagctgacctgcttcctcaccgacgtgtccgtgaagacggacatcttcagcgtcgccgcctccacgtgcaagatggcggacaaggggacctgcaccgtgaacgacgccaagtggaacatcatcaagtgcgacagcggcctgtactacttcaccgaccaccgcgagggccaggacaccggcaacgacttcggggagtactgcatctcccacagctgcaacaccgagcggttccccatcaaccccgacatcctgaaggactgcacctgggagttccactcccgcaagagcaagtacatctccacgatcagcctcgagtccctggaggagttccggcgcgccatgaccgagaagctgagccacaccctcaccatctacaacttcaagcccacggccaacctgccgcacatccggcccacctacaagttcatcaccgccaacggcgtggagaacagcgacgggatcgagtccgcgtacatcctgagctccatccccgccctcggcgggatcagcgtcggctacaacgtgcagaccaaggacaacttccccctgctggacatcatcgtgttcatcaagtccgccgtcatccgcacgacctacaaccacatctacgacaccggcccgaccatcgggatcaacacccagcacgacgagcactgcacgggcccctgccccgccgtggtgccccacaaggagaactggatcaccttcagccaggagcggacctcccgctgggggtgcgaggagttcggctgcctcgccatcaacaccgggtgcgtcttcggcagctgccaggacatcatccacccggagacgaaggtgtaccggaaggcggtggaggaggaggtcgtgctgaccgtgtgcatcaacttccccggcaacaactactgcaccgagatcaacgccgtcgagcccaagatcaccgacgagatcgagctgcagttcaagacggtggacaccaagaccctcccgaacctgctggccgtgcagaaccacaagctctactccgggcagatcaacgacctgggcagcttctcccaggggtgcggcaacgtccagaagaccaaccacagcatcctggggatgggcacggccaagttcgactacgtgtgccacggcgcgtcccgcaaggacgtgatcgtccggcgctgctacaacaacaacttcgacagctgccggctcctgaaggaggagacctccctgatcttcgccgacaaccacgagaccctcgaggtggcccacaccaagcacctgatcggggagctgcagttcaagatcatgctcggcgacatccgctacaagagcttcgccgagtcccccgagctggagatcgacgccaagtgcgtggggtgccccagctgcttcgagtcctacagctgcaacttccagatcgtcacgaacatcgacaccgtgtgcagcgtggagggcccctgcaccctgttccacaaccggatcatcatctccgcgaacaagcagagctacggcctcaagatgtcctgccagaccaagccgaaccagaacgaggagttcatcatctgcaaccgcaagtacagcgtcctgttcacgaccatcgacaagaacgacaagatcgaggtgaacaccggggaccagacctcctacatctacgagaaggacagccggtgcaagacgtggctgtgccgcgtgcgcgacgagggcatctccgtcctcttcgagcccctgaaggccttcttcgggagctacttctccatcatcttctacgtggtggtcggcatcatcgtgctgttcctcatcatctacatcttcctgcccatgttcttcaagctgaaggacgtgctcaagcggaacgagtacctgtacctgcaggagctcaagcacaagtga

SEQ ID NO: 12540 - RNA, 4305 nt, synthetic construct
  misc_feature 1..4305: note = derived and/or modified CDS sequence (opt1) from CVV(1156)__EU583730.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaagatctccaagcggtgcacctacaagtaccagctgaagtgggcgaaggtgctgatgatcaccctcgtcctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtgagccagtccaagatcagccagctggacgccgaccaggtctccctgctcgggaacagcatcgactccgccatcaaggccatccgggcccagaagacctaccccaccatgcacctcctggagacgatcttcctcatgaagaactgcgactactacaccagcttcaaccacaactccggctacagccaggcgaagtggcgcctgatcgccaagaccgggcacttcgacatctgctcccggcacagcacccaccacttctgccgctgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggccagcaaggtgctcggcaagctgatcaccaagtacgggaacaacaacatgttcgtcggcgtgtggaagttcggccagtacctgctcacgctgccctacatcaacaacaccgagctgtcccagaaccggcgcctcaccatcctgaccacgcaggagctgctcagccggagccactccgggcgccaggagagcatgtccaacgcgatccagggcagcatcaccaaggagtgccacaacgccaagggggtgggctgcatctccccgcgcttcggcatccccatcgggaacctgaccgcctgcggcgacagccccaactacaagatctacaagacccccgagaagctgtacaagtccaacaacaagggggaggtctggtgcagcaacgacgtgcactgcctcaacgacttcgagccggccgacgaggaggtggtcaacaagatcaagaagctgacgtgcttcctgaccgacgtgtccgtggaggtcgacatcttcagcgtggcggcctccacgtgcaagatggccgacaagggcgtgtgcaccgtcaacggggccaagtggaacatcatcaagtgcgacagcggcctctactacttcaccgaccaccgggagggccaggacaccgggaacgacttcggcgagtactgcatctcccacagctgcaacaccgagcgcttccccatcaaccccgacatcctgaaggactgcacctgggagttccactcccgcaagagcaagtacatctccacgatcagcctggagtccctcgaggagttccggcgggccatggcggagaagctgagccacaccctgaccatctacaacttcaagcccaccgccaacctcccgcacatccgccccacgtacaagttcatcaccgccaacggggtggagaacagcgacggcatcgagtccgcctacatcctgagctccatccccgccctcgggggcatcagcgtgggctacaacgtccagaccaaggacaacttccccctgctggacatcatcgtgttcatcaagtccgcggtgatccggaccacgtacaaccacatctacgacaccgggccgaccatcggcatcaacacccagcacgacgagcactgcaccgggccctgccccgccgtcgtgccccacaaggagaactggatgacgttcagccaggagcgcacctcccggtggggctgcgaggagttcgggtgcctggccatcaacaccggctgcgtgttcggcagctgccaggacatcatccacccggagaccaaggtctaccgcaaggccgtggaggaggaggtggtcctcacggtgtgcatcaacttccccgggaacaactactgcaccgagatcaacgccatcgagcccaagatcaccgacgagatcgagctgcagttcaagaccgtggacacgaagaccctgccgaacctcctggcggtccagaaccacaagctgtactccggccagatcaacgacctcgggagcttctcccagggctgcgggaacgtgcagaagaccaaccacagcatcctgggcatgggcaccgtgaagttcgactacgtctgccacggggcctcccggaaggacgtgatcgtgcgccggtgctacaacaacaacttcgacagctgcaagctgctcaaggaggagacgtccctgatcttcgccgacaaccacgagaccctggaggtcgcccacaccaagcacctcatcggcgagctgcagttcaagatcatgctgggggacatccgctacaagagcttcgcggagtcccccgagctcgagatcgacgccaagtgcgtgggctgccccagctgcttcgagtcctacagctgcaacttccagatcgtgaccaacatcgacacggtctgcagcgtggagggcccctgcaccctgttccacaaccggatcatcatctccgccaacaagcagagctacgggctgaagatgtcctgccagaccaagccgaaccagaacgaggagttcatcatctgcaaccgcaagtacagcgtgctgttcaccacgatcgacaagaacgacaagatcgaggtcaacaccggcgaccagacctcctacatctacgagaaggacagccggtgcaagacctggctgtgccgcgtgcgggacgaggggatctccgtgctgttcgagcccctcaaggccttcttcggcagctacttctccatcatcttctacgtcgtgatcgggatcatcgtgctgttcctgatcatctacatcttcctccccatgttcttcaagctgaaggacgtcctgaagcgcaacgagtacctctacctgcaggagctgaagcacaagtga

SEQ ID NO: 12541 - RNA, 4305 nt, synthetic construct
  misc_feature 1..4305: note = derived and/or modified CDS sequence (opt1) from CVV(6V633)__KX100134.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggcctccctgctcgggaacagcatcgactccgccatcaaggccatccgggcgcagaagacctaccccaccatgcacctcctggagacgatcttcctcatgaagaactgcgactactacaccagcttcaaccacaactccggctacagccaggccaagtggcgcctgatcgccaagaccgggcacttcgacatctgctcccggcacagcacccaccacttctgccgctgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggcgagcaaggtgctcggcaagctgatcaccaagtacgggaacaacaacatgttcgtcggcatctggaagttcggccagtacctgctcacgctgccctacatcaacaacaccgagctgtcccagaaccggcgcctcaccatcctggccacccaggagctgctcagccggagccactccgggcgccaggagagcatgtccaacgccatccagggcagcatcacgaaggagtgccacaacgccaagggggtgggctgcatctccccgcgcttcggcatccccatcgggaacctgaccgcgtgcggcgacagccccaactacaagatctacaagacccccgagaagctgtacaagtccaacaacaagggggaggtgtggtgcagcaacgacgtccactgcctcaacgacttcgagccggccgacgaggaggtggtgaacaagatcaagaagctgacctgcttcctgacggacgtctccgtggaggtggacatcttcagcgtcgccgcctccacgtgcaagatggccgacaagggcgtgtgcaccgtgaacggggcgaagtggaacatcatcaagtgcgacagcggcctctactacttcaccgaccaccgggagggccaggacaccgggaacgacttcggcgagtactgcatctcccacagctgcaacaccgagcgcttccccatcaaccccgacaccctgaaggactgcacctgggagttccactcccgcaagagcaagtacatctccacgatcagcctggagtccctcgaggagttccggcgggccatggccgagaagctgagccacaccctgaccatctacaacttcaagcccaccgccaacctcccgcacatccgccccacgtacaagttcatcaccgccaacggggtcgagaacagcgacggcatcgagtccgcgtacatcctgagctccatccccgccctcgggggcatcagcgtgggctacaacgtgcagaccaaggacaacttccccctgctggacatcatcgtcttcatcaagtccgccgtgatccggaccacgtacaaccacatctacgacaccgggccgaccatcggcatcaacacccagcacgacgagcactgcaccgggccctgccccgccgtggtcccccacaaggagaactggatgacgttcagccaggagcgcacctcccggtggggctgcgaggagttcgggtgcctggccatcaacaccggctgcgtgttcggcagctgccaggacatcatccacccggagaccaaggtgtaccgcaaggcggtcgaggaggaggtggtgctcacggtctgcatcaacttccccgggaacaactactgcaccgagatcaacgccatcgagcccaagatcaccgacgagatcgagctgcagttcaagaccgtggacacgaagaccctgccgaacctcctggccgtgcagaaccacaagctgtactccggccagatcaacgacctcgggagcttctcccagggctgcgggaacgtccagaagaccaaccacagcatcctgggcatgggcaccgtgaagttcgactacgtgtgccacggggcctcccggaaggacgtcatcgtgcgccggtgctacaacaacaacttcgacagctgcaagctgctcaaggaggagacgtccctgatcttcgcggacaaccacgagaccctggaggtggcccacaccaagcacctcatcggcgagctgcagttcaagatcatgctgggggacatccgctacaagagcttcgccgagtcccccgagctcgagatcgacgccaagtgcgtcggctgccccagctgcttcgagtcctacagctgcaacttccagatcgtgaccaacatcgacacggtgtgcagcgtcgagggcccctgcaccctgttccacaaccggatcatcatctccgccaacaagcagagctacgggctgaagatgtcctgccagaccaagccgaaccagaacgaggagttcatcatctgcaaccgcaagtacagcgtgctgttcaccacgatcgacaagaacgacaagatcgaggtgaacaccggcgaccagacctcctacatctacgagaaggacagccggtgcaagacctggctgtgccgcgtccgggacgaggggatctccgtgctgttcgagcccctcaaggcgttcttcggcagctacttctccatcatcttctacgtggtcgtggggatcatcgtgctgttcctgatcatctacatcttcctccccatgttcttcaagctgaaggacgtcctgaagcgcaacgagtacctctacctgcaggagctgaagcacaagtga

SEQ ID NO: 12542 - RNA, 4305 nt, synthetic construct
  misc_feature 1..4305: note = derived and/or modified CDS sequence (opt1) from CVV(807270)__AF186243.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggtgtccctgctcgggaacagcatcgactccgccatcaaggccatccgggcccagaagacctaccccaccatgcacctcctggagacgatcttcctgatgaagaactgcgactactacaccagcttcaaccacaactccggctacagccaggcgaagtggcgcctgatcgccaagaccgggcacttcgacatctgctcccggcacagcacccaccacttctgccagtgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggccagcaaggtcctcggcaagctgatcaccaagtacgggaacaacaacatgttcgtgggcgtgtggaagttcggccagtacctgctcacgctgccctacatcaacaacaccgagctgtcccagaaccgccggctcaccatcctggcgacccaggagctgctcagccgcagccactccgggcggcaggagagcatgtccaacgccatccagggcagcatcacgaaggagtgccacaacgccaagggggtcggctgcatctccccgcgcttcggcatccccatcgggaacctgaccgcctgcggcgacagccccaactacaagatctacaagacccccgagaagctgtacaagtccaacaacaagggggaggtgtggtgcagcaacgacgtgcactgcctcaacgacttcgagccggcggacgaggaggtcgtgaacaagatcaagaagctgacctgcttcctgacggacgtgtccgtcgaggtggacatcttcagcgtggccgcctccacgtgcaagatggccgacaagggcgtctgcaccgtgaacggggccaagtggaacatcatcaagtgcgacagcggcctctactacttcaccgaccaccgcgagggccaggacaccgggaacgacttcggcgagtactgcatctcccacagctgcaacaccgagcggttccccatcaaccccgacatcctgaaggactgcacctgggagttccactcccgcaagagcaagtacatctccaccatcagcctggagtccctcgaggagttccggcgcgcgatggccgagaagctgagccacacgctgaccatctacaacttcaagcccaccgccaacctcccgcacatccggcccacctacaagttcatcacggccaacggggtggagaacagcgacggcatcgagtccgcctacatcctgagctccatccccgcgctcgggggcatcagcgtcggctacaacgtgcagaccaaggacaacttccccctgctggacatcatcgtgttcatcaagtccgccgtcatccgcaccacctacaaccacatctacgacacggggccgaccatcggcatcaacacccagcacgacgagcactgcaccgggccctgccccgccgtggtgccccacaaggagaactggatgaccttcagccaggagcggacgtcccgctggggctgcgaggagttcgggtgcctggccatcaacaccggctgcgtcttcggcagctgccaggacatcatccacccggagaccaaggtgtaccggaaggccgtggaggaggaggtcgtgctcaccgtgtgcatcaacttccccgggaacaactactgcacggagatcaacgcgatcgagcccaagatcaccgacgagatcgagctgcagttcaagaccgtcgacaccaagacgctgccgaacctcctggccgtgcagaaccacaagctgtactccggccagatcaacgacctcgggagcttctcccagggctgcgggaacgtgcagaagaccaaccacagcatcctgggcatgggcaccgtcaagttcgactacgtgtgccacggggcctcccgcaaggacgtgatcgtccggcgctgctacaacaacaacttcgacagctgcaagctgctcaaggaggagacctccctgatcttcgccgacaaccacgagacgctggaggtggcgcacaccaagcacctcatcggcgagctgcagttcaagatcatgctgggggacatccggtacaagagcttcgccgagtcccccgagctcgagatcgacgccaagtgcgtgggctgccccagctgcttcgagtcctacagctgcaacttccagatcgtcaccaacatcgacaccgtgtgcagcgtggagggcccctgcacgctgttccacaaccgcatcatcatctccgccaacaagcagagctacgggctgaagatgtcctgccagaccaagccgaaccagaacgaggagttcatcatctgcaaccggaagtacagcgtcctcttcaccaccatcgacaagaacgacaagatcgaggtgaacacgggcgaccagacctcctacatctacgagaaggacagccgctgcaagacctggctgtgccgggtgcgcgacgaggggatctccgtcctgttcgagcccctcaaggccttcttcggcagctacttctccatcatcttctacgtggtggtcgggatcatcgtgctgttcctgatcatctacatcttcctccccatgttcttcaagctgaaggacgtgctgaagcggaacgagtacctctacctgcaggagctgaagcacaagtga

SEQ ID NO: 12543 - RNA, 4305 nt, synthetic construct
  misc_feature 1..4305: note = derived and/or modified CDS sequence (opt1) from CVV(856 clone 1)__EU583732.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcgccagcatgtgccagaacatcgagctgatcatcatcctgggcctcacgctggccatcttcatcctgatggtgatcctcaccaagacctacatctgctacctgctgatgcccatcttcatgccgatcgcctacctctacgggtgggcgtacaacaagtcctgcaagaagtgcaactgctgcggcctggcctaccaccccttcaccaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacgcccatcgaggggaccatcacctcctaccccgagagccgcaagtacaccctcgaggagatcacggacgtggtcgagggcctggtgtccgagcagaacatcaaggagtacatcgtgttctacaccagcctgttcgggtccctcatcctgctgctcgccttcatcatgagcatcaccctgtccaagatcaccagcatcctggcgaagcggaacgtcatctactgcgaggagtgctccatgtaccacagcaagcgcggcatcaagtacaacggggacttcacgaacaagtgcggcttctgcacgtgcaacgagcaggaggacaccgagggcctcgtgatccacaaggtgtccaagcggtgcacctacaagtaccagctgaagtgggccaaggtcctgatgatcaccctcgtgctgctgctgatcgcccagaacaccatcctcatcgtggccgccgagaccgactgctggatcaagaagtccctggacatcgactgcatcgggccgatgctggacatcggcagctgcaccaacaagaacacgcgcagctacgacgcggaggcccagaagctcgtcagccagtccaagatcagccagctggacgccgaccaggtgtccctgctcgggaacagcatcgactccgccatcaaggccatccgggcgcagaagacctaccccaccatgcacctcctggagaccatcttcctgatgaagaactgcgactactacaccagcttcaaccacaactccggctacagccaggccaagtggcgcctgatcgccaagacggggcacttcgacatctgctcccggcacagcacccaccacttctgccgctgcatcaacgacggcaccaagtgccagaacggcgactgggacttcgccggggagatgaacgagacctacaactccaagaacgacttctacagccacgacctgaacctcttctacacgatcttcgagaacgccttccccggcaccaccgagtccctgttctaccagctgatccagcggaagaacaccacgggggcgagcaaggtcctcggcaagctgatcaccaagtacgggaacaacaacatgttcgtgggcgtgtggaagttcggccagtacctgctcaccctgccctacatcaacaacaccgagctgtcccagaaccgccggctcacgatcctgaccacccaggagctgctcagccgcagccactccgggcgccaggagagcatgtccaacgccatccagggcagcatcaccaaggagtgccacaacgccaagggggtcggctgcatctccccgcggttcggcatccccatcgggaacctgacggcctgcggcgacagccccaactacaagatctacaagacccccgagaagctgtacaagtccaacaacaagggggaggtgtggtgcagcaacgacgtgcactgcctcaacgacttcgagccggcggacgaggaggtcgtgaacaagatcaagaagctgacctgcttcctgaccgacgtgtccgtcgaggtggacatcttcagcgtggccgcctccacgtgcaagatggccgacaagggcgtctgcaccgtgaacggggccaagtggaacatcatcaagtgcgacagcggcctctactacttcaccgaccaccgcgagggccaggacaccgggaacgacttcggcgagtactgcatctcccacagctgcaacacggagcggttccccatcaaccccgacatcctgaaggactgcacctgggagttccactcccgcaagagcaagtacatctccaccatcagcctggagtccctcgaggagttccggcgcgcgatggccgagaagctgagccacaccctgacgatctacaacttcaagcccaccgccaacctcccgcacatccggcccacctacaagttcatcaccgccaacggggtggagaacagcgacggcatcgagtccgcctacatcctgagctccatccccgcgctcgggggcatcagcgtcggctacaacgtgcagacgaaggacaacttccccctgctggacatcatcgtgttcatcaagtccgccgtcatccgcaccacctacaaccacatctacgacaccgggccgacgatcggcatcaacacccagcacgacgagcactgcaccgggccctgccccgccgtggtgccccacaaggagaactggatgaccttcagccaggagcggacctcccgctggggctgcgaggagttcgggtgcctggccatcaacacgggctgcgtcttcggcagctgccaggacatcatccacccggagaccaaggtgtaccggaaggccgtggaggaggaggtcgtgctcaccgtgtgcatcaacttccccgggaacaactactgcaccgagatcaacgcgatcgagcccaagatcacggacgagatcgagctgcagttcaagaccgtcgacaccaagaccctgccgaacctcctggccgtgcagaaccacaagctgtactccggccagatcaacgacctcgggagcttctcccagggctgcgggaacgtgcagaagacgaaccacagcatcctgggcatgggcaccgtcaagttcgactacgtgtgccacggggcctcccgcaaggacgtgatcgtccggcgctgctacaacaacaacttcgacagctgcaagctgctcaaggaggagacctccctgatcttcgccgacaaccacgagaccctggaggtggcgcacacgaagcacctcatcggcgagctgcagttcaagatcatgctgggggacatccggtacaagagcttcgccgagtcccccgagctcgagatcgacgccaagtgcgtgggctgccccagctgcttcgagtcctacagctgcaacttccagatcgtcaccaacatcgacaccgtgtgcagcgtggagggcccctgcaccctgttccacaaccgcatcatcatctccgccaacaagcagagctacgggctgaagatgtcctgccagacgaagccgaaccagaacgaggagttcatcatctgcaaccggaagtacagcgtcctcttcaccaccatcgacaagaacgacaagatcgaggtgaacaccggcgaccagacgtcctacatctacgagaaggacagccgctgcaagacctggctgtgccgggtgcgcgacgaggggatctccgtcctgttcgagcccctcaaggccttcttcggcagctacttctccatcatcttctacgtggtgatcgggatcatcgtcctgttcctgatcatctacatcttcctccccatgttcttcaagctgaaggacgtgctgaagcgcaacgagtacctctacctgcaggagctgaagcacaagtga

SEQ ID NO: 12544 - RNA, 4305 nt, synthetic construct
  misc_feature 1..4305: note = derived and/or modified CDS sequence (opt1) from CVV(856 clone 3)__EU583731.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcgccagcatgtgccagaacatcgagctgatcatcatcctgggcctcacgctggccatcttcatcctgatggtgatcctcaccaagacctacatctgctacctgctgatgcccatcttcatgccgatcgcctacctctacgggtgggcgtacaacaagtcctgcaagaagtgcaactgctgcggcctggcctaccaccccttcaccaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacgcccatcgaggggaccatcacctcctaccccgagagccgcaagtacaccctcgaggagatcacggacgtggtcgagggcctggtgtccgagcagaacatcaaggagtacatcgtgttctacaccagcctgttcgggtccctcatcctgctgctcgccttcatcatgagcatcaccctgtccaagatcaccagcatcctggcgaagcggaacgtcatctactgcgaggagtgctccatgtaccacagcaagcgcggcatcaagtacaacggggacttcacgaacaagtgcggcttctgcacgtgcaacgagcaggaggacaccgagggcctcgtgatccacaaggtgtccaagcggtgcacctacaagtaccagctgaagtgggccaaggtcctgatgatcaccctcgtgctgctgctgatcgcccagaacaccatcctcatcgtggccgccgagaccgactgctggatcaagaagtccctggacatcgactgcatcgggccgatgctggacatcggcagctgcaccaacaagaacacgcgcagctacgacgcggaggcccagaagctcgtcagccagtccaagatcagccagctggacgccgaccaggtgtccctgctcgggaacagcatcgactccgccatcaaggccatccgggcgcagaagacctaccccaccatgcacctcctggagaccatcttcctgatgaagaactgcgactactacaccagcttcaaccacaactccggctacagccaggccaagtggcgcctgatcgccaagacggggcacttcgacatctgctcccggcacagcacccaccacttctgccgctgcatcaacgacggcaccaagtgccagaacggcgactgggacttcgccggggagatgaacgagacctacaactccaagaacgacttctacagccacgacctgaacctcttctacacgatcttcgagaacgccttccccggcaccaccgagtccctgttctaccagctgatccagcggaagaacaccacgggggcgagcaaggtcctcggcaagctgatcaccaagtacgggaacaacaacatgttcgtgggcgtgtggaagttcggccagtacctgctcaccctgccctacatcaacaacaccgagctgtcccagaaccgccggctcacgatcctgaccacccacgagctgctcagccgcagccactccgggcgccaggagagcatgtccaacgccatccagggcagcatcaccaaggagtgccacaacgccaagggggtcggctgcatctccccgcggttcggcatccccatcgggaacctgacggcctgcggcgacagccccaactacaagatctacaagacccccgagaagctgtacaagtccaacaacaagggggaggtgtggtgcagcaacgacgtgcactgcctcaacgacttcgagccggcggacgaggaggtcgtgaacaagatcaagaagctgacctgcttcctgaccgacgtgtccgtcgaggtggacatcttcagcgtggccgcctccacgtgcaagatggccgacaagggcgtctgcaccgtgaacggggccaagtggaacatcatcaagtgcgacagcggcctctactacttcaccgaccaccgcgagggccaggacaccgggaacgacttcggcgagtactgcatctcccacagctgcaacacggagcggttccccatcaaccccgacatcctgaaggactgcacctgggagttccactcccgcaagagcaagtacatctccaccatcagcctggagtccctcgaggagttccggcgcgcgatggccgagaagctgagccacaccctgacgatctacaacttcaagcccaccgccaacctcccgcacatccggcccacctacaagttcatcaccgccaacggggtggagaacagcgacggcatcgagtccgcctacatcctgagctccatccccgcgctcgggggcatcagcgtcggctacaacgtgcagacgaaggacaacttccccctgctggacatcatcgtgttcatcaagtccgccgtcatccgcaccacctacaaccacatctacgacaccgggccgacgatcggcatcaacacccagcacgacgagcactgcaccgggccctgccccgccgtggtgccccacaaggagaactggatgaccttcagccaggagcggacctcccgctggggctgcgaggagttcgggtgcctggccatcaacacgggctgcgtcttcggcagctgccaggacatcatccacccggagaccaaggtgtaccggaaggccgtggaggaggaggtcgtgctcaccgtgtgcatcaacttccccgggaacaactactgcaccgagatcaacgcgatcgagcccaagatcacggacgagatcgagctgcagttcaagaccgtcgacaccaagaccctgccgaacctcctggccgtgcagaaccacaagctgtactccggccagatcaacgacctcgggagcttctcccagggctgcgggaacgtgcagaagacgaaccacagcatcctgggcatgggcaccgtcaagttcgactacgtgtgccacggggcctcccgcaaggacgtgatcgtccggcgctgctacaacaacaacttcgacagctgcaagctgctcaaggaggagacctccctgatcttcgccgacaaccacgagaccctggaggtggcgcacacgaagcacctcatcggcgagctgcagttcaagatcatgctgggggacatccggtacaagagcttcgccgagtcccccgagctcgagatcgacgccaagtgcgtgggctgccccagctgcttcgagtcctacagctgcaacttccagatcgtcaccaacatcgacaccgtgtgcagcgtggagggcccctgcaccctgttccacaaccgcatcatcatctccgccaacaagcagagctacgggctgaagatgtcctgccagacgaagccgaaccagaacgaggagttcatcatctgcaaccggaagtacagcgtcctcttcaccaccatcgacaagaacgacaagatcgaggtgaacaccggcgaccagacgtcctacatctacgagaaggacagccgctgcaagacctggctgtgccgggtgcgcgacgaggggatctccgtcctgttcgagcccctcaaggccttcttcggcagctacttctccatcatcttctacgtggtgatcgggatcatcgtcctgttcctgatcatctacatcttcctccccatgttcttcaagctgaaggacgtgctgaagcgcaacgagtacctctacctgcaggagctgaagcacaagtga

SEQ ID NO: 12545 - RNA, 4305 nt, synthetic construct
  misc_feature 1..4305: note = derived and/or modified CDS sequence (opt1) from CVV(CK102)__AF186242.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcgtgagcggcctgctctccatgctgatcctgagcttcgtgacccccatcgaggggaccatcacctcctaccccgagagccgcaagtacacgctcgaggagatcaccgacgtcgtggagggcctggtgtccgagcagaacatcaaggagtacatcgtcttctacaccagcctgttcgggtccctcatcctgctgctcgccttcatcatgagcatcaccctgtccaagatcacgagcatcctggccaagcggaacgtgatctactgcgaggagtgctccatgtaccacagcaagcgcggcatcaagtacaacggggacttcaccaacaagtgcggcttctgcacgtgcaacgagcaggaggacaccgagggcctcgtgatccacaaggtctccaagcggtgcacctacaagtaccagctgaagtgggcgaaggtgctgatgatcaccctcgtgctgctgctgatcgcccagaacaccatcctcatcgtcgccgccgagaccgactgctggacgaagaagtccctggacatcgactgcatcgggccgatgctggacatcggcagctgcaccaacaagaacacccgcagctacgacaccgaggcccagaagctcgtgagccagtccaagatcagccagctggacgcggaccaggtctccctgctcgggaacagcatcgactccgccatcaaggccatccgggcccagaagacctaccccacgatgcacctcctggagaccatcttcctcatgaagaactgcgactactacaccagcttcaaccacaactccggctacagccaggccaagtggcgcctgatcgcgaagaccgggcacttcgacatctgctcccggcacagcacgcaccacttctgccgctgcatcaacgacggcaccaagtgccagaacggcgactgggacttcgccggggagatgaacgagacctacaactccaagaacgacttctacagccacgacctgaacctcttctacaccatcttcgagaacgccttccccggcacgaccgagtccctgttctaccagctgatccagaagaagaacaccaccggggccagcaaggtgctcggcaagctgatcacgaagtacgggaacaacaacatgttcgtgggcgtctggaagttcggccagtacctgctcaccctgccctacatcaacaacaccgagctgtcccagaaccggcgcctcaccatcctggccacgcaggagctgctcagccggagccactccgggcgccaggagagcatgtccaacgcgatccagggcagcatcaccaaggagtgccacaacgccaagggggtgggctgcatctccccgcgcttcggcatccccatcgggaacctgaccgcctgcggcgacagccccaactacaagatctacaagacccccgagaagctgtacaagtccaacaacaagggggaggtgtggtgcagcaacgacgtccactgcctcaacgacttcgagccggccgacgaggaggtggtgaacaagatcaagaagctgacgtgcttcctgaccgacgtctccgtggaggtggacatcttcagcgtcgcggcctccacgtgcaagatggccgacaagggcgtgtgcaccgtgaacggggccaagtggaacatcatcaagtgcgacagcggcctctactacttcaccgaccaccgggagggccaggacaccgggaacgacttcggcgagtactgcatctcccacagctgcaacaccgagcgcttccccatcaaccccgacatcctgaaggactgcacctgggagttccactcccgcaagagcaagtacatctccacgatcagcctggagtccctcgaggagttccggcgggccatggcggagaagctgagccacaccctgaccatctacaacttcaagcccaccgccaacctcccgcacatccgccccacgtacaagttcatcaccgccaacggggtcgagaacagcgacggcatcgagtccgcctacatcctgagctccatccccgccctcgggggcatcagcgtgggctacaacgtgcagaccaaggacaacctgcccctgctggacatcatcgtcttcatcaagtccgcggtgatccggaccacgtacaaccacatctacgacaccgggccgaccatcggcatcaacacccagcacgacgagcactgcaccgggccctgccccgccgtggtcccccacaaggagaactggatgacgttcagccaggagcgcacctcccggtggggctgcgaggagttcgggtgcctcgccatcaacaccggctgcgtgttcggcagctgccaggacatcatccacccggagaccaaggtgtaccgcaaggccgtcgaggaggaggtggtgctgacggtctgcatcaacttccccgggaacaactactgcaccgagatcaacgccatcgagcccaagatcaccgacgagatcgagctgcagttcaagaccgtggacacgaagaccctcccgaacctgctggcggtgcagaaccacaagctctactccggccagatcaacgacctggggagcttctcccagggctgcgggaacgtccagaagaccaaccacagcatcctgggcatgggcaccgtgaagttcgactacgtgtgccacggggcctcccggaaggacgtcatcgtgcgccggtgctacaacaacaacttcgacagctgcaagctcctgaaggaggagacgtccctgatcttcgccgacaaccacgagaccctcgaggtggcccacaccaagcacctgatcggcgagctgcagttcaagatcatgctcggggacatccgctacaagagcttcgcggagtcccccgagctggagatcgacgccaagtgcgtcggctgccccagctgcttcgagtcctacagctgcaacttccagatcgtgaccaacatcgacacggtgtgcagcgtcgagggcccctgcaccctgttccacaaccggatcatcatctccgccaacaagcagagctacgggctcaagatgtcctgccagaccaagccgaaccagaacgaggagttcatcatctgcaaccgcaagtacagcgtgctgttcaccacgatcgacaagaacgacaagatcgaggtgaacaccggcgaccagacctcctacatctacgagaaggacagccggtgcaagacctggctgtgccgcgtccgggacgaggggatctccgtgctgttcgagcccctgaaggccttcagcggctcctacttcagcatcatcttctacgtggtcgtggggatcatcgtgctgttcctcatcatctacatcttcctgcccatgttcttcaagctgaaggacgtcctcaagcgcaacgagtacctgtacctgcaggagctcaagcacaagtga

SEQ ID NO: 12546 - RNA, 4305 nt, synthetic construct
  misc_feature 1..4305: note = derived and/or modified CDS sequence (opt1) from CVV(CK-102)__KX100146.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcgtgagcggcctgctctccatgctgatcctgagcttcgtgacccccatcgaggggaccatcacctcctaccccgagagccgcaagtacacgctcgaggagatcaccgacgtcgtggagggcctggtgtccgagcagaacatcaaggagtacatcgtcttctacaccagcctgttcgggtccctcatcctgctgctcgccttcatcatgagcatcaccctgtccaagatcacgagcatcctggccaagcggaacgtgatctactgcgaggagtgctccatgtaccacagcaagcgcggcatcaagtacaacggggacttcaccaacaagtgcggcttctgcacgtgcaacgagcaggaggacaccgagggcctcgtgatccacaaggtctccaagcggtgcacctacaagtaccagctgaagtgggcgaaggtgctgatgatcaccctcgtgctgctgctgatcgcccagaacaccatcctcatcgtcgccgccgagaccgactgctggacgaagaagtccctggacatcgactgcatcgggccgatgctggacatcggcagctgcaccaacaagaacacccgcagctacgacaccgaggcccagaagctcgtgagccagtccaagatcagccagctggacgcggaccaggtctccctgctcgggaacagcatcgactccgccatcaaggccatccgggcccagaagacctaccccacgatgcacctcctggagaccatcttcctcatgaagaactgcgactactacaccagcttcaaccacaactccggctacagccaggccaagtggcgcctgatcgcgaagaccgggcacttcgacatctgctcccggcacagcacgcaccacttctgccgctgcatcaacgacggcaccaagtgccagaacggcgactgggacttcgccggggagatgaacgagacctacaactccaagaacgacttctacagccacgacctgaacctcttctacaccatcttcgagaacgccttccccggcacgaccgagtccctgttctaccagctgatccagaagaagaacaccaccggggccagcaaggtgctcggcaagctgatcacgaagtacgggaacaacaacatgttcgtgggcgtctggaagttcggccagtacctgctcaccctgccctacatcaacaacaccgagctgtcccagaaccggcgcctcaccatcctggccacgcaggagctgctcagccggagccactccgggcgccaggagagcatgtccaacgcgatccagggcagcatcaccaaggagtgccacaacgccaagggggtggagtgcatctccccgcgcttcggcatccccatcggcaacctgaccgcctgcggggacagccccaactacaagatctacaagacccccgagaagctgtacaagtccaacaacaagggcgaggtgtggtgcagcaacgacgtccactgcctcaacgacttcgagccggccgacgaggaggtggtgaacaagatcaagaagctgacgtgcttcctgaccgacgtctccgtggaggtggacatcttcagcgtcgcggcctccacgtgcaagatggccgacaagggggtgtgcaccgtgaacggcgccaagtggaacatcatcaagtgcgacagcgggctctactacttcaccgaccaccgggagggccaggacaccggcaacgacttcggggagtactgcatctcccacagctgcaacaccgagcgcttccccatcaaccccgacatcctgaaggactgcacctgggagttccactcccgcaagagcaagtacatctccacgatcagcctggagtccctcgaggagttccggcgggccatggcggagaagctgagccacaccctgaccatctacaacttcaagcccaccgccaacctcccgcacatccgccccacgtacaagttcatcaccgccaacggcgtcgagaacagcgacgggatcgagtccgcctacatcctgagctccatccccgccctgggcgggatcagcgtgggctacaacgtgcagaccaaggacaacctccccctgctggacatcatcgtcttcatcaagtccgcggtgatccggaccacgtacaaccacatctacgacaccggcccgaccatcgggatcaacacccagcacgacgagcactgcaccggcccctgccccgccgtggtcccccacaaggagaactggatgacgttcagccaggagcgcacctcccggtgggggtgcgaggagttcggctgcctcgccatcaacaccgggtgcgtgttcggcagctgccaggacatcatccacccggagaccaaggtgtaccgcaaggccgtcgaggaggaggtggtgctgacggtctgcatcaacttccccggcaacaactactgcaccgagatcaacgccatcgagcccaagatcaccgacgagatcgagctgcagttcaagaccgtggacacgaagaccctcccgaacctgctggcggtgcagaaccacaagctctactccgggcagatcaacgacctgggcagcttctcccaggggtgcggcaacgtccagaagaccaaccacagcatcctggggatgggcaccgtgaagttcgactacgtgtgccacggcgcctcccggaaggacgtcatcgtgcgccggtgctacaacaacaacttcgacagctgcaagctcctgaaggaggagacgtccctgatcttcgccgacaaccacgagaccctcgaggtggcccacaccaagcacctgatcggggagctgcagttcaagatcatgctcggcgacatccgctacaagagcttcgcggagtcccccgagctggagatcgacgccaagtgcgtcgggtgccccagctgcttcgagtcctacagctgcaacttccagatcgtgaccaacatcgacacggtgtgcagcgtcgagggcccctgcaccctgttccacaaccggatcatcatctccgccaacaagcagagctacggcctcaagatgtcctgccagaccaagccgaaccagaacgaggagttcatcatctgcaaccgcaagtacagcgtgctgttcaccacgatcgacaagaacgacaagatcgaggtgaacaccggggaccagacctcctacatctacgagaaggacagccggtgcaagacctggctgtgccgcgtccgggacgagggcatctccgtgctgttcgagcccctgaaggccttcttcgggagctacttctccatcatcttctacgtggtcgtgggcatcatcgtgctgttcctcatcatctacatcttcctgcccatgttcttcaagctgaaggacgtcctcaagcgcaacgagtacctgtacctgcaggagctcaagcacaagtga

SEQ ID NO: 12547 - RNA, 4305 nt, synthetic construct
  misc_feature 1..4305: note = derived and/or modified CDS sequence (opt1) from CVV(MI80-1-450)__AF186241.1__GP
  source 1..4305: mol_type = other RNA
atgctgttcctcctgatcctggccttcctcggcttcagcacctccaaccccatcgccacccgctgcttccacgggggccacctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggtgtccctgctcgggaacagcatcgactccgccatcaaggccatccgggcccagaagacctaccccaccatgcacctcctggagacgatcttcctgatgaagaactgcgactactacaccagcttcaaccacaactccggctacagccaggcgaagtggcgcctgatcgccaagaccgggcacttcgacatctgctcccggcacagcacccaccacttctgccgctgcatcaacgacggcacgaagtgccagaacggcaactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggccagccaggtcctcggcaagctgatcaccaagtacgggaacaacaacatgttcgtgggcgtgtggaagttcggccagtacctgctcacgctgccctacatcaacaacaccgagctgtcccagaaccggcgcctcaccatcctggcgacccaggagctgctcagccggagccactccgggcgccaggagagcatgtccaacgccatccagggcagcatcacgaaggagtgccacaacgccaagggggtcggctgcatctccccgcgcttcggcatccccatcgggaacctgaccgcctgcggcgacagccccaactacaagatctacaagacccccgagaagctgtacaagtccaacaacaagggggaggtgtggtgcagcaacgacgtgcactgcctcaacgacttcgagccggcggacgaggaggtcgtgaacaagatcaagaagctgacctgcttcctgacggacgtgtccgtcgaggtggacatcttcagcgtggccgcctccacgtgcaagatggccgacaagggcgtctgcaccgtgaacggggccaagtggaacatcatcaagtgcgacagcggcctctactacttcaccgaccaccgggagggccaggacaccgggaacgacttcggcgagtactgcatctcccacagctgcaacaccgagcgcttccccatcaaccccgacatcctgaaggactgcacctgggagttccactcccgcaagagcaagtacatctccaccatcagcctggagtccctcgaggagttccggcgggcgatggccgagaagctgagccacacgctgaccatctacaacttcaagcccaccgccaacctcccgcacatccgccccacctacaagttcatcacggccaacggggtggagaacagcgacggcatcgagtccgcctacatcctgagctccatccccgcgctcgggggcatcagcgtcggctacaacgtgcagaccaaggacaacttccccctgctggacatcatcgtgttcatcaagtccgccgtcatccggaccacctacaaccacatctacgacacggggccgaccatcggcatcaacacccagcacgacgagcactgcaccgggccctgccccgccgtggtgccccacaaggagaactggatgaccttcagccaggagcgcacgtcccggtggggctgcgaggagttcgggtgcctggccatcaacaccggctgcgtcttcggcagctgccaggacatcatccacccggagaccaaggtgtaccgcaaggccgtggaggaggaggtcgtgctcaccgtgtgcatcaacttccccgggaacaactactgcacggagatcaacgcgatcgagcccaagatcaccgacgagatcgagctgcagttcaagaccgtcgacaccaagacgctgccgaacctcctggccgtgcagaaccacaagctgtactccggccagatcaacgacctcgggagcttctcccagggctgcgggaacgtgcagaagaccaaccacagcatcctgggcatgggcaccgtcaagttcgactacgtgtgccacggggcctcccggaaggacgtgatcgtccgccggtgctacaacaacaacttcgacagctgcaagctgctcaaggaggagacctccctgatcttcgccgacaaccacgagacgctggaggtggcgcacaccaagcacctcatcggcgagctgcagttcaagatcatgctgggggacatccgctacaagagcttcgccgagtcccccgagctcgagatcgacgccaagtgcgtgggctgccccagctgcttcgagtcctacagctgcaacttccagatcgtcaccaacatcgacaccgtgtgcagcgtggagggcccctgcacgctgttccacaaccggatcatcatctccgccaacaagcagagctacgggctgaagatgtcctgccagaccaagccgaaccagaacgaggagttcatcatctgcaaccgcaagtacagcgtcctcttcaccaccatcgacaagaacgacaagatcgaggtgaacacgggcgaccagacctcctacatctacgagaaggacagccggtgcaagacctggctgtgccgcgtgcgggacgaggggatctccgtcctgttcgagcccctcaaggccttcttcggcagctacttctccatcatcttctacgtggtggtcgggatcatcgtgctgttcctgatcatctacatcttcctccccatgttcttcaagctgaaggacgtgctgaagcgcaacgagtacctctacctgcaggagctgaagcacaagtga

SEQ ID NO: 12548 - RNA, 4305 nt, synthetic construct
  misc_feature 1..4305: note = derived and/or modified CDS sequence (opt1) from CVV(MI80-1-450)__KX100149.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggtgtccctgctcgggaacagcatcgactccgccatcaaggccatccgggcccagaagacctaccccaccatgcacctcctggagacgatcttcctgatgaagaactgcgactactacaccagcttcaaccacaactccggctacagccaggcgaagtggcgcctgatcgccaagaccgggcacttcgacatctgctcccggcacagcacccaccacttctgccgctgcatcaacgacggcacgaagtgccagaacggcaactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggccagccaggtcctcggcaagctgatcaccaagtacgggaacaacaacatgttcgtgggcgtgtggaagttcggccagtacctgctcacgctgccctacatcaacaacaccgagctgtcccagaaccggcgcctcaccatcctggcgacccaggagctgctcagccggagccactccgggcgccaggagagcatgtccaacgccatccagggcagcatcacgaaggagtgccacaacgccaagggggtcggctgcatctccccgcgcttcggcatccccatcgggaacctgaccgcctgcggcgacagccccaactacaagatctacaagacccccgagaagctgtacaagtccaacaacaagggggaggtgtggtgcagcaacgacgtgcactgcctcaacgacttcgagccggcggacgaggaggtcgtgaacaagatcaagaagctgacctgcttcctgacggacgtgtccgtcgaggtggacatcttcagcgtggccgcctccacgtgcaagatggccgacaagggcgtctgcaccgtgaacggggccaagtggaacatcatcaagtgcgacagcggcctctactacttcaccgaccaccgggagggccaggacaccgggaacgacttcggcgagtactgcatctcccacagctgcaacaccgagcgcttccccatcaaccccgacatcctgaaggactgcacctgggagttccactcccgcaagagcaagtacatctccaccatcagcctggagtccctcgaggagttccggcgggcgatggccgagaagctgagccacacgctgaccatctacaacttcaagcccaccgccaacctcccgcacatccgccccacctacaagttcatcacggccaacggggtggagaacagcgacggcatcgagtccgcctacatcctgagctccatccccgcgctcgggggcatcagcgtcggctacaacgtgcagaccaaggacaacttccccctgctggacatcatcgtgttcatcaagtccgccgtcatccggaccacctacaaccacatctacgacacggggccgaccatcggcatcaacacccagcacgacgagcactgcaccgggccctgccccgccgtggtgccccacaaggagaactggatgaccttcagccaggagcgcacgtcccggtggggctgcgaggagttcgggtgcctggccatcaacaccggctgcgtcttcggcagctgccaggacatcatccacccggagaccaaggtgtaccgcaaggccgtggaggaggaggtcgtgctcaccgtgtgcatcaacttccccgggaacaactactgcacggagatcaacgcgatcgagcccaagatcaccgacgagatcgagctgcagttcaagaccgtcgacaccaagacgctgccgaacctcctggccgtgcagaaccacaagctgtactccggccagatcaacgacctcgggagcttctcccagggctgcgggaacgtgcagaagaccaaccacagcatcctgggcatgggcaccgtcaagttcgactacgtgtgccacggggcctcccggaaggacgtgatcgtccgccggtgctacaacaacaacttcgacagctgcaagctgctcaaggaggagacctccctgatcttcgccgacaaccacgagacgctggaggtggcgcacaccaagcacctcatcggcgagctgcagttcaagatcatgctgggggacatccgctacaagagcttcgccgagtcccccgagctcgagatcgacgccaagtgcgtgggctgccccagctgcttcgagtcctacagctgcaacttccagatcgtcaccaacatcgacaccgtgtgcagcgtggagggcccctgcacgctgttccacaaccggatcatcatctccgccaacaagcagagctacgggctgaagatgtcctgccagaccaagccgaaccagaacgaggagttcatcatctgcaaccgcaagtacagcgtcctcttcaccaccatcgacaagaacgacaagatcgaggtgaacacgggcgaccagacctcctacatctacgagaaggacagccggtgcaagacctggctgtgccgcgtgcgggacgaggggatctccgtcctgttcgagcccctcaaggccttcttcggcagctacttctccatcatcttctacgtggtggtcgggatcatcgtgctgttcctgatcatctacatcttcctccccatgttcttcaagctgaaggacgtgctgaagcgcaacgagtacctctacctgcaggagctgaagcacaagtga

SEQ ID NO: 12549 - RNA, 4305 nt, synthetic construct
  misc_feature 1..4305: note = derived and/or modified CDS sequence (opt1) from CVV(MNZ-92011)__KC436107.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacaccaagaacgacaccgggctgttcggccacaacaaggtgttccggagctggaccatcaaggactggaagctgtgcaacccgatccccacggccgggggcaccatcaacgtcatcgaggtgaacaaggacctctccctgatgaccaagacctacatctgcagccgcgactgcacgatcaccatcgacaaggaggaggcccagatcatcttccagaccgacaagctgaaccacttcgaggtgtccggcaccacgctcaacagcgggtggttcaagtccaaggccagcgtcaccctggaccggacctgcgagcacgtgaaggtgacctgcggcaagaagtccctgcagttccacgcgtgcttcaagcaccacatgagctgcgtccgcttcttccacaacacgatcctccccgggaacatgatcaactccatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagagctgcaagaagtgcaactgctgcggcctggcgtaccaccccttcacgaactgcggctcccactgcgtgtgcgggctgaagttcgaggccagcgaccggatgcgcatccaccgggagagcggcctctgccaggggtacaagtccctgcgcatcgcccggctgctctgcaagagcaagggctccagcctggtcatctccggcctgctcagcatgctgatcctgtccttcgtgacccccatcgaggggaccatcaccagctaccccgagtcccgcaagtacacgctcgaggagatcaccgacgtggtcgagggcctggtgagcgagcagaacatcaaggagtacatcgtgttctacacctccctgttcgggagcctcatcctgctgctcgccttcatcatgtccatcaccctgagcaagatcacgtccatcctggcccggcgcaacgtcatctactgcgaggagtgcagcatgtaccactccaagcggggcatcaagtacaacggggacttcaccaacaagtgcggcttctgcacgtgcaacgagcaggaggacgcggagggcctcgtgatccacaaggtgagcaagcgctgcacctacaagtaccagctgaagtgggccaaggtcctgatggtgaccctcgtgctgctgctgatcgcccagaacaccatcctcatcgtcgccgccgggaccgactgctgggcgaagaagtccctggacatggactgcatcggcccgatgctggacatcgggagctgcaccaacaagaacacgcggaactacgacaccgaggcccagaagctcgtgagccagtccaaggtcagccagctggacgccgaccaggcctccctgctcggcaacagcatcgactccgccatcaaggcgatccgcgcccagaagacctaccccaccatgcacctcctggagaccatcttcctgatgaagaactgcgactactacacgagcttcaaccacaactccgggtacagccaggccaagtggcggctgatcgccaagaccggccacttcgacatctgctcccgccacagcacccaccacttctgccggtgcatcaacgacggcaccaagtgccagaacggggactgggacttcgccggcgagatgaacgagacgtacaactccaagaacgacttctacagccacgacctgaacctcttctacaccatcttcgagaacgcgttccccgggaccaccgagtccctgttctaccagctgatccagaagaagaacacggccggcgccagcaagatcctcgggaagctgatcaccaagtacggcaacaacaacatgttcgtgggcgtgtggaagttcgggcagtacctgctcaccctgccctacatcaacaacaccgagctgtcccagaaccgccggcagacgatcctcgccacccaggagagcctgtcccgcagccacagcggccgccaggagtccatgagctccgcgatccaggggagcgtcaccaaggagtgccacaacgccaaggacgtgggctgcatctccccgcggttcggcatccccatcgggaacctgaccgcctgcggcgacagccccaactacaagatctacaagacgcccgagaagctctacaagtccaacaacaagggggaggtgtggtgcagcaacgacgtccactgcctgaacgacttcgagccggccgacgaggaggtggtgaacaaggtcaagaagctgacctgcttcctcaccgacgtgtccgtgaagaccgacatcttcagcgtcgccgcgtccacgtgcaagatggccgacaagggcatctgcaccgtgaacgacgccaagtggaacatcatcaagtgcgacagcgggctgtactacttcaccgaccaccgcgagggccaggacaccggcaacgacttcggggagtactgcatctcccacagctgcaacacggagcggttccccatcaaccccgacatcctgaaggactgcacctgggagttccactcccgcaagagcaagtacatctccaccatcagcctcgagtccctggaggagttccggcgcgccatgaccgagaagctgagccacacgctcaccatctacaacttcaagcccaccgccaacctgccgcacatccggcccacctacaagttcatcacggcgaacggcgtggagaacagcgacgggatcgagtccgcctacatcctgagctccatccccgccctcggcgggatcagcgtcggctacaacgtgcagaccaaggacaacttccccctgctggacatcatcgtgttcatcaagtccgccgtcatccgcaccacctacaaccacatctacgacacgggcccgaccatcgggatcaacacccagcacgacgagcactgcaccggcccctgccccgccgtggtgccccacaaggagaactggatcaccttcagccaggagcggacgtcccgctgggggtgcgaggagttcggctgcctcgcgatcaacaccgggtgcgtcttcggcagctgccaggacatcatccacccggagaccaaggtgtaccggaaggccgtggaggaggaggtcgtgctgaccgtgtgcatcaacttccccggcaacaactactgcacggagatcaacgccgtcgagcccaagatcaccgacgagatcgagctgcagttcaagaccgtggacaccaagacgctcccgaacctgctggccgtgcagaaccacaagctctactccgggcagatcaacgacctgggcagcttctcccaggggtgcggcaacgtccagaagaccaaccacagcatcctggggatgggcaccgcgaagttcgactacgtgtgccacggcgcctcccgcaaggacgtgatcgtccggcgctgctacaacaacaacttcgacagctgccggctcctgaaggaggagacctccctgatcttcgccgacaaccacgagacgctcgaggtggcccacaccaagcacctgatcggggagctgcagttcaagatcatgctcggcgacatccgctacaagagcttcgccgagtcccccgagctggagatcgacgcgaagtgcgtggggtgccccagctgcttcgagtcctacagctgcaacttccagatcgtcaccaacatcgacaccgtgtgcagcgtggagggcccctgcacgctgttccacaaccggatcatcatctccgccaacaagcagagctacggcctcaagatgtcctgccagaccaagccgaaccagaacgaggagttcatcatctgcaaccgcaagtacagcgtcctgttcaccaccatcgacaagaacgacaagatcgaggtgaacacgggggaccagacctcctacatctacgagaaggacagccggtgcaagacctggctgtgccgcgtgcgcgacgagggcatctccgtcctcttcgagcccctgaaggccttcttcgggagctacttctccatcatcttctacgtggtggtcggcatcatcgtgctgttcctcatcatctacatcttcctgcccatgttcttcaagctgaaggacgtgctcaagcggaacgagtacctgtacctgcaggagctcaagcacaagtga

SEQ ID NO: 12550 - RNA, 4305 nt, synthetic construct
  misc_feature 1..4305: note = derived and/or modified CDS sequence (opt1) from CVV(MPB1-1551)__KX100143.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggcctccctgctcgggaacagcatcgactccgccatcaaggccatccgggcgcagaagacctaccccaccatgcacctcctggagacgatcttcctcatgaagaactgcgactactacaccagcttcaaccacaactccggctacagccaggccaagtggcgcctgatcgccaagaccgggcacttcgacatctgctcccggcacagcacccaccacttctgccgctgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggcgagcaaggtgctcggcaagctgatcaccaagtacgggaacaacaacatgttcgtcggcgtgtggaagttcggccagtacctgctcacgctgccctacatcaacaacaccgagctgtcccagaaccggcgcctcaccatcctggccacccaggagatcctgagccggagccactccgggcgccaggagagcatgtccaacgccatccagggcagcatcacgaaggagtgccacaacgccaagggggtgggctgcatctccccgcgcttcggcatccccatcgggaacctcaccgcgtgcggcgacagccccaactacaagatctacaagacccccgagaagctgtacaagtccaacaacaagggggaggtctggtgcagcaacgacgtgcactgcctgaacgacttcgagccggccgacgaggaggtgatcaacaagatcaagaagctgacctgcttcctgacggacgtctccgtggaggtggacatcttcagcgtcgccgcctccacgtgcaagatggccgacaagggcgtgtgcaccgtgaacggggcgaagtggaacatcatcaagtgcgacagcggcctgtactacttcaccgaccaccgggagggccaggacaccgggaacgacttcggcgagtactgcatctcccacagctgcaacaccgagcgcttccccatcaaccccgacaccctcaaggactgcacctgggagttccactcccgcaagagcaagtacatctccacgatcagcctggagtccctggaggagttccggcgggccatggccgagaagctcagccacaccctgaccatctacaacttcaagcccaccgccaacctgccgcacatccgccccacgtacaagttcatcaccgccaacggggtcgagaacagcgacggcatcgagtccgcgtacatcctcagctccatccccgccctcgggggcatcagcgtgggctacaacgtgcagaccaaggacaacttccccctgctcgacatcatcgtcttcatcaagtccgccgtgatccggaccacgtacaaccacatctacgacaccgggccgaccatcggcatcaacacccagcacgacgagcactgcaccgggccctgccccgccgtggtcccccacaaggagaactggatgacgttcagccaggagcgcacctcccggtggggctgcgaggagttcgggtgcctggccatcaacaccggctgcgtgttcggcagctgccaggacatcatccacccggagaccaaggtgtaccgcaaggcggtcgaggaggaggtggtgctgacggtctgcatcaacttccccgggaactcctactgcaccgagatcaacgccatcgagcccaagatcaccgacgagatcgagctccagttcaagaccgtggacacgaagaccctgccgaacctgctcgccgtgcagaaccacaagctgtacagcggccagatcaacgacctggggtccttcagccagggctgcgggaacgtccagaagaccaaccactccatcctcggcatgggcaccgtgaagttcgactacgtgtgccacggggccagccggaaggacgtcatcgtgcgccggtgctacaacaacaacttcgactcctgcaagctgctgaaggaggagacgagcctcatcttcgcggacaaccacgagaccctggaggtggcccacaccaagcacctgatcggcgagctccagttcaagatcatgctgggggacatccgctacaagtccttcgccgagagccccgagctggagatcgacgccaagtgcgtcggctgcccctcctgcttcgagagctacagctgcaacttccagatcgtgaccaacatcgacacggtgtgctccgtcgagggcccctgcaccctcttccacaaccggatcatcatcagcgccaacaagcagtcctacgggctgaagatgagctgccagaccaagccgaaccagaacgaggagttcatcatctgcaaccgcaagtactccgtgctgttcaccacgatcgacaagaacgacaagatcgaggtgaacaccggcgaccagaccagctacatctacgagaaggactcccggtgcaagacctggctctgccgcgtccgggacgaggggatcagcgtgctgttcgagcccctgaaggcgttcttcggctcctacttcagcatcatcttctacgtggtcgtggggatcatcgtgctgttcctgatcatctacatcttcctgcccatgttcttcaagctcaaggacgtcctgaagcgcaacgagtacctgtacctccaggagctgaagcacaagtga

SEQ ID NO: 12551 - RNA, 4305 nt, synthetic construct
  misc_feature 1..4305: note = derived and/or modified CDS sequence (opt1) from CVV(W308-67)__KX100140.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgaccctcaccaagacgtacatctgctacctgctgatgcccatcttcatgccgatcgcctacctctacgggtgggcctacaacaagtcctgcaagaagtgcaactgctgcggcctggcgtaccaccccttcaccaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacgtcctaccccgagagccgcaagtacaccctcgaggagatcaccgacgtggtcgagggcctggtgtccgagcagaacatcaaggagtacatcgtgttctacaccagcctgttcgggtccctcatcctgctgctcgccttcatcatgagcatcacgctgtccaagatcaccagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagacggactgctggaccaagaagtccctggacatcgactgcatcgggccgatgctggacatcggcagctgcaccaacaagaacacccgcagctacgacgccgaggcgcagaagctcgtcagccagtccaagatcagccagctggacgccgaccaggcctccctgctcgggaacagcatcgactccgccatcaaggccatccgggcgcagaagacctaccccacgatgcacctcctggagaccatcttcctcatgaagaactgcgactactacaccagcttcaaccacaactccggctacagccaggccaagtggcgcctgatcgccaagaccgggcacttcgacatctgctcccggcacagcacgcaccacttctgccgctgcatcaacgacgagaccaagtgccagaacggcgactgggacttcgccggcgagatgaacgagacctacaagtccaagaacgacttctacagccacgacctgaacctcttctacaccatcttcgagaacgccttccccgggacgaccgagtccctgttctaccagctgatccagaagaagaacaccaccggcgcgagcaaggtgctcgggaagctgatcacgaagtacggcaacaacaacatgttcgtcggggtgtggaagttcggccagtacctgctcaccctgccctacatcaacaacaccgagctgtcccagaaccggcgcctcaccatcctggccacgcaggagatcctgagccggagctactccggccgccaggagagcatgtccaacgccatccaggggagcatcaccaaggagtgccacaacgccaagggcgtggggtgcatctccccgcgcttcggcatccccatcggcaacctcaccgcgtgcggggacagccccaactacaagatctacaagacccccgagaagctgtacaagtccaacaacaagggcgaggtctggtgcagcaacgacgtgcactgcctgaacgacttcgagccggccgacgaggaggtgatcaacaagatcaagaagctcacgtgcttcctgaccgacgtctccgtggaggtggacatcttcagcgtcgccgcctccacgtgcaagatggccgacaagggggtgtgcaccgtgaacggcgcgaagtggaacatcatcaagtgcgacagcgggctgtactacttcaccgaccaccgggagggccaggacaccggcaacgacttcggggagtactgcatctcccacagctgcaacaccgagcgcttccccatcaaccccgacaccctcaaggactgcacgtgggagttccactcccgcaagagcaagtacatctccaccatcagcctggagtccctggaggagttccggcgggccatggccgagaagctcagccacaccctgaccatctacaacttcaagcccacggccaacctgccgcacatccgccccacctacaagttcatcaccgccaacggcgtcgagaacagcgacgggatcgagtccgcgtacatcctcagctccatccccgccctgggcgggatcagcgtgggctacaacgtgcagaccaaggacaacttccccctgctcgacatcatcgtcttcatcaagtccgccgtgatccggacgacctacaaccacatctacgacaccggcccgaccatcgggatcaacacccagcacgacgagcactgcacgggcccctgccccgccgtggtcccccacaaggagaactggatgaccttcagccaggagcgcacctcccggtgggggtgcgaggagttcggctgcctggccatcaacaccgggtgcgtgttcggcagctgccaggacatcatccacccggagacgaaggtgtaccgcaaggcggtcgaggaggaggtggtgctgaccgtctgcatcaacttccccggcaacaactactgcaccgagatcaacgccatcgagcccaagatcaccgacgagatcgagctccagttcaagacggtggacaccaagaccctgccgaacctgctcgccgtgcagaaccacaagctgtactccgggcagatcaacgacctgggcagcttctcccaggggtgcggcaacgtccagaagaccaaccacagcatcctcgggatgggcacggtgaagttcgactacgtgtgccacggcgcctcccggaaggacgtcatcgtgcgccggtgctacaacaacaacttcgacagctgcaagctgctgaaggaggagacctccctcatcttcgcggacaaccacgagaccctggaggtggcccacaccaagcacctgatcggggagctccagttcaagatcatgctgggcgacatccgctacaagagcttcgccgagtcccccgagctggagatcgacgccaagtgcgtcgggtgccccagctgcttcgagtcctacagctgctacttccagatcgtgacgaacatcgacaccgtgtgcagcgtcgagggcccctgcaccctcttccacaaccggatcatcatctccgccaacaagcagagctacggcctgaagatgtcctgccagaccaagccgaaccagaacgaggagttcatcatctgcaaccgcaagtacagcgtgctgttcacgaccatcgacaagaacgacaagatcgaggtgaacaccggggaccagacctcctacatctacgagaaggacagccggtgcaagacgtggctctgccgcgtccgggacgagggcatctccgtgctgttcgagcccctgaaggcgttcttcgggagctacttctccatcatcttctacgtggtcgtgggcatcatcgtgctgttcctgatcatctacatcttcctgcccatgttcttcaagctcaaggacgtcctgaagcgcaacgagtacctgtacctccaggagctgaagcacaagtga

SEQ ID NO: 12552 - RNA, 4305 nt, synthetic construct
  misc_feature 1..4305: note = derived and/or modified CDS sequence (opt1) from CVV(W728-67)__KX100137.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggcctccctgctcgggaacagcatcgactccgccatcaaggccatccgggcgcagaagacctaccccaccatgcacctcctggagacgatcttcctcatgaagaactgcgactactacaccagcttcaaccacaactccggctacagccaggccaagtggcgcctgatcgccaagaccgggcacttcgacatctgctcccggcacagcacccaccacttctgccgctgcatcaacgacggcacgaagtgccagaacggcgactgggacttcgccggggagatgaacgagacctacaactccaagaacgacttctacagccacgacctgaacctcttctacaccatcttcgagaacgccttccccggcaccacggagtccctgttctaccagctgatccagaagaagaacaccaccggggcgagcaagatcctcggcaagctgatcaccaagtacgggaacaacaacatggtggtcggcgtgtggaagttcggccagtacctgctcacgctgccctacatcaacaacaccgagctgtcccagaaccggcgcctcaccatcctggccacccaggagctgctcagccggagccactccgggcgccaggagagcatgtccaacgccatccagggcagcatcacgaaggagtgccacaacgccaagggggtgggctgcatctccccgcgcttcggcatccccatcgggaacctgaccgcgtgcggcgacagccccaactacaagatctacaagacccccgagaagctgtacaagtccaacaacaagggggaggtctggtgcagcaacgacgtgcactgcctcaacgacttcgagccggccgacgaggaggtggtcaacaagatcaagaagctgacctgcttcctgacggacgtgtccgtggaggtcgacatcttcagcgtggccgcctccacgtgcaagatggccgacaagggcgtgtgcaccgtcaacggggcgaagtggaacatcatcaagtgcgacagcggcctctactacttcaccgaccaccgggagggccaggacaccgggaacgacttcggcgagtactgcatctcccacagctgcaacaccgagcgcttccccatcaaccccgacaccctgaaggactgcacctgggagttccactcccgcaagagcaagtacatctccacgatcagcctggagtccctcgaggagttccggcgggccatggccgagaagctgagccacaccctgaccatctacaacttcaagcccaccgccaacctcccgcacatccgccccacgtacaagttcatcaccgccaacggggtggagaacagcgacggcatcgagtccgcgtacatcctgagctccatccccgccctcgggggcatcagcgtgggctacaacgtccagaccaaggacaacttccccctgctggacatcatcgtgttcatcaagtccgccgtgatccggaccacgtacaaccacatctacgacaccgggccgaccatcggcatcaacacccagcacgacgagcactgcaccgggccctgccccgccgtcgtgccccacaaggagaactggatgacgttcagccaggagcgcacctcccggtggggctgcgaggagttcgggtgcctggccatcaacaccggctgcgtgttcggcagctgccaggacatcatccacccggagaccaaggtctaccgcaaggcggtggaggaggaggtggtcctcacggtgtgcatcaacttccccgggaacaactactgcaccgagatcaacgccatcgagcccaagatcaccgacgagatcgagctgcagttcaagaccgtggacacgaagaccctgccgaacctcctggccgtccagaaccacaagctgtactccggccagatcaacgacctcgggagcttctcccagggctgcgggaacgtgcagaagaccaaccacagcatcctgggcatgggcaccgtgaagttcgactacgtctgccacggggcctcccggaaggacgtgatcgtgcgccggtgctacaacaacaacttcgacagctgcaagctgctcaaggaggagacgtccctgatcttcgcggacaaccacgagaccctggaggtcgcccacaccaagcacctcatcggcgagctgcagttcaagatcatgctgggggacatccgctacaagagcttcgccgagtcccccgagctcgagatcgacgccaagtgcgtgggctgccccagctgcttcgagtcctacagctgcaacttccagatcgtgaccaacatcgacacggtctgcagcgtggagggcccctgcaccctgttccacaaccggatcatcatctccgccaacaagcagagctacgggctgaagatgtcctgccagaccaagccgaaccagaacgaggagttcatcatctgcaaccgcaagtacagcgtgctgttcaccacgatcgacaagaacgacaagatcgaggtcaacaccggcgaccagacctcctacatctacgagaaggacagccggtgcaagacctggctgtgccgcgtgcgggacgaggggatctccgtgctgttcgagcccctcaaggcgttcttcggcagctacttctccatcatcttctacgtcgtggtggggatcatcgtcctgttcctgatcatctacatcttcctccccatgttcttcaagctgaaggacgtgctgaagcgcaacgagtacctctacctgcaggagctgaagcacaagtga

SEQ ID NO: 12553 - RNA, 4305 nt, synthetic construct
  misc_feature 1..4305: note = derived and/or modified CDS sequence (opt1) from CVV(WI-03BS7669)__KX100152.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatcctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggatcaagaagtccctggacatcgactgcatcgggccgatgctggacatcggcagctgcacgaacaagaacacccgcagctacgacaccgaggcccagaagctcgtcagccagtccaagatcagccagctggacgcggaccaggtgtccctgctcgggaacagcatcgactccgccatcaaggccatccgggcccagaagacctacagcaccatgcacctcctggagacgatcttcctgatgaagaactgcgactactacacctccttcaaccacaacagcggctactcccaggccaagtggcgcctgatcgcgaagaccgggcacttcgacatctgcagccggcactccacccaccacttctgccgctgcatcaacgacggcacgaagtgccagaacggcgactgggacttcgccggggagatgaacgagacctacaacagcaagaacgacttctactcccacgacctgaacctcttctacaccatcttcgagaacgccttccccggcaccacggagagcctgttctaccagctgatccagaagaagaacaccaccggggcctccaaggtcctcggcaagctgatcaccaagtacgggaacaacaacatgttcgtgggcgtgtggaagttcggccagtacctgctcacgctgccctacatcaacaacaccgagctgagccagaaccggcgcctcaccatcctgaccacgcaggagctgctcagccggtcccacagcgggcgccaggagtccatgagcaacgccatccagggctccatcaccaaggagtgccacaacgcgaagggggtcggctgcatcagcccccgcttcggcatcccgatcgggaacctgaccgcctgcggcgactcccccaactacaagatctacaagacccccgagaagctgtacaagagcaacaacaagggggaggtgtggtgctccaacgacgtgcactgcctcaacgacttcgagcccgccgacgaggaggtcgtgaacaagatcaagaagctgacgtgcttcctgaccgacgtgagcgtcgaggtggacatcttctccgtggccgcgagcacgtgcaagatggccgacaagggcgtctgcaccgtgaacggggccaagtggaacatcatcaagtgcgactccggcctctactacttcaccgaccaccgggagggccaggacaccgggaacgacttcggcgagtactgcatcagccactcctgcaacaccgagcgcttcccgatcaaccccgacatcctgaaggactgcacctgggagttccacagccggaagtccaagtacatcagcacgatctccctggagagcctcgaggagttccgccgggccatggccgagaagctgagccacaccctgaccatctacaacttcaagcccaccgcgaacctcccccacatccgcccgacgtacaagttcatcaccgccaacggggtggagaactccgacggcatcgagagcgcctacatcctgtccagcatccccgccctcgggggcatctccgtcggctacaacgtgcagaccaaggacaacttccccctgctggacatcatcgtgttcatcaagagcgccgtcatccggaccacgtacaaccacatctacgacaccgggcccaccatcggcatcaacacccagcacgacgagcactgcaccgggccgtgccccgcggtggtgccccacaaggagaactggatgacgttctcccaggagcgcaccagccggtggggctgcgaggagttcgggtgcctggccatcaacaccggctgcgtcttcggctcctgccaggacatcatccaccccgagaccaaggtgtaccgcaaggccgtggaggaggaggtcgtgctcacggtgtgcatcaacttcccggggaacaactactgcaccgagatcaacgccatcgagcccaagatcaccgacgagatcgagctgcagttcaagaccgtcgacacgaagaccctgcccaacctcctggccgtgcagaaccacaagctgtacagcggccagatcaacgacctcgggtccttcagccagggctgcgggaacgtgcagaagaccaaccactccatcctgggcatgggcaccgtcaagttcgactacgtgtgccacggggcgagccggaaggacgtgatcgtccgccggtgctacaacaacaacttcgactcctgcaagctgctcaaggaggagacgagcctgatcttcgccgacaaccacgagaccctggaggtggcccacaccaagcacctcatcggcgagctgcagttcaagatcatgctgggggacatccgctacaagtccttcgccgagagcccggagctcgagatcgacgcgaagtgcgtgggctgcccctcctgcttcgagagctacagctgcaacttccagatcgtcaccaacatcgacacggtgtgctccgtggagggcccctgcaccctgttccacaaccggatcatcatcagcgccaacaagcagtcctacgggctgaagatgagctgccagaccaagcccaaccagaacgaggagttcatcatctgcaaccgcaagtactccgtcctcttcaccacgatcgacaagaacgacaagatcgaggtgaacaccggcgaccagaccagctacatctacgagaaggactcccggtgcaagacctggctgtgccgcgtgcgggacgaggggatcagcgtcctgttcgagccgctcaaggccttcttcggctcctacttcagcatcatcttctacgtggtggtcgggatcatcgtgctgttcctgatcatctacatcttcctccccatgttcttcaagctgaaggacgtgctgaagcgcaacgagtacctctacctgcaggagctgaagcacaagtga

SEQ ID NO: 12554 - RNA, 4317 nt, synthetic construct
  misc_feature 1..4317: note = derived and/or modified CDS sequence (opt1) from CHLV(CHLV-Mex07)__JN808310.1__GP
  source 1..4317: mol_type = other RNA
atggagcccagcatcaagctgttcctcatcctggccatcgccgcggccgccgtgcactccctgccggccagccgctgcttctccgagggcatcgtcatcaaggagaagcaggacagcaaggccgtgtccgagttctgcctcaaggacgacgtgagcatgatcaagtcccacgtcgtgtacagcaagaacgagtccgggatcttcgcgaacagccagatcctgcggaagtggatcatcaaggactggaagctgtgcagccccctccccaccgccggcgggcagatcaacgtgatcgagatcaaccacgacctgaccctgagcacgaagacctacgtctgcaccaccgactgcacgatcggcatcgacaaggagaacgcccagatcaccttccagaccaacaagctcaactacttcgaggtgtccgggaccacgatcagctccggctggttcaagagcaagacctccgtgagcctggaccagacctgcgagcacctgaaggtctcctgcggcaagaagtccatgcagttccacgcctgcttcaagcagcacatgagctgcatccgctacctccaccggaccgcgctgcccgggtacatggccgcctccatctgcagcaacatcgagctgatcatcatgacgaccctcaccctggccatcttcatcctgctctgcatcatcaccaagacgtacatctgctacctgctgatgcccctcttcatgccgatcgcctacatctacggctggctgtacaacaagtcctgcaagaagtgcaactgctgcgggctgagctaccaccccttcaccaactgcggctcctactgcgtgtgcggggcgaagttcgagaccagcgaccgcatgcggatccaccgcgagtccggcctctgccagggctacaagagcctgcgggtggcccgcaagctgtgcaagtccaaggggagctccctcgtcatcagcatcaccctgtccgtgttcatcttcagcttcatcacgcccatcggcggggccatcatcaacgacaagctgtccgaggagaagtacagcatcaaccagatgatggacgccatcgtggacctcgagaacttctcccacaacgtcagcggcacccagcaggtcatctccgtgatcttcctgctgatcagctgcctcttcctgctgctcacctaccacctgaacaagatcatccagcacctggcccggttcggcctcctgttctgcgaggagtgcagcatgtaccactccaagaaggacatcaagtacaacggggacttcaccaacaagtgcggcttctgcacgtgcgggcagccggaggaccccgagggcctgaacctccacatcctgagccagaactgcacctacaagcagcagttcaagtgggtgaagatcatcatctccatcctgctcagcctgatcatcatcgagaactccatgatcctggcggccgccgagaccgactgcttcagcgagaagcagatctccgagttctgcctcgggcccctgctgagcatctccagctgcgaggacaagaactcccgcaccttcaagggcgaggcccagaagctggtggccctcaagaagatcacgagcgacgaggcgatgctgatcgagtccatgggcgccaacgtggagggggccctggagatgatccaggcccagaagtcccccgacagcatgtacaccatggagtacgtcttcctcaacacctactgcgactactacagcctgttcgagcacaactccggctacagccaggtgaagtggcggtacatcctgaagacccaccagttcgacgcctgcgcgcgccacagcaactcccacttctgccggtgcatgagcgacgggatgcactgcccgtccagcgactgggacatcgccgacgagctcgacaacacgtacatcaccaagcccaacttcttcaagcacgactacaacctgctgctcgacgtgatcaccgccgccttccccggcaccggggcggtcttcgtgatcgacgcctgcaagaaggccaacgccacggccatcaagaccttctccaacaacatcatcgcgcgcttcccctacaacaacctgctgaagggcgtcatgaagttcctccagtacatcagcaagcacccgtccttcaagaagtaccagcccgacacccggcactacgacctgatccccgtggcccccaccgcccgcggccggagcctggggcgctccaacagctacaacaacgcccagatcggctccccgaccaaggactgccagatgctcaaggaggtggggtgcctgagccccaagttcggcctgcccctcgagtccatcatcagctgcgggtccagccccaactacaagctgtacaagaagccgcagaagtactacaagtccaacaacaaggagaacacgtggtgcagcaaggacgtccactgcctgcacgacttcgagcccatcaccgaggacgtgctcgagaaggtgaaggtcatgacctgctgggagatcgagcccggcaccatcgaggacatcttcacgatcgcctccgagacctgcaagatcaacgaccggggcgtgtgcgaggtgaacgcggccaagtggaagatcgtcaagtgcgagaccgggctgtactactacaccgaccaccgcgagggcgacgacacggggagcgacctgggccactactgcctcacccacaagtgcgccggcgggcggtaccccatcaacccggagatcctgcagaactgcgtgtgggagttccacagccagaagtcccagtacatcaaccaggtggacctggagcagatcgaggagtacaagaaggccctcaccgagaagctgacccacacgctgaaccactacaacttcctccccaccaagaacctgccccacatcagcccgaactacaagtacgtcaccctgaacggccaggagacctccgacgggatcgagaacagctacatcgtgtccgagatccccgccatcgcgggcacgagcatcgggctcaaggtgcagaccaagaccaacgacgacatcttcgacctgatcatctacgtcaagcgcgccgacatcatcgcctcctacaaccacatctacgacaccggccccacgatcggccacaacgtggagcacgaggagctgtgcaccgggcagtgcccccagcacatcccggccaaggcgaactggctcaccttcagccaggagcgcacctcccggtggggctgcgaggagttcgggtgcctggccatcaacacgggctgcgtgtacgggagctgccaggacatcatcaagcccgtcgccaaggtgtaccgcaagtccaccgaggagaaggtggagctggagctctgcatcgtcctgcccgacaagaacttctgcaccaccctgaacgccctcgagcccaagatcacggaggagatcgagctgcagttcaagaccatcgaccagatgagcctgccgaacatcgtgctcctgcgggaccacaagctgttcaagggccagatcaacgacctcggcaccttcgggcagaactgcggcaacgtgcagaagaccaaccagtccatcctgggggccggcacggtccgcttcgactacctgtgccacagcgcgtcccggaaggacatcatcatccgccggtgctacaacaacaactacgacagctgcaaccacctccagctggccgagtccctgatcttcctcgacaaccacgagaccctggaggtgcgcaagcccaaccacatcctggggaccctcagcatgaagctgatgctgggcgacttccagtacaagaccttcgccaaggacatcgagctcgacttcacgggccggtgcgtggggtgcatcggctgcttcgaggggttcgtctgcgagatgcacatcaccaccaccgtggaggcgacctgcaacctggaggcctcctgccagttcttccacaaccagctgcacatcaagcccgacgtgctcaagtactacacgaagatgacctgccagaccgacgagtacatccccagcaagatcaagatctgcaacaaggagtacaagatcaccgtcggcaaggtgcagaagaacgacaagatcgagatcgacaacagcgaccagacgtcctacatcaaggagaaggacgagcgctgcaagacctggctgtgccgggtgcgcgacgaggggatcagcgtcatcttcgagccgctgctcaacatcttcggcaactacggccggatcgccgtggccgtgatctccgccatcctggccctgatcatcctcgtctacatcctgatgcccatctgcatgcgcatccgggacatcctgaagaccaacgagcgcgagttcctcatcgagagcaagtacaagtga

SEQ ID NO: 12555 - RNA, 4305 nt, synthetic construct
  misc_feature 1..4305: note = derived and/or modified CDS sequence (opt1) from FSV(86MSP18)__KX100131.1__GP
  source 1..4305: mol_type = other RNA
atgctgagcctcctgatcctggccctcctgggcctgtccaccagcaaccccatcgccacccgctgcttccacgggggccagctcatcgcggagtccaagagcgccacgtccatcagcgagttctgcctgaaggacgacgtgtccatgctcaagagcgaggtcatctacaccaagaacgacaccgggctgttcggccacaacaaggtgttccggtcctggaccatcaaggactggaagctgtgcaacccgatccccacggccgggggcaccatcaacgtgatcgaggtcaacaaggacctgagcctcatgaccaagacctacatctgctcccgcgactgcacgatcaccatcgacaaggaggaggcccagatcatcttccagaccgacaagctgaaccacttcgaggtgagcggcaccacgctgtccagcgggtggttcaagtccaaggccagcgtgaccctcgaccggacctgcgagcacgtcaaggtgacctgcggcaagaagtccctgcagttccacgcgtgcttcaagcaccacatgagctgcgtgcgcttcttccacaacacgatcctgcccgggaacatgatcacctccatgtgccagaacatcgagctcatcatcatcctgggcctgaccctcgccatcttcatcctgatggtcatgatcaccaagacgtacatctgctacctgctcatgcccatcttcatgccgatcgcctacctgtacgggtgggcctacaacaagagctgcaagaagtgcaactgctgcggcctggcgtaccaccccttcaccaactgcggcagccactgcgtgtgcgggctcaagttcgaggcctccgaccggatgcgcatccaccgggagagcggcctgtgccaggggtacaagtccctgcgcatcgcccggctcctgtgcaagagcaagggctccagcctggtgatctccggcctcctgagcatgctgatcctctccttcgtcacccccatcgaggggaccatcacgaactaccccgacagccgcaagtacaccctggaggagatcaccgacgtggtggagggcctgatctccgagcagaacatcaaggagtacatcgtcttctacaccagcctcttcgggtccctgatcctgctcctggccttcatcatgagcatcacgctgtccaagatcaccagcatcctcgcccggcgcaacgtgatctactgcgaggagtgctccatgtaccacagcaagcggggcatcaagtacaacggggacttcaccaacaagtgcggcttctgcacgtgcaacgagcaggaggacgcggagggcgtggtcatccacaaggtgtccaagcgctgcacctacaagtaccagctgaagtgggccaaggtgctgatgatcaccctcgtcctgctgctgatcgcccagaacaccatcctcatcgtggccgccgagaccgactgctgggcgaagaagtccctggacatcaactgcatcgggccgatgctgaacatcggcagctgcacgaacaagaacacccggagctacgacaccgaggcccagaagctcgtgagccagtccaaggtcagccagctggacgccgaccaggcctccctgctcgggagctccatcgacagcgccatcaaggcgatccgcgcccagaagacctaccccgccatgcacctcctggagaccatcttcctcatgaagaactgcgactactacacgtccttcaaccacaacagcggctactcccaggccaagtggcggctgatcgccaagaccgggcacttcgacatctgcagccgccactccacccaccacttctgccggtgcatcaacgacggcaccaagtgccagaacggcgactgggacttcgcgggggagatgaacgagacgtacaacagcaagaacgacttctacctgcacgacctcaacctgttctacaccatcttcgagaacgccttccccggcaccaccgagtccctgttctaccagctcatccagaagcgcaacacgatcggggccagcaaggtgctgggcaagctgatcaccaagtacggggacaacaacatgttcgtcggcgtgtggaagttcggccagtacctcctgaccctgccctacatcaacaacaccgagctctcccagaaccggcgccagacgatcctggccgcgcaggagctgagcagccgctcccacccggggcggcaggagagcatgtccagcgccatccagggctccgtgaccaaggagtgccacaacgccaaggacgtcgggtgcatcagcccccgcttcggcatccccatcggcaacctcaccgcctgcggggactcccccaactacaagatctacaagaccccggagaagctgtacaagagcaacaacaagggcgaggtgtggtgctccaacgacgtgcactgcctgaacgacttcgagcccgccgacgaggaggtcgtgaacaaggtgaagaagctcacgtgcttcctgaccgacgtcagcgtgaagaccgacatcttctccgtggcggccagcacgtgcaagatggccgacaagggggtctgcaccgtgaacgacgccaagtggaacatcatcaagtgcgactccggcctgtactacttcaccgaccaccgggaggggcaggacaccggcaacgacttcggcgagtactgcatcagccactcctgcaacaccgagcgcttccccatcaaccccgacatcctcaaggactgcacgtgggagttccacagccggaagtccaagtacatcagcaccatctccctggagagcctggaggagttccgccgggccatgaccgagaagctcagccacaccctgacgatctacaacttcaagccgaccgcgaacctgccccacatccgccccacctacaagttcatcaccgccaacggggtggagaactccgacggcatcgagagcgcctacatcctctccagcatccccgccctcgggggcatctccgtcgggtacaacgtgcagacgaaggacaacttcccgctgctggacatcatcgtgttcgtcaagagcgccgtgatccggaccacctacaaccacatctacgacaccggccccacgatcggcatcaacacccagcacgacgagcactgcaccgggccctgccccgcggtggtcccgcacaaggagaactggatcaccttctcccaggagcgcaccagccggtggggctgcgaggagttcgggtgcctggccatcaacacgggctgcgtgttcgggtcctgccaggacatcatccaccccgagaccaaggtgtaccgcaaggccgtcgaggaggaggtggtgctgaccgtctgcatcaacttccccggcaacaactactgcaccgagatcaacgccatcgagccgaagatcacggacgagatcgagctccagttcaagaccgtggacaccaagaccctgcccaacctgctcgcggtgcagaaccacaagctgtacagcggccagatcaacgacctggggtccttcagccagggctgcgggaacgtccagaagacgaaccactccatcctcggcatggggaccgccaagttcgactacgtgtgccacggcgccagccggaaggacgtgatcgtccgccggtgctacaacaacaacttcgactcctgcaagctgctgaaggaggagaccagcctcgtgttcgccgacaaccacgagaccctggaggtggcccacacgaagcacctgatcggcgagctccagttcaagatcatgctgggggacatccgctacaagtccttcgcggagagccccgagctggagatcgacgccaagtgcgtcggctgcccctcctgcttcgagagctacagctgcaacttccagatcgtgaccaacatcgacaccgtgtgctccgtcgaggggccgtgcaccctcttccacaaccggatcatcatcagcgcctccaagcagagctacggcctgaagatgtcctgccagacgaagcccagccagaacgaggagttcatcatctgcaaccgcaagtactccgtgctgttcaccaccatcgacaagaacgacaagatcgaggtgaacaccggcgaccagacgagctacatctacgagaaggactcccggtgcaagacctggctctgcaaggtccgcgacgaggggatcagcgtgctgttcgagcccctgaaggccttcttcggctcctacttcagcatcatcttctacgtggtcgtggggatcatcgtgctgttcctggtcatctacatcttcctgcccatgttcttcaagctcaaggacgtgctgaagaagaacgagtacctgtacctccaggagctgaagcaccgctga

SEQ ID NO: 12556 - RNA, 4314 nt, synthetic construct
  misc_feature 1..4314: note = derived and/or modified CDS sequence (opt1) from GERV__M21951.1__GP
  source 1..4314: mol_type = other RNA
atggccatcagcacctccctgctcatcgtggccctgctgatcaagctctgcctggtcaacaccgcgcccccgatcagcaagtgcttccaggacggcatcctgatcgccgagctcaagtccagctccgggatcagcgagttctgcatcaaggacgacatctccatcctcaagagcgagatcacgtactccaagaacgacaccggcatcttcatgcacagcaaggtgttccgccactggaccgtggccgactggaagcagtgcaaccacacctccgccgggggcagcacgaacgtcctggaggtggacaagaacctcaacctggtggccaagaactacatgtgcacccggccctgcgtcatcaccatcgacaaggagaacgcgcagctgctgttccagaccgagcagctgaaccagttcgaggtgacggggaccaccatctccaccggctggttcaagagcaagacgtccgtgagcctggacaacacgtgcgagcacatcaaggtgacctgcggcaagaagtccctccagttccacgcctgcttcaagcagcacatgagctgcgtccgcttcctgcaccggtccgtgctgcccgggtacatggccagcagcatctgccagaacatcgagctcatcatcatcatcatcctgaccctggccatcttcatcttcatgtgcatcatcacgcgcacctacatctgctacctcatgctgcccctgttcgcgccgatcgcctacctctacggctggctgtacaaccggtcctgcaagaagtgcatctgctgcgggctggcctaccaccccttcaccaactgcggcagctactgcgtctgcgggtcccgcttcgagaccagcgaccggatgcgcctccaccgggagtccggcctgtgccagggcttcaagagcctgcgcgtggcccggtccctctgcaagagcaaggggtccagcctggtgatctccatcctgacggccatgctcatcctgagcttcatcacgcccctggaggcgatgaccaccaactaccccgacgacaagaagttcaccctcaaggaggtcaacgacatcgtgctgggccgcgacatggagcaggagctgaagtccagcatcctcatcctgatgtccatctgcgggatcggcatcatcctgatcttcttcggcctcaccgtgctgctggagatcgtcctcgagctgatcgccaagcggagcaccatcttctgcaaggagtgcaacctgatccacgacaagaagtccatgacctaccgcggggacttcacgaacaagtgcggcttctgcccgtgcggggagctcgaggaccccgagggcctggtgatccacaccacccgcaagagctgcacctactacatcaagatccggaacctgaagctgatcatgctcatcttctccatcgtgatcctgatgcagaacgccacgatgctggtcgtggccggggagaactgctggaccaacaccgagatcaaggccgactgcgtgggccccctcatcggccccagcgcgtgcaccaacaaggggagcaagacgtacaagaccgtcgcccaggagctggtgaccgcctccaagatcacccagctggacgccgacaagtacgtcctcctgggcgacaccatcgagagcgccctggacgcgatcacgtcccagaagcactacagcgccatgcacctcctggagaccatgttcctgatgaagcactgcgactactacaaggtgtacgagcacaactccgggtacagccagaccaagtggcggctcatcgccatcgccaactccttcgacatctgcaccaacacgccgacccccaacttctgcaagtgcctgagcgactccagctgctccaccaccacgctgaacttcgccaccagcatgaacgcgacctacacctccaaggtggagttcttcaaccacgacttcaccctcttcctggacatcttcgaggccgccttccccggcagcgccaccgcgttcctgttcaagaagatcaaggagaagaacccctaccaggccttcgagatgatggggaagatcgccaacaagtacccgaacaacaagctcctggtcgtgatcctgaagtacggccagtacatggtgggcctctcccacgccagcacctaccagctgaagcaggagtgggtcgccaagtccctgagcctcacccgcgcgcagcggacggggctgaagatgagcatggccaacgccgagcccggccccgccaccaaggagtgctccgacgccaagaccatcgcgtgcctgacccccaagttccaggtggaggtgaacaacctcatgagctgcggggcctccccgaacttcaagatctacgtcaagacgggcgagctgtacaaggcccacgaccgcaacagcgtgtggtgcctgaacgacatgcactgcctcaccccctacacccccgccaacgccgagatcatcaccacgatgaagaagatggactgctggcaggacaaccccaagcagccgaccgacgagtacgcgatccccaagcggtcctgccagatgaaggaccgcgggctgtgcaacagcggcgccgacaagtggaagatcatcaagtgcgacaaccacaagctgttctacaccgacgccctcgagcgccgggaccccgcctccatcgtgggcagcaaccactgcttctccgagaagtgccagatcgagcgctaccccatcaacccgaccagcctgacgaactgcgagtggctgtaccgggcggtccgccccgagtacatcaagaagctctccctgcagaccatcgaggagtacaagaaggccatcgccgacaagctgacccacaccctccagctgtaccacttcgcgcccctgctcgagaacctgccgcacatcaagcccacgtacaagtacatcaccgcccaggggacctacaccgccgacggcatcgagggggccagcatcacgacctccatccccgccctgagcggcacctccgtgggcttcaagatcaacgccaaggacgggaccgacctcctggacatcgtggtctacatcaaggccagcgtggtgaagtccatctacaaccacatctacgacaccggccccacgatcaacatcaacagcaagcacgacgagctgtgcaccgggcagtgcccgaagaagatccccgcggaccccaactggctcaccttctcccaggagcggaccagccgctggggctgcgaggagttcgggtgcctggccatcaacacgggctgcgtctacggcagctgccaggacgtgatccggaccgagaccaaggtgtaccgcaaggccaacgaggagaccgtcatgctgacggtgtgcatcacctaccccgggcacaccttctgcaccgacgtgaacgcccacgagccgaagatcacggacgagctcgagctgcagttcaagaccatcgacatcaagtccctgcccaacctcgtcgccgtgaccaaccacaagctgtacaccggccagatcaacgacctggggacgttcggccagatgtgcgggaacgtgcagaagaccaacaccagccacaccggcgcgggcacgcccaagttcgactacacgtgctactccgccagccggaaggacatcatcatccgccggtgctacaacaacaactacgactcctgccgcctcctgaaccaggagagcgacctcctgttcgacgacaaccacgagaccctggtcgtgtacaacaacaagcggctgaacggggagctcgccctgaagctgctcctgggcgacatccagtacaagctgtacaccgagaacatggagctcgagctggaggccaagtgcgtggggtgcgtcggctgcttcgagtcctaccagtgcaacctgcagatcaccagctccctcgacgagaccgcgctgtacctggtgcccgtgagccacttccacgaccgcatccagatcaagaccaccaagaaggactacgccatgaagatctcctgcacgcgggacccgggggacaaggccagcttccgcgtctgcggcaagtcctacgacttcaacttccacaccgtgcccaagaacgacaagatcgaggtgaacgtcggcgacgagaccagctacatcaaggagaaggacaaccggtgcgggcgctggctctgccgggtgcgcgacgagggcctgtccgtgatcttcgagcccctgaacaacttcttcgggaactacctcaacatgttcctgtacatcctgggcgggatcatcctcctgttcctggccctctacatcctgatgcccatgtgcgcccgcctgcgggacgagctcaagcgcaacgagcggctgcaccagatggagatgaagaagcgctga

SEQ ID NO: 12557 - RNA, 4260 nt, synthetic construct
  misc_feature 1..4260: note = derived and/or modified CDS sequence (opt1) from IACOV(BeAn314206)__JN572066.1__GP
  source 1..4260: mol_type = other RNA
atgcgcgtgatcgccctgttccacctcgtcatggtgatcaccgccaaccccgtgttccaccggtgcttccagggcgggcagctgatcctggagaagaagtcccacgtcagcatgagcgagttctgcctcaaggacgacgtgtccatggtcaagagcgtggtggagtacgagaagaccaacaactccatcgtgggcacgaacaaggtctaccgccagtgggtggtgagcgactggaagctgtgccacccgatcaaggcggagggcggcgggatcaacatcatcgaggtcgagaaggacctgaccatcaagtccaacacctacatctgcaccacggactgcaccatcaccgtggacaaggagaacgcccagatcatcttccagaccagcaagctcaaccacttcgaggtgacggggaccaccctgtccaccggctggttcaagacgaaggccgccgtcaccctggaccagacctgcgagcacatccgggtgagctgcgggaagaagtccatccagttccacgcctgcttccgccagcacatgacctgcgtgcggttcctccaccgcagcctgctgcccggctccatggcgaacagcatctgccagaacgtcgagctcatcatcatcatcgtgctgacgctgctcatcttcatcgtgctgaacatcatcgccaagacctacatctgctacctgatgctccccatcttcatgcccatcgcctacatctacgggtggatctacaaccggtcctgcaagaagtgcgtcaactgcggcctggcctaccacccgttcagcaactgcgggtcccactgcgtgtgcggcgcgatcttccagaccagcgaccgcatgcggatgcaccgcgagtccggcctgtgcagcgggttcaagagcctccgggtggcccgcgtcctgtgcaagtccaagagctccagcctggtgatcgccatcctctccagcctgctgatcctctccttcgtcacccccatcgagggcctggacctggaggagaagaagtacagcctctccgacctgcccgacatctacacgaaggagctgaacaccctcagcgagaagatcgccatcaacttctacatctccatcaccaacatgctgatcaccatcatcctgctcatcgtggccttctgcagccactgcatcacgaacaagatcgtgaagtacaaggcgttcctgtgcaccgagtgcgacatgtaccacacctacaagaacatccggtacaacggggacttctgcaacaagtgcggctcctgcacgtgcggcaccatggaggaccccaactacaccaccatgcacaaggtcagcgacctgtgcctcgccgagccgaagcgcatcatccagaagaagctgatgatcatcctgatcatcttcgtgatcatcgagaacggggcctgcctcgcctccgccgaggagaagtgcttcaaggagcacgactacaacatcgagtgcatcggccccctgatcaccatgcggccctgcacgaagaagaccatccaggaggtggcgcgcaccctggtcaccgacaagcagatcgcccaggaggacacggagaagatcgagctcctgcccgacagcatcgtgcaggcctggaacatgatcgacaaccagctgaactacgaccagatgttcctcatggagtacgccttcctgaagcgggagtgctccttcttcgaggagttcgagcacaacagcggggtgaaccagatcatgtggcgcaccatcgccaagaccggccacttcgacatctgcgcgatccggtccagccagcgcttctgcaagtgcatgagcgagtccgtctactgcaaggacgccaactgggacatcgccaacgagatgaacgacacctacagcttcaagccgctgttctaccggcacgacgtgaagctgtactccaagatcttcaaggccgccttccaggggaccacgctcaagacctacgagaagttcctgaacgcgaagaacaagaccgagctgatcaacatgctcaagaagctgggcaagcgcttcccctacaacaacctgctcatgggcttcctgaagttcggggagctcctcttcgacctgaccctgttcgacgccctccccaaggacaagacgagccgcacctccagcaccaccgccaagcgggagtacgagaacctgcaggacgccaaggtgggcgagcccacgtccgagtgcaaggacatgaagctgctccagtgcatcagcccgcgctaccaggtctccgtggggagcgtgatcaagtgcggcgacaccgagaagaagatctacgacttccacacccccgtctacaagctggcgaccgacgagacgaagtggtgccggttcgacaagcactgcctgcacgagtgggtgcccatcgacaacgcccgcctcgagatgctgaagaagctgaactgctggtacaccgaccccaccgagatggtggacatctacaccacgtcccgcaagagctgccggatgatcaacaaggggacctgcaacatcaagaacgccccgatgaccgtcatgcagtgcgacgacgacctcatcttctacaccgaccaccggtccagcgccgacacgcagggcgacatcggcgagtactgcctgtcccagaactgcgacgtgagccgctaccccatcaacgtgatggacgggatgacctgcacctgggagtacaacaccgtcaagcccaagtacctgtccaagacggagctcaagaccctggaggagtacaagcggaccctgcaggacaagctcagccacaacctggaggtgtaccacttccacatgaccgccaacttcccccacatcaagccggtgtacaagtacatcacggcgggcggggtcgagaccagcgacggcatcgagggggccttcatcctggtggacctccccgccctgtccggcaccagcgtgggcctgaccgtcctctccaaggacgacgtgcccctgatggacgtgatcatctacatcaagagcgccgtcatcaaggccacgtacaaccacatctacgacaccgggcccaccatcggcatcaacgtgaagcacgaggagctgtgcaccgggccgtgcccccagaacatcccccaccaggagcagtggctcacgttctcccaggagcgcaccagccggtggggctgcgaggagttcggctgcctggcggtgggggagggctgcgtctacgggtcctgccaggacatcatcaagaaggagacccgcgtgtacaagaaggtgagcgaggagatcaacgagatcaccttctgcatcatcttccagaccaacacgtactgccagaccatgaacgccatcgagccgcagatcaccccctccctggaggtccagctcgagggcctggacaccaagatcctgcccaacatcctcgccctgcagaaccacaagctgtacagcgggcagatcaacgacctcggctccttcggcctggcctgcgggaacgtgcagcaggtcaacaagacgatctacggcgccgggcagcccaagttcgactacctgtgccacggcgcgaagcggaaggacatcatcgtgcgcaagtgctacaacaacaacttcgggagctgcaagctcctgaccatcgaggacaacctgatcgtggaggacaactacaacaccatcaacgtgatcaacaccaagcacctcatcggcacggtcaagtccaagctgaacctgggcgacatccggtacaagctgttcaacaagaagccggagttcgagctggaggcccactgcgtggggtgcgtgggctgcttcgccaactacaactgcgagatcaagatcgagagcaccatcgacatgacctgccccatctccgggccctgcgagttcttccacaacaacatcttcatccaggccgagcacaccaagtacgcgatgaagatgatctgcaagaagcagcccgaccagacgaccgagttcaccatctgcgacaagaagtaccacttcatcatcgacaccgtcgagaagcacgaccagatcgagatcgacgtgggcgaccagacgagctacatcctggagaaggacaaccgctgcgggacctggatgtgcaaggtgctcgacgagggcctgtccgtcatcttcgagccgctgaagctcctgctgggcaactacttccacatggccatcgtgatcatcatcgggctcatcgccctggccgtgatcatctacatcctgctccccatgttcatgaagctgcgggacaccctgaaggccaacgagatcgcgtaccagaaggagatgaagatcaagtga

SEQ ID NO: 12558 - RNA, 4305 nt, synthetic construct
  misc_feature 1..4305: note = derived and/or modified CDS sequence (opt1) from ILEV(KO/2)__AY859372.1__GP
  source 1..4305: mol_type = other RNA
atgctgttccccatcatcctcctgatgatccagctggtgagctccaccccgctcagcacccgctgcttccacgagggcacgctggtcaaggagaagatctccaccaccagcatctccgagttctgcctgaaggacgacgtgagcatgatcaagtccgagatcacctaccagaagaacgacacgggggtgtacggccacagcaagatctaccggaactggatcgtcaaggagtggaaggcctgcaaccccgtgccctccgccgggggcagcatcaacgtgatcgaggtcaacgaggacatgtccctcgcgaccaagaactacatctgcacccgcgactgcgtgatcaccgtggacaaggaggacgcccagatcgtcttccagacggacaacctgaaccacttcgaggtgagcgggaccaccctgtccagcggctggttcaagaccaaggcctccgtgacgctcgaccggacctgcgagcacatcaaggtcagctgcggcaagaagaccgtgcagttccacgcctgcttccgcaaccacatgtcctgcgtgcggttcttccacaacaccatcctgcccgggtacatggccacgagcatctgccagaacatcgagctgatcatcatcatcgtcctcaccatcgcgatcttcatcatgctggtgatcctgaccaagacctacatctgctacctcctgatgccgctgttcatgcccatcgcctactgctacggctgggcctacaacaagtcctgcaagaagtgcaactgctgcgggctcgcctaccaccccttcacgaactgcggcagcttctgcgtgtgcgggctgaagttcgaggcgagcgaccgcatgcggatccaccgcgagtccggcctgtgccagggctacaagagcctccgggtcgcccgccggctgtgcaagtccaaggggagctccttcgtgatcagcatcctgctctccctgttcatcctgagcttcgtgacccccatcgagggcaccatgaccaactacccggaggagcgcaagtacacgctcgaggagatcgccgacgtcatcgaggggttctaccaggaggccaagatcaaggagtacatcgtgttctactccagcatcttcggctccttcatcctgatcagctccatgctgatcctctacaagctgcagaacatcacctacttcctgagcaagttcaacgtgatgtactgctccgagtgcagcatgtaccactccaagaagaacatcaagtacctcggcgacttcaccaacaagtgcgggttctgcacgtgcggcgagctggaggacgccgaggggctgagcatccacaaggtcacgaagcggtgcacctacgcgtaccagatgacctggaccaagatcatcctcgccacgctgctgatcctcctgatcggccagaacaccctgctcgtggtctccgcccaggccgactgctgggagaagaccgagatcaccatcgactgcatcgggcccatcttcgcccccaacacgtgcatcaagcaggaggagaagacctacgcgaaggaggcccagaccctggtggaccagaacaagatcagccaggccgacgccaagcaggtcgacatgctgggcgccaccatcgacgacgcgatcaaggccatccgcagccagaagacctacacgaccatgcacatgctcgaggccatcttcctgtccaagtactgcgactactacagcctgttcgagcacaactccggctacagccaggggaagtggcggctcatcgccaagaccgagtccttcgacatctgcagccgccacaccacgcaccacttctgccggtgcatgtccgacgagaccaagtgcaagaacggcgactgggacttcgccggggagatgaacagcacctaccactccaagagcaacttcctgctgcacgacctgcgcctcttctacaagatctactccgcggccttccccggcctgagcgaggccatgctgtacaagttcctctccgagaaggacaccacgaacgccatcaagctgctggagaagctgttcaccaagtacagctacaacaacctcctggtggggatcctccggttcggcaagttcctgttctccatgagcatcttcaacaccaccgagctgggcggggcgcagaaggccatgatcctccgcccgacggacgagctgcggaccacctactccggcaagcaggagagcctgagcaactccgtggtgggggagcagaccagcgactgcgtcaacatgaagaagatctcctgcatcagcccccgcttcaacatccccctctccagcatgatcgcctgcggcaaccagcccaactaccagatctacaaggagccgtccaagtactacaagagcaacaacaagcccaacacgtggtgcaacaaggacatccactgcctgaacgacttcgagtccatcgaccagagcgccctggaccgcctcaagaccatgacctgcttcctgatcgaccccatcaccacggaggacgtgtactccatcgccatccacagctgcaaggtgaaggacaaggggcagtgcaccatccgggacaagaagtggaacatcatcaagtgcgactccgagctgctctactacaccgaccaccgcgagggcgaggacaccggcaacgagatcgggcactactgcctgagccacaagtgcggcacggaccggtaccccatcaacccggagatcatcaaggactgcatctgggagttccgctcccgcaagagcgagtacatcaaccgggtcgacctggagtccctcgaggagttcaagcgggcgctgagcgacaagctgacccacaccctcaccatctacaacttcaagcccacggccaacctgccccacatcaagcccatctacaagtacatcaccgccctgggggtggagaactccgacggcctcgaggccgcctacatcctgaccagcatcccggcgctgggcgggaccagcatcggctacaacatcatgacgaaggacaacttccccgtgatggacgtcatcatctacgtgaagtccgccgtgatccagaccacctacaaccacatctacgacaccgggcccacgatcggcatcaacagcaagcacgacgagaagtgcaccgggtcctgcccccagaacatcacccacgaccagaactggctcaccttcagccaggagcgcgcctcccggtggggctgcgaggagttcggctgcctggccatcaacaccgggtgcgtcttcggcagctgccaggacatgatccgctccgacacgaaggtgtacaagaaggccctggaggagaccgtggtcctcaccgtgtgcatcaactacccggggaacaccttctgcacggaggtgaacagcgtcgagaccaagatgaccgacgacgtggagctgcagttcaagaccgtggacacgaagaccctgcccaacctcctggcggtcaccaaccacaagctgtactccggccagatcaacgacctcgggagcttctcccagatgtgcggcaacgtgcagaagaccaacagcacggtgatgggcgccgggaccgtcaagttcgactacatctgccacggcgcctcccggaaggacatcatcatccgccggtgctacatgaacaactacgccagctgctccctgctgaaggaggagaaggacctcatcttcgcggacaaccacgagaccatcaccgtgagcaactccaagcacctggtgggggagctgcagatcaagctcatgctgggcgacatccgctacaagctgttcgccgagcggcccgagctcgaggtcgacgccaagtgcgtggggtgcccgagctgcttcgagtcctacagctgcaacttccagatcgtgacgaacatcgacaccgtctgcaccctggagggcccctgcaccatcttccacaaccgcatcatcatcagctccacgaagcagagctacggcatcaagatgtcctgccccaccaagcccaaccacatcgagaagttcaagatctgcaaccacgagtacgacatcctgttcgacaccgtggccaagaacgacaagatcgagatcgacaccggggaccagaccctcttcgtgcgggagaaggacacccgctgcaagacctggctgtgccgggtcaaggacgagggcatcagcgtgatcttcgagccgctgcgcgccttcttcgggtcctacttcagcatcatcttctacatcatcctcgcggccatcctgatcttcgtgggcgtctacatcttcctgcccatgttcatgcgcctccgggacgtgctgaagcgcaacgagcacctgtacctccaggagatcaagcacaagtga

SEQ ID NO: 12559 - RNA, 4305 nt, synthetic construct
  misc_feature 1..4305: note = derived and/or modified CDS sequence (opt1) from ILEV(R5964)__KF234074.1__GP
  source 1..4305: mol_type = other RNA
atgctgttccccatcatcctcctgatgatccagctggtgagctccaccccgctcagcacccgctgcttccacgagggcacgctggtcaaggagaagatctccaccaccagcatctccgagttctgcctgaaggacgacgtgagcatgatcaagtccgagatcacctaccagaagaacgacacgggggtgtacggccacagcaagatctaccggaactggatcgtcaaggagtggaaggcctgcaaccccgtgccctccgccgggggcagcatcaacgtgatcgaggtcaacgaggacatgtccctcgcgaccaagaactacatctgcacccgcgactgcgtgatcaccgtggacaaggaggacgcccagatcatcttccagacggacaacctgaaccacttcgaggtcagcgggaccaccctgtccagcggctggttcaagaccaaggcctccgtgacgctcgaccggacctgcgagcacatcaaggtgagctgcggcaagaagaccgtccagttccacgcctgcttccgcaaccacatgtcctgcgtgcggttcttccacaacaccatcctgcccgggtacatggccacgagcatctgccagaacatcgagctgatcatcatcatcgtgctcaccatcgcgatcttcatcatgctggtcatcctgaccaagacctacatctgctacctcctgatgccgctgttcatgcccatcgcctactgctacggctgggcctacaacaagtcctgcaagaagtgcaactgctgcgggctcgcctaccaccccttcacgaactgcggcagcttctgcgtgtgcgggctgaagttcgaggcgagcgaccgcatgcggatccaccgcgagtccggcctgtgccagggctacaagagcctccgggtggcccgccggctgtgcaagtccaaggggagctccttcgtcatcagcatcctgctctccctgttcatcctgagcttcgtgacccccatcgagggcaccatgaccaactacccggaggagcgcaagtacacgctcgaggagatcgccgacgtgatcgaggggttctaccaggaggccaagatcaaggagtacatcgtcttctactccagcatcttcggctccttcatcctgatcagctccatgctgatcctctacaagctgcagaacatcacctacttcctgagcaagttcaacgtgatgtactgctccgagtgcagcatgtaccactccaagaagaacatcaagtacctcggcgacttcaccaacaagtgcgggttctgcacgtgcggcgagctggaggacgccgaggggctgagcatccacaaggtgaccaagcggtgcacctacgcgtaccagatgacctggaccaagatcatcctcgccacgctgctgatcctcctgatcggccagaacaccctgctcgtcgtgtccgcccaggccgactgctgggagaagaccgagatcaccatcgactgcatcgggcccatcttcgcccccaacacgtgcatcaagcaggaggagaagacctacgcgaaggaggcccagaccctggtcgaccagaacaagatcagccaggccgacgccgagcaggtcgacatgctgggcgccaccatcgacgacgcgatcaaggccatccgcagccagaagacctacacgaccatgcacatgctcgaggccatcttcctgtccaagtactgcgactactacagcctgttcgagcacaactccggctacagccaggggaagtggcggctcatcgccaagaccgagtccttcgacatctgcagccgccacaccacgcaccacttctgccggtgcatgtccgacgagaccaagtgcaagaacggcgactgggacttcgccggggagatgaacagcacctaccactccaagagcaacttcctgctgcacgacctgcgcctcttctacaagatctactccgcggccttccccggcctgagcgaggccatgctgtacaagttcctctccgagaaggacaccacgaacgccatcaagctgctggagaagctgttcaccaagtacagctacaacaacctcctggtggggatcctccggttcggcaagttcctgttctccatgagcatcttcaacaccaccgagctgggcggggcgcagaaggccatgatcctccgcccgacggacgagctgcggaccacctactccggcaagcaggagagcctgagcaactccgtggtgggggagcagaccagcgactgcgtgaacatgaagaagatctcctgcatcagcccccgcttcaacatccccctctccagcatgatcgcctgcggcaaccagcccaactaccagatctacaaggagccgtccaagtactacaagagcaacaacaagcccaacacgtggtgcaacaaggacatccactgcctgaacgacttcgagtccatcgaccagagcgccctggaccgcctcaagaccatgacctgcttcctgatcgaccccatcaccacggaggacgtctactccatcgccatccacagctgcaaggtgaaggacaaggggcagtgcaccatccgggacaagaagtggaacatcatcaagtgcgactccgagctgctctactacaccgaccaccgcgagggcgaggacaccggcaacgagatcgggcactactgcctgagccacaagtgcggcacggaccggtaccccatcaacccggagatcatcaaggactgcatctgggagttccgctcccgcaagagcgagtacatcaaccgggtggacctggagtccctcgaggagttcaagcgggcgctgagcgacaagctgacccacaccctcaccatctacaacttcaagcccacggccaacctgccccacatcaagcccatctacaagtacatcaccgccctgggggtcgagaactccgacggcctcgaggccgcctacatcctgaccagcatcccggcgctgggcgggaccagcatcggctacaacatcatgacgaaggacaacttccccgtgatggacgtgatcatctacgtcaagtccgccgtgatccagaccacctacaaccacatctacgacaccgggcccacgatcggcatcaacagcaagcacgacgagaagtgcaccgggtcctgcccccagaacatcacccacgaccagaactggctcaccttcagccaggagcgcacctcccggtggggctgcgaggagttcggctgcctggccatcaacacggggtgcgtgttcggcagctgccaggacatgatccgctccgacaccaaggtctacaagaaggccctggaggagaccgtggtgctcaccgtctgcatcaactacccggggaacacgttctgcaccgaggtgaacagcgtggagaccaagatgaccgacgacgtcgagctgcagttcaagacggtggacaccaagaccctgcccaacctcctggccgtgaccaaccacaagctgtactccggccagatcaacgacctcgggagcttctcccagatgtgcggcaacgtccagaagacgaacagcaccgtgatgggcgcggggaccgtgaagttcgactacatctgccacggcgcctcccggaaggacatcatcatccgccggtgctacatgaacaactacgccagctgctccctgctgaaggaggagaaggacctcatcttcgccgacaaccacgagaccatcacggtcagcaactccaagcacctggtgggggagctgcagatcaagctcatgctgggcgacatccgctacaagctgttcgcggagcggcccgagctcgaggtggacgccaagtgcgtcgggtgcccgagctgcttcgagtcctacagctgcaacttccagatcgtgaccaacatcgacaccgtgtgcaccctggagggcccctgcacgatcttccacaaccgcatcatcatcagctccaccaagcagagctacggcatcaagatgtcctgccccaccaagcccaaccacatcgagaagttcaagatctgcaaccacgagtacgacatcctgttcgacaccgtcgccaagaacgacaagatcgagatcgacacgggggaccagaccctcttcgtgcgggagaaggacacccgctgcaagacctggctgtgccgggtgaaggacgagggcatcagcgtcatcttcgagccgctgcgcgccttcttcgggtcctacttcagcatcatcttctacatcatcctcgccgcgatcctgatcttcgtgggcgtgtacatcttcctgcccatgttcatgcgcctccgggacgtcctgaagcgcaacgagcacctgtacctccaggagatcaagcacaagtga

SEQ ID NO: 12560 - RNA, 4305 nt, synthetic construct
  misc_feature 1..4305: note = derived and/or modified CDS sequence (opt1) from MAGV__AY286443.1__GP
  source 1..4305: mol_type = other RNA
atggagctgctcatcatcatcctgctgctcggcagcgccgcctccagccccatctccacccgctgcttccacgggggccagctgatcgcggagagcaagtccgccaccagcatctccgagttctgcctgaaggacgacgtgagcatgatcaagtccgaggtcacgtacatcaagaacgacaccgggatctacggccacaacaaggtgttccggagctggaccatcaaggactggaagctctgcaacccgatccccaccgccgggggctccatcaacgtgatcgaggtcaacagcgacctgtccctggccacgcgcgcctacgtgtgcagccgggactgcaccatcaccatcgacaaggaggacgcgcagatcatcttccagaccgacaagctcaaccacttcgaggtgtccggcacgaccctgagctccgggtggttcaagaccaaggccagcgtcaccctggaccgcacgtgcgagcacatcaaggtgacctgcggcaagaagtccctccagttccacgcctgcttcaagcaccacatgagctgcatccggttcttccaccacaccatcctgcccgggaccatggtgagctccatgtgccagaacatcgagctgatcatcatcatcggcctcacgctggtcatcttcatcctgatggtgatcctcaccaagacctacatctgctacctgctgatgcccgtgttcatgccggtcgcctacatctacgggtgggcgtacaacaagagctgcaagaagtgcaactgctgcggcctcgcctaccaccccttcaccaactgcggctcccactgcgtgtgcgggctgaagttcgaggccagcgaccgcatgcggctgcaccgcgagtccggcctctgccaggggtacaagagcctgcggatcgcccgcatgctgtgcaagtccaagggcagctccctcgtgatcagcggcctgctgtccatgctcctgctgagcttcatcacgcccatcgaggggaccctcaccaactaccccaacgagaagcagtacaccctggaggagatcgccgacgtcgtggagggcatcatcacggagcagcacctgaaggagtacgtggtcttctacacctccctcttcgggggcctgatcctgctcctgaccctgatcctcagcatcaccatcaacaaggtgacggacctgctggcgtccaccaacgtgatctactgcgaggagtgcagcatgtaccactccaagaaggggatcaagtacaacggcgacttcaccaacaagtgcggcttctgcacgtgcagcgagcaggaggacgtcgagggggtgatcatccacaaggtgtcccggaagtgcacgtacaagtaccagctcaagtgggtccgcgtgatcatgatcatcctggccctgctcctgaccatccagaacaccgtcctgatcgtggccgccgaggtggactgctggaccaagaagtccatcgagatcgactgcatcggcccgctgctcaacatcgggagctgcacggacaagagcagccggacctacgagaccgaggtcaacaagctggtgcgccagtccaaggtgacccacgccgacgcggagcagatcagcatcctgggctccaccctcgacaacgccatcaaggccgtccggagccagaagacgtacgagaccatgcacttcctggagaccgtgttcctgatgaagaactgcgactactacaactccttcgagcacaacagcgggtactcccagaccaagtggcgcctcatcgccaagacgagccacttcgacatctgctcccggcacagcacccaccacttctgccgctgcgtgaacgagggcaccaagtgccagaacggcgactgggacttcgccggggagatgaacgacacctacaactccaagaacgacttctacctgcacgacctggacctcttctacacgctgctggagaacgcgttccccggcaccaccgagagcctcttctaccagctgctgcagaagaagaacaccacgggggcctccaagctcctgggcaagctgatcaccaagtacgggaacaacaacatgttcgtcgagatctggaagttcggccagtacctcctgaagctgccctacatcaacgacaccgagctcagcaccgaccggaagtccacgatcatcaagagccagcaggtcctgagccgctcccagaccggccggcaggagagcctgtccagcgccacccccgggaccgccacgaaggagtgctccaacgccaaggacatcggctgcatcagcccgcgcttcgggatccccatcggcaacctcaccgcgtgcggcgactcccccaactacaaggtgtacaagacccccgagaagatctacaagagcaacaaccgcggggaggtgtggtgctccgacgacgtgcactgcctgaccgacttcgagccggccgaggaggaggtggtcaaccggatcaagcagatgacgtgcttcctgaccgacgtgaccaccaagacggacgtgttcagcgtcgccatctccacgtgcaagatggtggacaagggcgtgtgcaccgtcaacgacgccaagtggaacatcctcaagtgcaacagcgggctgtactacttcaccgaccaccgcggcgggcaggacaccggcaacgacttcggcgagtactgcatctcccacagctgcaacaccgagcggttccccatcaaccccgacgtgctgaaggactgcatctgggagtaccactcccgcaagagcaagtacatctccaccgtgagcctcgagtccctggacgagttccggcgcgcgatgagcgacaagctgagccacaccctcatgatctacaacttcaagcccacggccaacctgccgcacatcaagcccacctacaagttcatcaccgccaacgggatcgagaactccgacggcatcgacagcgcctacatcctgtccagcatccccgccctcgggggcatgtccgtcgggtacaacatccagaccaaggacaacttccccctgctggacatcatcgtgttcatcaagagcgcgatcatcaagaccacgtacaaccacatctacgacaccggcccgaccatcggcatcaacacccagcacgacgagcactgcacggggccctgccccaccctcatcccccacaaggagaactggctgaccttctcccaggagcggaccagccgctggggctgcgaggagttcgggtgcctggccatcaacacgggctgcgtgttcgggtcctgccaggacatcatccacccggaggccaaggtctaccggaaggccatcgaggaggaggtggtgctcaccgtctgcatcaccttccccggcaacacctactgcacggagatcaacgccatcgagcccaagatcaccgacgagatcgagctgcagttcaagaccgtggacaccaagacgctgccgaacctcctgatggtgcagaaccacaagctgtacagcggccagatcaacgacctcgggtccttcagccagggctgcgggaacgtccagaagaccaaccagtccgtgatcggcgcggggaccgccaagttcgactacgtgtgccacggcgccagccgcaaggacgtcatcgtgcggcgctgctacaacaacaactacgagtcctgcaagctgctgaaggaggagaccagcctcatcttcgccgacaaccacgagacgctggaggtggccaacaccaagcacctgatcggcgagctccagttcaagatcatgctgggggacatccggtacaagtccttcgcggagagccccgagctggaggtcgacgccaagtgcgtgggctgcccctcctgcttcgagagctacagctgcaacttccagatcgtgaccaacatcgacaccgtctgctccgtggacgggccctgcaccctcttccacaaccgcctgatcatcagcgccaccaagcagtcctacggcttcaagatgagctgcccgcggaagcccgagcccaccgaggagttccagatctgcaaccgcaagtacaacgtgctgttcaccacgatcgacaagaacgacaagatcgagatcaacaccggcgaccagacctcctacatctacgagaaggacaaccggtgcaagacctggctctgccgcgtccgggacgaggggatcagcgtgatcttcgagcccctgaaggccttcttcggctcctacttcagcatcatcttctacgtggtcgtggggatcatcgtgctgttcctcacgatctacatcttcctgccgatgttcttcaagctgcgcgacatcctcaagcgcaacgagtacctgtacctgcaggagctcaagcacaagtga

SEQ ID NO: 12561 - RNA, 4305 nt, synthetic construct
  misc_feature 1..4305: note = derived and/or modified CDS sequence (opt1) from MAGV(ts8)__AY286444.1__GP
  source 1..4305: mol_type = other RNA
atggagctgctcatcatcatcctgctgctcggcagcgccgcctccagccccatctccacccgctgcttccacgggggccagctgatcgcggagagcaagtccgccaccagcatctccgagttctgcctgaaggacgacgtgagcatgatcaagtccgaggtgacgtacatcaagaacgacaccgggatctacggccacaacaaggtgttccggagctggaccatcaaggactggaagctctgcaacccgatccccaccgccgggggctccatcaacgtgatcgaggtcaacagcgacctgtccctggccacgcgcgcctacgtgtgcagccgggactgcaccatcaccatcgacaaggaggacgcgcagatcatcttccagaccgacaagctcaaccacttcgaggtgtccggcacgaccctgagctccgggtggttcaagaccaaggccagcgtcaccctggaccgcacgtgcgagcacatcaaggtgacctgcggcaagaagtccctccagttccacgcctgcttcaagcaccacatgagctgcatccggttcttccaccacaccatcctgcccgggaccatggtgagctccatgtgccagaacatcgagctgatcatcatcatcggcctcacgctggtcatcttcatcctgatggtgatcctcaccaagacctacatctgctacctgctgatgcccgtgttcatgccggtcgcctacatctacgggtgggcgtacaacaagagctgcaagaagtgcaactgctgcggcctcgcctaccaccccttcaccaactgcggctcccactgcgtgtgcgggctgaagttcgaggccagcgaccgcatgcggctgcaccgcgagtccggcctctgccaggggtacaagagcctgcggatcgcccgcatgctgtgcaagtccaagggcagctccctcgtgatcagcggcctgctgtccatgctcctgctgagcttcatcacgcccatcgaggggaccctcaccaactaccccaacgagaagcagtacaccctggaggagatcgccgacgtcgtggagggcatcatcacggagcagcacctgaaggagtacgtggtcttctacacctccctcttcgggggcctgatcctgctcctgaccctgatcctcagcatcaccatcaacaaggtgacggacctgctggcgtccaccaacgtgatctactgcgaggagtgcagcatgtaccactccaagaaggggatcaagtacaacggcgacttcaccaacaagtgcggcttctgcacgtgcagcgagcaggaggacgtcgagggggtgatcatccacaaggtgtcccggaagtgcacctacaagtaccagctcaagtgggtccgcgtgatcatgatcatcctggccctgctcctgaccatccagaacaccgtcctgatcgtggccgccgaggtggactgctggaccaagaagtccatcgagatcgactgcatcggcccgctgctcaacatcgggagctgcacggacaagagcagccggacctacgagaccgaggtcaacaagctggtgcgccagtccaaggtgacccacgccgacgcggagcagatcagcatcctgggctccaccctcgacaacgccatcaaggccgtccggagccagaagacgtacgagaccatgcacttcctggagaccgtgttcctgatgaagaactgcgactactacaactccttcgagcacaacagcgggtactcccagaccaagtggcgcctcatcgccaagacgagccacttcgacatctgctcccggcacagcacccaccacttctgccgctgcgtgaacgagggcaccaagtgccagaacggcgactgggacttcgccggggagatgaacgacacctacaactccaagaacgacttctacctgcacgacctggacctcttctacacgctgctggagaacgcgttccccggcaccaccgagagcctcttctaccagctgctgcagaagaagaacaccacgggggcctccaagctcctgggcaagctgatcaccaagtacgggaacaacaacatgttcgtcgagatctggaagttcggccagtacctcctgaagctgccctacatcaacgacaccgagctcagcaccgaccggaagtccacgatcatcaagagccagcaggtcctgagccgctcccagaccggccggcaggagagcctgtccagcgccacccccgggaccgccacgaaggagtgctccaacgccaaggacatcggctgcatcagcccgcgcttcgggatccccatcggcaacctcaccgcgtgcggcgactcccccaactacaaggtgtacaagacccccgagaagatctacaagagcaacaaccgcggggaggtgtggtgctccgacgacgtgcactgcctgaccgacttcgagccggccgaggaggaggtggtcaaccggatcaagcagatgacgtgcttcctgaccgacgtgaccaccaagacggacgtgttcagcgtcgccatctccacgtgcaagatggtggacaagggcgtgtgcaccgtcaacgacgccaagtggaacatcctcaagtgcaacagcgggctgtactacttcaccgaccaccgcgacggccaggacaccgggaacgacttcggcgagtactgcatctcccacagctgcaacaccgagcggttccccatcaaccccgacgtgctgaaggactgcatctgggagtaccactcccgcaagagcaagtacatctccaccgtgagcctcgagtccctggacgagttccggcgcgcgatgagcgacaagctgagccacaccctcatgatctacaacttcaagcccacggccaacctgccgcacatcaagcccacctacaagttcatcaccgccaacggcatcgagaactccgacgggatcgacagcgcctacatcctgtccagcatccccgccctcggcgggatgtccgtcggctacaacatccagaccaaggacaacttccccctgctggacatcatcgtgttcatcaagagcgcgatcatcaagaccacgtacaaccacatctacgacaccgggccgaccatcggcatcaacacccagcacgacgagcactgcacgggcccctgccccaccctcatcctgcacaaggagaactggctgaccttctcccaggagcggaccagccgctgggggtgcgaggagttcggctgcctcgccatcaacacggggtgcgtgttcggctcctgccaggacatcatccaccccgaggccaaggtctaccggaaggccatcgaggaggaggtggtgctgaccgtctgcatcaccttcccggggaacacctactgcacggagatcaacgccatcgagcccaagatcaccgacgagatcgagctgcagttcaagaccgtggacaccaagacgctccccaacctgctgatggtgcagaaccacaagctctacagcggccagatcgacgacctgggctccttcagccaggggtgcggcaacgtccagaagaccaaccagtccgtgatcggggcgggcaccgccaagttcgactacgtgtgccacggggccagccgcaaggacgtcatcgtgcggcgctgctacaacaacaactacgagtcctgcaagctgctcaaggaggagaccagcctgatcttcgccgacaaccacgagacgctggaggtggccaacaccaagcacctcatcggcgagctgcagttcaagatcatgctgggcgacatccggtacaagtccttcgcggagagcccggagctcgaggtcgacgccaagtgcgtggggtgcccctcctgcttcgagagctacagctgcaacttccagatcgtgaccaacatcgacaccgtctgctccgtggacggcccctgcacgctgttccacaaccgcctgatcatcagcgccaccaagcagtcctacgggttcaagatgagctgcccccggaagccggagcccaccgaggagttccagatctgcaaccgcaagtacaacgtcctcttcaccacgatcgacaagaacgacaagatcgagatcaacaccggcgaccagacctcctacatctacgagaaggacaaccggtgcaagacctggctgtgccgcgtgcgggacgagggcatcagcgtgatcttcgagcccctgaaggccttcttcgggtcctacttcagcatcatcttctacgtggtcgtgggcatcatcgtcctcttcctgacgatctacatcttcctgcccatgttcttcaagctccgcgacatcctgaagcgcaacgagtacctgtacctccaggagctgaagcacaagtga

SEQ ID NO: 12562 - RNA, 4311 nt, synthetic construct
  misc_feature 1..4311: note = derived and/or modified CDS sequence (opt1) from MAGV(AG83-1746)__KX100113.1__GP
  source 1..4311: mol_type = other RNA
atgaagatgatcctgctcatcatcatcctgtgcgtgaacctggccgccgcgaaccccgtcgccacccgctgcttccacggcgggcagctcatcgccgagacccggagcgccacgtccatcagcgagttctgcctgaaggacgacgtgtccatgatcaagagcgagatcacctacaccaagaacgacaccggcatcttcgggcactccaagatctacaagagctggctgatcaaggactggaagctctgcaacccggtgcccacggccggcgggtccatcaacgtcatcgaggtgaacagcgacctgtccctgaccaccaaggcgtacgtgtgcagccgcgactgcaccatcacgatcgacaaggaggaggcccagatcatcttccagaccgacaagctcaaccacttcgaggtctccggcaccaccctgagctccggctggttcaagacgaaggccagcgtgaccctggaccggacctgcgagcacatcaaggtgacctgcgggaagaagacgctccagttccacgcctgcttccgccaccacatgtcctgcgtccggttcttccacaacaccatcctgcccggcaccatggtgaacagcatgtgccagaacatcgagctgatcatcatcctcgggctgaccctgatcatcttcacgctcatggtgatcctgaccaagacctacatctgctacatcctgatgcccctcttcatgccgatcgcgtacgcctacggctgggcctacaacaagtcctgcaagaagtgcaactgctgcgggctggcctaccaccccttcaccaactgcggcagccactgcgtctgcggcctgaagttcgaggcctccgaccgcatgcggatccaccgcgagagcgggctctgccagggctacaagagcctgcggatcgcgcgcctgctctgcaagtccaaggggagctccctgatcatcagcacgctgctctccatgctgctgctcagcttcatcacccccatcgagggcaccatgaccaactaccccgagacgcggcagtactccctggaggagatcgccgacgtggtggagggcctgctcagcgagcagaacatcaaggagtacgtcgtgttctacacctccctgttcgggagcctgatcctcctgctggccttcatcctctccatcaccctgaccaaggtgacgaacgccctggccaagaccaacgtcatctactgcgaggagtgcagcatgtaccacgcgaagaagggcatcaagtacaacggggacttcaccaacaagtgcggcttctgcacgtgcgacgagcaggaggacgaggaggggatcatcatccacaaggtgtccaagaagtgcacctaccgctaccagctccagtgggccaagatcatcatgatcatcctggtgatgctgctcatgatgcagaacaccatcctgatcgtcgccgccgagaccgactgctggaccaagaacagcctggagctggactgcatcggcccgctcctgaccatctccgactgcagcaacaaggagtccaagaactacgaggaggaggccgcgaagctggtgagccagtccaagatcacgcaggccgacgccgagcaggtcaccatcctcggcaacaccatcgacaccgccctgaaggccatccggagccagaagacgtaccagaccatgcacctcctcgagagcgtgttcctgatgaagaactgcgactactactccagcttcgagcacaactccgggtacagccaggcgaagtggcgcctgatcgccaagacctcccacttcgacatctgcagccggcactccatgcaccacttctgccgctgcgtggccgacggcaccaagtgccagaacgggaactgggacttcgccggcgagatgaacaacacgtacagcaccaagaacgacttctacctccacgacctgaacctgttcttcaccctccacgagaccgcgttccccgggacgaccgagtccctgttctaccagctgatcgccaagaagaacaccaccggcgccagcaagctcctgggcaagctgatcacgaagtacgggaacaacaagctgttcgtcggcatctggaagttcgggcagtacctgctgaccctcccctacgtgaacaccaccgagctgtccaagacgcggaaggagaccatcctgaagccccaccagatcctcacccgcagccagggcgggcggccggagtccatgagctccgccgaggtgggccagaccgccaaggagtgcgcgaacgccaagaacgtcggctgcatcagcccccgcttcggggtgcccatcggcaacctgacggcctgcgggaactcccccaactacaagatctacaagaccccgaacaagatctacaagagcaacaaccggggcgaggtgtggtgcagcgaggacgtccactgcctggccgacttcgagcccgccgacaccgaggtggtgaacaaggtcaagaagatgacctgcttcctctccgacgtgaacacgcgcgcggacatcttcagcatcgccatctccgcctgccgcatggtggacaagggcgtctgcaccgtgaacggggccaagtggaacatcctgaagtgcgagagcggcctgtactacttcaccgaccaccgggaggggcaggacaccggcaacgacttcggggagtactgcatctcccacagctgcaacacggagcgctaccccatcaaccccgacatcctcaaggagtgcatctgggagtaccactcccgcaagagcaagtacatctccaccatcaacctggagagcctggaggagttcaagcgggccatgtccgacaagctcagccacaccctgatggtgtacaacttcaagccgaccgcgaacctgccccacatcaagccctcctacaagttcatcacggccaacggcatcgagaacagcgacggcctcgagtccgcctacatcctgagctccatccccgccatcgggggcatgagcatcgggtacaacatccagaccaaggacaacttcccgctgctcgacctgatcgtcttcgtgaagtccgcggtgatcaagaccacctacaaccacatctacgacaccggccccacgatcgggatcaacaccaaccacgacgagcactgcaccggcccctgccccaccatcatcccgcacaaggagaactggctgacgttcagccaggagcggaccagccgctggggctgcgaggagttcgggtgcctcgccatcaacaccggctgcgtcttcgggtcctgccaggacgtgatccaccccgagaccaagatctaccggaaggccgtggaggaggaggtcgtgctgacggtgtgcatcaacttccccggcaacaccttctgcaccgagatcaacgccatcgagccgaagatcaccgacgagatcgagctgcagttcaagacggtcgacaccaagaccctccccaacctgctggccgtgcagaaccacaagctctacagcgggcagatcaacgacctgggctccttcagccagggctgcgggaacgtgcagaagaccaaccagtccatcctgggcgcggggacggtcaagttcgactacgtgtgccacggcgccagccgcaaggacatcatcgtgcggcgctgctacaccaacaactacgactcctgcaagctcctgaaggaggagcggagcctgatcttcgccgacaaccacgagaccctcgaggtcgccaacacccgccacctgatcggggagctgcagttcaagatcatgctcggcgacatccggtacaaggccttcgcggagaagcccgagctggagatcgacgccaagtgcgtgggctgcccctcctgcttcgagagctactcctgcagcttccagatcgtgacgtccatcgacaccgtctgcagcgtggaggggccgtgcaccctgttccacaaccgcatcatcatcaccgccgccaagcagtcctacggcgtgaagatgagctgcaagacgaagcccgggcccgtcgaggagttccggatctgcaaccgcaactaccgggtgtccttcgccaccatcgacaagaacgacaagatcgagatcaacaccggcgaccagaccagctacatcgtggagaaggactcccgctgcaagacgtggctctgccgggtccgcgacgagggcatcagcgtgatcttcgagcccctgaaggcgttcttcgggagctacttctccgtggccttctacatcatcatcggcatcgccgccctgttcctcatcatctacatcttcctgccgatgttcttcaagctgcgcgacgtcctcaagaagaacgagtacctgtacctgcaggagctcaagcacaagtga

SEQ ID NO: 12563 - RNA, 4305 nt, synthetic construct
  misc_feature 1..4305: note = derived and/or modified CDS sequence (opt1) from MAGV(BeAr 7272)__KX100104.1__GP
  source 1..4305: mol_type = other RNA
atggagctgctcatcatcatcctgctgctcggcagcgccgcctccagccccatctccacccgctgcttccacgggggccagctgatcgcggagagcaagtccgccaccagcatctccgagttctgcctgaaggacgacgtgagcatgatcaagtccgaggtcacgtacatcaagaacgacaccgggatctacggccacaacaaggtgttccggagctggaccatcaaggactggaagctctgcaacccgatccccaccgccgggggctccatcaacgtgatcgaggtcaacagcgacctgtccctggccacgcgcgcctacgtgtgcagccgggactgcaccatcaccatcgacaaggaggacgcgcagatcatcttccagaccgacaagctcaaccacttcgaggtgtccggcacgaccctgagctccgggtggttcaagaccaaggccagcgtcaccctggaccgcacgtgcgagcacatcaaggtgacctgcggcaagaagtccctccagttccacgcctgcttcaagcaccacatgagctgcatccggttcttccaccacaccatcctgcccgggaccatggtgagctccatgtgccagaacatcgagctgatcatcatcatcggcctcacgctggtcatcttcatcctgatggtgatcctcaccaagacctacatctgctacctgctgatgcccgtgttcatgccggtcgcctacatctacgggtgggcgtacaacaagagctgcaagaagtgcaactgctgcggcctcgcctaccaccccttcaccaactgcggctcccactgcgtgtgcgggctgaagttcgaggccagcgaccgcatgcggctgcaccgcgagtccggcctctgccaggggtacaagagcctgcggatcgcccgcatgctgtgcaagtccaagggcagctccctcgtgatcagcggcctgctgtccatgctcctgctgagcttcatcacgcccatcgaggggaccctcaccaactaccccaacgagaagcagtacaccctggaggagatcgccgacgtcgtggagggcatcatcacggagcagcacctgaaggagtacgtggtcttctacacctccctcttcgggggcctgatcctgctcctgaccctgatcctcagcatcaccatcaacaaggtgacggacctgctggcgtccaccaacgtgatctactgcgaggagtgcagcatgtaccactccaagaaggggatcaagtacaacggcgacttcaccaacaagtgcggcttctgcacgtgcagcgagcaggaggacgtcgagggggtgatcatccacaaggtgtcccggaagtgcacgtacaagtaccagctcaagtgggtccgcgtgatcatgatcatcctggccctgctcctgaccatccagaacaccgtcctgatcgtggccgccgaggtggactgctggaccaagaagtccatcgagatcgactgcatcggcccgctgctcaacatcgggagctgcacggacaagagcagccggacctacgagaccgaggtcaacaagctggtgcgccagtccaaggtgacccacgccgacgcggagcagatcagcatcctgggctccaccctcgacaacgccatcaaggccgtccggagccagaagacgtacgagaccatgcacttcctggagaccgtgttcctgatgaagaactgcgactactacaactccttcgagcacaacagcgggtactcccagaccaagtggcgcctcatcgccaagacgagccacttcgacatctgctcccggcacagcacccaccacttctgccgctgcgtgaacgagggcaccaagtgccagaacggcgactgggacttcgccggggagatgaacgacacctacaactccaagaacgacttctacctgcacgacctggacctcttctacacgctgctggagaacgcgttccccggcaccaccgagagcctcttctaccagctgctgcagaagaagaacaccacgggggcctccaagctcctgggcaagctgatcaccaagtacgggaacaacaacatgttcgtcgagatctggaagttcggccagtacctcctgaagctgccctacatcaacgacaccgagctcagcaccgaccggaagtccacgatcatcaagagccagcaggtcctgagccgctcccagaccggccggcaggagagcctgtccagcgccacccccgggaccgccacgaaggagtgctccaacgccaaggacatcggctgcatcagcccgcgcttcgggatccccatcggcaacctcaccgcgtgcggcgactcccccaactacaaggtgtacaagacccccgagaagatctacaagagcaacaaccgcggggaggtgtggtgctccgacgacgtgcactgcctgaccgacttcgagccggccgaggaggaggtggtcaaccggatcaagcagatgacgtgcttcctgaccgacgtgaccaccaagacggacgtgttcagcgtcgccatctccacgtgcaagatggtggacaagggcgtgtgcaccgtcaacgacgccaagtggaacatcctcaagtgcaacagcgggctgtactacttcaccgaccaccgcgacggccaggacaccgggaacgacttcggcgagtactgcatctcccacagctgcaacaccgagcggttccccatcaaccccgacgtgctgaaggactgcatctgggagtaccactcccgcaagagcaagtacatctccaccgtgagcctcgagtccctggacgagttccggcgcgcgatgagcgacaagctgagccacaccctcatgatctacaacttcaagcccacggccaacctgccgcacatcaagcccacctacaagttcatcaccgccaacggcatcgagaactccgacgggatcgacagcgcctacatcctgtccagcatccccgccctcggcgggatgtccgtcggctacaacatccagaccaaggacaacttccccctgctggacatcatcgtgttcatcaagagcgcgatcatcaagaccacgtacaaccacatctacgacaccgggccgaccatcggcatcaacacccagcacgacgagcactgcacgggcccctgccccaccctcatcccccacaaggagaactggctgaccttctcccaggagcggaccagccgctgggggtgcgaggagttcggctgcctggccatcaacacggggtgcgtgttcggctcctgccaggacatcatccacccggaggccaaggtctaccggaaggccatcgaggaggaggtggtgctcaccgtctgcatcaccttccccgggaacacctactgcacggagatcaacgccatcgagcccaagatcaccgacgagatcgagctgcagttcaagaccgtggacaccaagacgctgccgaacctcctgatggtgcagaaccacaagctgtacagcggccagatcaacgacctcggctccttcagccaggggtgcggcaacgtccagaagaccaaccagtccgtgatcggggcgggcaccgccaagttcgactacgtgtgccacggggccagccgcaaggacgtcatcgtgcggcgctgctacaacaacaactacgagtcctgcaagctgctgaaggaggagaccagcctcatcttcgccgacaaccacgagacgctggaggtggccaacaccaagcacctgatcggcgagctccagttcaagatcatgctgggcgacatccggtacaagtccttcgcggagagccccgagctggaggtcgacgccaagtgcgtggggtgcccctcctgcttcgagagctacagctgcaacttccagatcgtgaccaacatcgacaccgtctgctccgtggacggcccctgcaccctcttccacaaccgcctgatcatcagcgccaccaagcagtcctacgggttcaagatgagctgcccgcggaagcccgagcccaccgaggagttccagatctgcaaccgcaagtacaacgtgctgttcaccacgatcgacaagaacgacaagatcgagatcaacaccggcgaccagacctcctacatctacgagaaggacaaccggtgcaagacctggctctgccgcgtccgggacgagggcatcagcgtgatcttcgagcccctgaaggccttcttcgggtcctacttcagcatcatcttctacgtggtcgtgggcatcatcgtgctgttcctcacgatctacatcttcctgccgatgttcttcaagctgcgcgacatcctcaagcgcaacgagtacctgtacctgcaggagctcaagcacaagtga

SEQ ID NO: 12564 - RNA, 4311 nt, synthetic construct
  misc_feature 1..4311: note = derived and/or modified CDS sequence (opt1) from MAGV(CbaAr 426)__KX100110.1__GP
  source 1..4311: mol_type = other RNA
atgaagatgatcctgctcatcatcatcctgtgcgtgaacctggccgccgcgaaccccgtcgccacccgctgcttccacggcgggcagctcatcgccgagacccggagcgccacgtccatcagcgagttctgcctgaaggacgacgtgtccatgatcaagagcgagatcacctacaccaagaacgacaccggcatcttcgggcactccaagatctacaagagctggctgatcaaggactggaagctctgcaacccggtgcccacggccggcgggtccatcaacgtcatcgaggtgaacagcgacctgtccctgaccaccaaggcgtacgtgtgcagccgcgactgcaccatcacgatcgacaaggaggaggcccagatcatcttccagaccgacaagctcaaccacttcgaggtctccggcaccaccctgagctccggctggttcaagacgaaggccagcgtgaccctggaccggacctgcgagcacatcaaggtgacctgcgggaagaagacgctccagttccacgcctgcttccgccaccacatgtcctgcgtccggttcttccacaacaccatcctgcccggcaccatggtgaacagcatgtgccagaacatcgagctgatcatcatcctcgggctgaccctgatcatcttcacgctcatggtgatcctgaccaagacctacatctgctacatcctgatgcccctcttcatgccgatcgcgtacgcctacggctgggcctacaacaagtcctgcaagaagtgcaactgctgcgggctggcctaccaccccttcaccaactgcggcagccactgcgtctgcggcctgaagttcgaggcctccgaccgcatgcggatccaccgcgagagcgggctctgccagggctacaagagcctgcggatcgcgcgcctgctctgcaagtccaaggggagctccctgatcatcagcacgctgctctccatgctgctgctcagcttcatcacccccatcgagggcaccatgaccaactaccccgagacgcggcagtactccctggaggagatcgccgacgtggtggagggcctgctcagcgagcagaacatcaaggagtacgtcgtgttctacacctccctgttcgggagcctgatcctcctgctggccttcatcctctccatcaccctgaccaaggtgacgaacgccctggcccgcaccaacgtcatctactgcgaggagtgcagcatgtaccacgcgaagaagggcatcaagtacaacggggacttcaccaacaagtgcggcttctgcacgtgcgacgagcaggaggacgaggaggggatcatcatccacaaggtgtccaagaagtgcacctaccggtaccagctccagtgggccaagatcatcatgatcatcctggtgatgctgctcatgatgcagaacaccatcctgatcgtcgccgccgagaccgactgctggaccaagaacagcctggagctggactgcatcggcccgctcctgaccatctccgactgcagcaacaaggagtccaagaactacgaggaggaggccgcgaagctggtgagccagtccaagatcacgcaggccgacgccgagcaggtcaccatcctcggcaacaccatcgacaccgccctgaaggccatccgcagccagaagacgtaccagaccatgcacctcctcgagagcgtgttcctgatgaagaactgcgactactactccagcttcgagcacaactccgggtacagccaggcgaagtggcggctgatcgccaagacctcccacttcgacatctgcagccgccactccatgcaccacttctgccggtgcgtggccgacggcaccaagtgccagaacggggactgggacttcgccggcgagatgaacaacacgtacagcaccaagaacgacttctacctccacgacctgaacctgttcttcaccctccacgagaccgcgttccccgggacgaccgagtccctgttctaccagctgatcgccaagaagaacaccaccggcgccagcaagctcctgggcaagctgatcacgaagtacgggaactccaagctgttcgtcggcatctggaagttcgggcagtacctgctgaccctcccctacgtgaacaccaccgagctgagcaagacgcgccgggagaccatcctgaagacccaccagatcctcacccgctcccagggcgggcggagcgagtccatgagctccgccgaggtgggccagatcgccaaggagtgcgcgaacgccaagaacgtcggctgcatcagcccccgcttcgggatcccgatcggcaacctgacggcctgcgggaacagccccaactacaagatctacaagacccccaacaagatctacaagtccaacaaccgcggcgaggtgtggtgcagcgaggacgtgcactgcctggccgacttcgagcccgccgacaccgaggtcgtgaacaaggtgaagaagatgacctgcttcctctccgacgtcaacacgcgggcggacatcttcagcatcgccatctccgcctgccgcatggtggacaagggcgtgtgcaccgtcaacggggccaagtggaacatcctgaagtgcgagagcggcctgtactacttcaccgaccaccgggaggggcaggacaccggcaacgacttcggggagtactgcatctcccacagctgcaacacggagcgctacccgatcaaccccgacatcctcaaggagtgcatctgggagtaccactcccgcaagagcaagtacatctccaccatcaacctggagagcctggaggagttcaagcgggccatgtccgacaagctcagccacaccctgatggtgtacaacttcaagcccaccgcgaacctgccccacatcaagccgtcctacaagttcatcacggccaacggcatcgagaacagcgacggcctcgagtccgcctacatcctgagctccatccccgccatcgggggcatgagcatcgggtacaacatccagaccaaggacaacttccccctgctcgacctgatcgtgttcgtcaagagcgcggtgatcaagaccacctacaaccacatctacgacaccggccccacgatcgggatcaacaccaaccacgacgagcactgcaccggcccgtgccccaccatcatcccccacaaggagaactggctgacgttctcccaggagcggaccagccgctggggctgcgaggagttcgggtgcctcgccatcaacaccggctgcgtgttcgggtcctgccaggacgtcatccaccccgagaccaagatctaccggaaggccgtggaggaggaggtggtcctgacggtgtgcatcaacttcccgggcaacaccttctgcaccgagatcaacgccatcgagcccaagatcaccgacgagatcgagctgcagttcaagacggtggacaccaagaccctccccaacctgctggccgtccagaaccacaagctctacagcgggcagatcaacgacctgggctccttcagccagggctgcgggaacgtgcagaagaccaaccagtccatcctgggcgcggggacggtgaagttcgactacgtctgccacggcgccagccgcaaggacatcatcgtgcggcgctgctacaccaacaactacgactcctgcaagctcctgaaggaggagcggagcctgatcttcgccgacaaccacgagaccctcgaggtggccaacacccgccacctgatcggggagctgcagttcaagatcatgctcggcgacatccggtacaaggccttcgcggagaagccggagctggagatcgacgccaagtgcgtcggctgcccctcctgcttcgagagctactcctgcaacttccagatcgtgacgagcatcgacaccgtgtgctccgtcgaggggccctgcaccctgttccacaaccgcatcatcatcaccgccgccaagcagagctacggcgtgaagatgtcctgcaagacgaagcccgggccggtggaggagttcaccatctgcaaccggaactaccgcgtcagcttcgccaccatcgacaagaacgacaagatcgagatcaacaccggcgaccagacgtcctacatcgtggagaaggacagccggtgcaagacctggctctgccgcgtgcgcgacgagggcatcagcgtcatcttcgagcccctgaaggcgttcttcgggtcctacttcagcatcgccttctacatcatcatcggcatcgccgccctgttcctcatcatctacatcttcctgcccatgttcttcaagctgcgggacgtgctcaagaagaacgagtacctgtacctgcaggagctcaagcacaagtga

SEQ ID NO: 12565 - RNA, 4305 nt, synthetic construct
  misc_feature 1..4305: note = derived and/or modified CDS sequence (opt1) from MAGV(CoAr 3363)__KX100107.1__GP
  source 1..4305: mol_type = other RNA
atgctgagcctcctgatcctggccttcctcggcctgtccaccagcaaccccatcgccacccgctgcttccacgggggccagctgatcgcggagtccaagagcgccacgtccatcagcgagttctgcctcaaggacgacgtgtccatgctcaagagcgaggtcgtgtacaccaagaacgacaccgggctgttcggccacaacaaggtgttccggtcctggaccatcaaggactggaagctctgcaacccgatccccacggccgggggcaccatcaacgtcatcgaggtgaacaaggacctgagcctgatgaccaagacctacatctgctcccgcgactgcacgatcaccatcgacaaggaggaggcccagatcatcttccagaccgacaagctcaaccacttcgaggtgagcggcaccacgctgtccagcgggtggttcaagtccaaggccagcgtcaccctggaccggacctgcgagcacgtgaaggtgacctgcggcaagaagtccctccagttccacgcgtgcttcaagcaccacatgagctgcgtccgcttcttccacaacacgatcctgcccgggaacatgatcacctccatgtgccagaacatcgagctgatcatcatcctcggcctgaccctggccatcttcatcctcatggtgatgctgaccaagacgtacatctgctacctgctcatgcccatcttcatgccgatcgcctacctgtacgggtgggcctacaacaagagctgcaagaagtgcaactgctgcggcctggcgtaccaccccttcaccaactgcggcagccactgcgtgtgcgggctcaagttcgaggcctccgaccggatgcgcatccaccgggagagcggcctgtgccaggggtacaagtccctgcgcatcgcccggctcctgtgcaagagcaagggctccagcctggtcatctccggcctcctgagcatgctgatcctctccttcgtgacccccatcgaggggaccatcacgagctaccccgagtcccgcaagtacaccctggaggagatcaccgacgtggtcgagggcctggtgagcgagcagaacatcaaggagtacatcgtgttctacacctccctcttcgggagcctgatcctgctcctggccttcatcatgtccatcacgctgagcaagatcacctccatcctcgcccggcgcaacgtcatctactgcgaggagtgcagcatgtaccactccaagcggggcatcaagtacaacggggacttcaccaacaagtgcggcttctgcacgtgcaacgagcaggaggacgcggagggcctggtgatccacaaggtgagcaagcgctgcacctacaagtgccagctgaagtgggccaaggtcctcatgatcaccctggtgctgctgctcatcgcccagaacaccatcctgatcgtggccgccaagaccgactgctggacgaagaagtccctggacatcgactgcatcgggccgatgctcgacatcggcagctgcaccaacaagaacacccggagctacgacaccgaggcgcagaagctggtcacccagtccaaggtgagccagctggacgccgaccaggcctccctcctggggagctccatcgacagcgccatcaaggccatccgcacgcagaagacctaccccaccatgcacctcctggagaccatcttcctgatgaagaactgcgactactacacgtccttcaaccacaacagcggctactcccaggcgcggtggcgcctgatcgccaagaccgggcacttcgacatctgcagccggcactccacccaccacttctgccgctgcatcagcgacggcaccaagtgccagaacggcgactgggacttcgccggggagatgaacgagccctacaactccaagaacgacttctacctccacgacctgaacctgttctacacgatcttcgagaacgccttccccggcaccaccgagagcctcttctaccagctgatccagaagcgggacaccacgggggcctccaaggtcctgggcaagctcatcaccaagtacgggaacaacaacatgttcgtgggcgtgtggaagttcggccagtacctgctgaccctcccgtacatcaacaacaccgagctgagccagaaccgcaagcagacgatcctggcgacccaggagcccctcagccgctcccaccccgggcggcaggagagcatgtccagcgccatccagggctccgtcaccaaggagtgccacaacgccaaggacgtggggtgcatcagcccccgcttcggcatcccgatcggcaacctgaccgcctgcggggactcccccaactacaagatctacaagacgcccgagaagctgtacaagagcaacaacaagggcgaggtgtggtgctccaacgacgtccactgcctcaacgacttcgagcccgcggacgaggaggtggtgaacaaggtcaagaagctgacctgcttcctgaccgacgtgctcgtgaagaccgacatcttcagcgtcgccgcctccacgtgcaagatggccgacaaggggatctgcaccgtgaacgacgccaagtggaacatcatcaagtgcgacagcggcctgtactacttcaccgaccaccgggaggggcaggacaccggcaacgacttcggcgagtactgcatctcccacagctgcaacacggagcgcttcccgatcaaccccgacatcctgaaggactgcacctgggagttccactcccgcaagagcaagtacatctccaccatcagcctcgagtccctggaggagttccggcgggcgatggccgagaagctgagccacaccctcacgatctacaacttcaagcccaccgccaacctgccccacatccgcccgacctacaagttcatcaccgccaacggggtggagaacagcgacggcatcgagtccgcctacatcctgagctccatccccgcgctcagcgggatctccgtcggctacaacgtgcagacgaaggacaacttccccctgctggacatcatcgtgttcatcaagagcgccgtcatccggaccacctacaaccacatctacgacaccgggcccaccatcggcatcaacacgcagcacgacgagcactgcaccggcccgtgccccgccgtggtgccccacaaggagaactggatcaccttctcccaggagcgcaccagccggtgggggtgcgaggagttcggctgcctcgccatcaacacggggtgcgtcttcggctcctgccaggacatcatccacccggagaccaaggtgtaccgcaaggccgtggaggaggaggtcgtgctgaccgtgtgcatcaacttccccgggaacaactactgcaccgagatcaacgcgatcgagcccaagatcacggacgagatcgagctgcagttcaagaccgtcgacaccaagaccctccccaacctgctggccgtgcagaaccacaagctctacagcggccagatcaacgacctgggctccttcagccaggggtgcggcaacgtgcagaagacgaaccactccatcctggggatgggcaccgccaagttcgactacgtctgccacggggccagccggaaggacgtgatcgtgcgccggtgctacaacaacaacttcgactcctgcaagctcctgaaggaggagaccagcctgatcttcgcggacaaccacgagaccctcgaggtcgcccacacgaagcacctgatcggcgagctgcagttcaagatcatgctcggcgacatccgctacaagtccttcgccgagagcccggagctggagatcgacgccaagtgcgtggggtgcccctcctgcttcgagagctacagctgcaacttccagatcgtgaccaacatcgacaccgtctgctccgtggagggcccctgcaccctgttccacaaccggatcatcatcagcgccaacaagcagtcctacgggctcaagatgagctgccagacgaagcccaaccagaacgaggagttcatcatctgcaaccgcaagtactccgtgctgttcaccaccatcgacaagaacgacaagatcgaggtcaacaccggcgaccagacgagctacatctacgagaaggactcccggtgcaagacctggctgtgccgcgtgcgcgacgagggcatcagcgtgctgttcgagccgctgaaggcgttcttcgggtcctacttcagcatcatcttctacgtcgtgatcggcatcatcgtgctgttcctcatcgtctacatcttcctgcccatgttcttcaagctgaaggacgtgctcaagaagaacgagtacctgtacctgcaggagctcaagcacaagtga

SEQ ID NO: 12566 - RNA, 4305 nt, synthetic construct
  misc_feature 1..4305: note = derived and/or modified CDS sequence (opt1) from MAGV(OBS 6657)__KX100116.1__GP
  source 1..4305: mol_type = other RNA
atggagctgctcatcatcatcctgctgctcggcagcgccgcctccagccccgtgtccacccgctgcttccacgggggccagctgatcgcggagagcaagtccgccaccagcatctccgagttctgcctgaaggacgacgtcagcatgatcaagtccgaggtgacgtacaccaagaacgacaccgggatctacggccacaacaaggtgttccggagctggaccatcaaggactggaagctctgcaacccgatccccacggccgggggctccatcaacgtcatcgaggtgaacagcgacctgtccctggccaccaaggcctacgtgtgcagccgcgactgcaccatcaccatcgacaaggaggacgcgcagatcatcttccagacggacaagctcaaccacttcgaggtctccggcaccaccctgagctccgggtggttcaagaccaaggccagcgtgacgctggaccggacctgcgagcacatcaaggtgacctgcggcaagaagtccctccagttccacgcctgcttcaagcaccacatgagctgcatccgcttcttccaccacaccatcctgcccgggacgatggtcagctccatgtgccagaacatcgagctgatcatcatcatcggcctcaccctggtgctgttcatcctcatggtgatcctgaccaagacctacatctgctacctgctcatgcccatcttcatgccgatcgcctacatctacgggtgggcgtacaacaagagctgcaagaagtgcaactgctgcggcctggcctaccaccccttcacgaactgcggctcccactgcgtctgcgggctgaagttcgaggccagcgaccggatgcgcatccaccgggagtccggcctctgccaggggtacaagagcctgcgcatcgcccggatgctgtgcaagtccaagggcagctccctcgtgatcagcggcctgctgtccatgctcctgctgagcttcatcacccccatcgaggggaccctcaccaactaccccaacgagcgccagtacacgctggaggagatcgccgacgtggtcgagggcatcctgaccgagcagcacctcaaggagtacgtggtgttctacacctccctgttcgggggcctgatcctcctgctgaccctcatcctgagcatcacgatcaacaaggtcaccgacctgctcgcgtccaccaacgtgatctactgcgaggagtgcagcatgtaccactccaagaaggggatcaagtacaacggcgacttcaccaacaagtgcggcttctgcacgtgcagcgagcaggaggacatcgagggggtggtcatccacaaggtgtcccggaagtgcacctacaagtaccagctgaagtgggtgcgcgtcatcatgatcatcctggccctcctgctgaccctgcagaacaccgtgctcatcgtcgccgccgaggtggactgctggacgaagaagtccatcgagatcgactgcatcggcccgctgctgaacatcgggacctgcaccgacaagagcagccggacctacgagaccgaggtgaacaagctcgtccgccagagcaaggtgacgcaggccgacgcggagcaggtctccatcctgggcagcaccctggactccgccatcaaggccatccggagccagaagacctacgagaccatgcacttcctcgagacggtgttcctgatgaagaactgcgactactactccagcttcgagcacaactccgggtacagccagaccaagtggcgcctgatcgccaagacctcccacttcgacatctgcagccggcactccgcccaccacttctgccgctgcgtgaacgagggcaccaagtgccagaacggcgactgggacttcgcgcgggagatgaacgacacgtacaacagcaagaacgacttctacctccacgacctggacctgttctacaccctcttcgagaacgccttccccgggaccaccgagtccctgttctaccagctgctccagaagaagaacacgaccggcgccagcaagctgctggggaagctcatcaccaagtacggcaacaacaacctgttcgtggggatctggaagttcggccagtacctgctcaagctgccctacatcaacgacaccgagctgtccacggaccgcaagagcaccatcatgaagtcccagcagatgctcagccggagccagaccggccgccaggagtccctgagctccgccacccccgggacggccaccaaggagtgcagcaacgcgaaggacatcggctgcatctccccgcgcttcgggatccccatcggcaacctgaccgcctgcggcgacagccccaactacaagatctacaagacccccgagaagatctacaagtccaacaacaagggggaggtctggtgcagcgacgacgtgcactgcctcgccgacttcgagccggccgaggaggaggtggtcaaccggatcaagcagatgacgtgcttcctgaccgacgtgaccaccaagacggacgtgttctccgtcgcgatcagcacgtgcaagatggccgacaagggcgtgtgcaccgtgaacgacgccaagtggaacatcctgaagtgcaactccgggctctactacttcaccgaccaccgcgacggccaggacaccgggaacgacttcggcgagtactgcatcagccactcctgcaacaccgagcggttccccatcaaccccgacgtcctgaaggactgcatctgggagtaccacagccgcaagtccaagtacatcagcaccatctccctggagagcctcgacgagttccggcgcgccatgagcgacaagctgtcccacaccctgatgatctacaacttcaagcccacggccaacctcccgcacatcaagcccacctacaagttcatcaccgcgaacggcatcgagaacagcgacgggatcgactccgcctacatcctgagctccatccccgccctgggcgggatgagcgtgggctacaacgtgcagaccaaggacaacttccccctcctggacatcatcgtcttcatcaagtccgccatcatcaagaccacgtacaaccacatctacgacaccgggccgaccatcggcatcaacacccagcacgacgagcactgcacgggcccctgccccaccctgatcccccacaaggagaactggctcaccttcagccaggagcggacctcccgctgggggtgcgaggagttcggctgcctggccatcaacacggggtgcgtgttcggcagctgccaggacatcatccacccggaggcgaaggtgtaccggaaggccatcgaggaggaggtcgtgctgaccgtgtgcatcaccttccccgggaacacctactgcacggagatcaacgccatcgagcccaagatcaccgacgagatcgagctccagttcaagaccgtcgacaccaagacgctgccgaacctgctcatggtgcagaaccacaagctgtactccggccagatcaacgacctgggcagcttctcccaggggtgcggcaacgtgcagaagaccaaccagagcgtcatcgggaccggcaccgccaagttcgactacgtgtgccacggggcctcccgcaaggacgtgatcgtccggcgctgctacaacaacaactacgagagctgcaagctcctgaaggaggagtccagcctgatcttcgcggacaaccacgagacgctcgaggtggccaacaccaagcacctgatcggcgagctgcagttcaagatcatgctcggcgacatccggtacaagtccttcgccgagagccccgagctggaggtggacgccaagtgcgtcgggtgccccagctgcttcgagtcctacagctgcaacttccagatcgtgaccaacatcgacaccgtgtgctccgtcgacggcccctgcacgctgttccacaaccgcctcatcatcagcgcggccaagcagtcctacgggctgaagatgagctgctcccggcgcccggagcagaccgaggagttccagatctgcaaccggaagtacagcgtgctgttcaccaccatcgacaagaacgacaagatcgagatcaacacgggcgaccagacctcctacatctacgagaaggacaaccgctgcaagacctggctctgccgggtgcgcgacgagggcatcagcgtcatcttcgagcccctgaaggccttcttcgggtcctacttcagcatcatcttctacgtgatcgtgggcatcatcgtcctgttcctcatcatctacatcttcctgcccatgttcttcaagctgcgcgacatcctcaagcggaacgagtacctgtacctgcaggagctcaagcacaagtga

SEQ ID NO: 12567 - RNA, 4302 nt, synthetic construct
  misc_feature 1..4302: note = derived and/or modified CDS sequence (opt1) from NORV(0234)__EU004188.1__GP
  source 1..4302: mol_type = other RNA
atgatctggttcatcctgctcctggccatcgcccccagcttcggcaccccgatcgcgacccgctgcttccacgggggccagctgatcgccgaggccaagtcccagacgagcatctccgagttctgcctcaaggacgacgtgagcatgatcaagtccgaggtcacctacaccaagaacgacaccgggatcttcggccacagcaaggtgtaccggtcctggacgatcaaggactggaagctgtgcaaccccgtgcccaccgtcgggggcagcatcaacgtgatcgaggtgaccgccgacctgtccctcagcaccaaggcctacgtctgctcccgcgactgcacgatcaccatcgacaaggagggcgcgcagatcgtgttccagaccgacaagctgaaccacttcgaggtgagcgggaccacgctgtccagcggctggttcaagaccaaggcctccgtcaccctcgaccggacctgcgagcacatcaaggtgacgtgcgggaagaagaccctgcagttccacgcctgcttcaagcaccacatgagctgcatccgcttcttccacaacaccatcctgcccggctccatggtggccagcatgtgccagaacatcgagctcatcatcatcctggggctgaccctcatcatcttcatcctgatggcgatcctgacgaagacctacatctgctacctcctgatgccgatcttcatgcccatcgcctacgcctacggctgggcctacaacaagtcctgcaagaagtgccactgctgcggcctggcctaccaccccttcaccaactgcgggagccactgcgtctgcggcctcaagttcgaggcgagcgaccggatgcgcatccaccgggagtccgggctgtgccagggctacaagagcctgcgcgtggcccggctcctgtgcaagtccaagggcagctccctggtgatcagcatcctcctgtccatgctgatcctcagcttcgtcacccccatcgaggggacgctgaccaactacccggagtcccgccggtacaccctggaggagatcgccgacgtggtggagggcatcatcgccgagcaggacctcaaggagtacatcgtcttctacaccagcctgttcgggtccctgatcctcctgctggccttcatcctcagcgtgacgctgaccaaggtgctggacctcctggcgaagaccaacgtcatctactgcgaggagtgctccatgtaccacccccgcaagggcatcaagtacaacggggacttcaccaacaagtgcggcttctgcacgtgcgacgagcaggaggacgtggagggcgtgatcatccacaaggtcagcaagaagtgcacctaccggtaccaggtgaagtgggccaagatcatcatgatcatcgtcgtgatcctgctcatggcccagaacaccatcctgatcgtggccgccgagaccgactgctggacgaagaagtccctggagctcgactgcatcgggcccctgctgaacatcggcagctgctccgggaaggaggcgcgcacctacgagaccgaggtcaagaagctggtgagccagtccaaggtgacccacatcgacgccgagcacatcagcatcctcggcgccaccatcgacagcgccatcaagtccatccgggcccagaagacgtacgcgaccatgcacctcctggagaccgtcttcctgatgaagaactgcgactactacaccgtgttcgagcacaacagcgggtactcccaggccaagtggcgcctgatcgccaagacgaaccacttcgacatctgcagccggcactccgcccaccacttctgccgctgcatcaacgacgagaccaagtgccagaacggcaactgggacttcgcgggcgagatgaacaacacctacagcaccaagaaggacttctaccggcacgacctggacctcttctacacgatcttcgagaacgccttccccgggtccaccgagagcctgttctaccacctcctgcagaccaagaacaccacgggcgcctcccgcatcctggagaagctgagcaccaagttcgggaacaacaacatgttcgtgggcatctggaagttcgggcagtacctcctgaccctgccgtacgtcaacgagaccgagctctcccccagccggcagtccacgatcctgaccaacagcaactccctgagccgctccaccggccgccaggagagcctcagctccgccatccccggccccaacaccaaggagtgcagcaacgcccgggacgtggggtgcatctccccgcgcttcggcatccccatcgggaacctgacggcgtgcggcgagagcccctcctacaagatctacaagacccccgagaagctgtacaagagcaacaacaagggcgagatctggtgctccgacgacgtgcactgcctcaagaacttcgagccggccaccgaggagatcgtcaaccggatcaagcagatgacctgcttcctgacggacgtgagcaccaagaccgacatcttctccatcgccaccagcacgtgccgcatggtggacaagggggtctgcaccgtgaacgacgccaagtggaacatcctgaagtgcgactccggcctcttctacttcaccgaccagcgggaggggcaggacaccggcaacgacttcggggagtactgcatcagccactcctgcaacacggagcgcttccccatcaaccccgacatcctgaaggactgcacctgggagtaccacagccggaagtccaagtacatcagcaccatctccctggagagcctcgacgagttccgccgggccatgtccgacaagctgagccacaccctgatgatctacaacttcaagcccacggcgaacctcccgcacatcaagcccacctacaagttcatcaccgccaacggcatcgagaacagcgacggcctggactccgcctacatcgtgagctccatccccgccctcgggggcatgagcgtcgggtacaacgtgcagaccaaggacaacttccccctgctggacatcatcgtgttcatcaagtccgccgtcatccgcaccacgtacaaccacatctacgacaccggcccgaccatcgggatcaacacccagcacgacgagcactgcacgggcgcgtgccccacccagatcccccacaaggacaactggctgaccttcagccaggagcggacctcccgctggggctgcgaggagttcgggtgcctcgccatcaacacgggctgcgtgttcgggagctgccaggacatcatccacccggagaccaaggtgtaccggaaggccatggaggaggaggtcatcctgaccgtgtgcgtgaccttccccggcaacacgtactgcaccgagatcaacgccatcgagcccaagatcaccgacgagatcgagctgcagttcaagaccgtcgacacgaagaccctccccaacatcctggcggtgcagaaccacaagctgtactccgggcagatcaacgacctcggcagcttctcccagggctgcgggaacgtgcagaagaccaaccagagcatcctgggcaccgggacggccaagttcgactacgtctgccacggcgcctcccgcaaggacatcatcgtgcggcgctgctacaacaacaaccacgacagctgcaagctgctcaaggaggagacctccctgatcttcgccgacaaccacgagaccctggtggtcgccaacaccaagcacctcatcggggagctgcagttcaagatcatgctgggcgacatccggtacaagagcttcgcggagtccccggagctcgagatcgacgccaagtgcgtgggctgccccagctgcttcgagtcctacagctgcaacttccagatcatcacgaacatcgacaccgtgtgcagcgtctccgggccctgcaccctgttccacaaccgcctgatcatcaccgccacgaagcagagctacggcatcaagatgtcctgccccaccaagccggaggggaccgagaccttcgagatctgcaacaagcagtacaagatcttcttcacgaccatcgacaagaacgacaagatcgagatcaacaccggcgaccagaccagctacatctacgagaaggacaaccggtgcaagacgtggctctgccgcgtgcgcgacgagggcatctccgtgctgttcgagcccctgcgggccttcttcgggagctacttctccatcatcttctacgccgtcgtgggcatcatcatcctcttcctggcggtgtacatcttcctgcccatgatcttcaagctccgcgacatgctgaagaagaacgagtacctgtacctccaggagagcaagcacaagtga

SEQ ID NO: 12568 - RNA, 4305 nt, synthetic construct
  misc_feature 1..4305: note = derived and/or modified CDS sequence (opt1) from PLAV(75V3066)__KX100122.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacatcaagaacgacaccgggctgttcggccacaacaaggtgttccggagctggaccatcaaggactggaagctgtgcaacccgatccccaccgccgggggcacgatcaacgtcatcgaggtgaacaaggacctctccctgatgaccaagacctacatctgcagccgcgactgcaccatcacgatcgacaaggaggaggcccagatcatcttccagaccgacaagctgaaccacttcgaggtgtccggcaccaccctcagctccgggtggttcaagagcaaggcctccgtcacgctggaccggacctgcgagcacgtgaaggtgacctgcggcaagaagtccctgcagttccacgcgtgcttcaagcaccacatgagctgcgtccgcttcttccacaacaccatcctccccgggaacatgatcacgagcatgtgccagaacatcgagctgatcatcatcctgggcctcaccctggccatcttcatcctgatggtgatgctcaccaagacctacatctgctacctgctgatgcccatcttcatgccgatcgcctacctctacgggtgggcctacaacaagtcctgcaagaagtgcaactgctgcggcctggcgtaccaccccttcacgaactgcggcagccactgcgtgtgcgggctgaagttcgaggccagcgaccggatgcgcatccaccgggagtccggcctctgccaggggtacaagagcctgcgcatcgcccggctgctctgcaagtccaagggcagctccctggtcatcagcggcctgctctccatgctgatcctgagcttcgtgacccccatcgaggggaccatcacctcctaccccgagagccgcaagtacacgctcgaggagatcaccgacgtggtcgagggcctggtgtccgagcagaacatcaaggagtacatcgtgttctacaccagcctgttcgggtccctcatcctgctgctcgccttcatcatgagcatcaccctgtccaagatcacgagcatcctggccaagcggaacgtcatctactgcgaggagtgctccatgtaccacagcaagcgcggcatcaagtacaacggggacttcaccaacaagtgcggcttctgcacgtgcaacgagcaggaggacaccgagggcctcgtgatccacaaggtgtccaagcggtgcacctacaagtaccagctgaagtgggcgaaggtcctgatgatcaccctcgtgctgctgctgatcgcccagaacaccatcctcatcgtggccgccgagaccgactgctggacgaagaagtccctggacatcgactgcatcgggccgatgctggacatcggcagctgcaccaacaagaacacccgcagctacgacgccgaggcgcagaagctcgtcagccagtccaagatcagccagctggacgccgaccaggtgtccctgctcgggaacagcatcgactccgccatcaaggccatccgggcccagaagacctaccccaccatgcacctcctggagacgatcttcctcatgaagaactgcgactactacaccaacttcaaccacaacagcggctactcccaggcgaagtggcgcctgatcgccaagaccgggcacttcgacatctgcagccggcactccacccaccacttctgccgctgcatcaacgacggcacgaagtgccagaacggcgactgggacttcgccggggagatgaacgagacctacaacagcaagaacgacttctactcccacgacctgaacctcttctacaccatcttcgagaacgccttccccggcaccacggagagcctgttctaccagctgatccagaagaagaacaccaccggggcctccaaggtcctcggcaagctgatcaccaagtacgggaacaacaacatgttcgtgggcgtgtggaagttcggccagtacctgctcacgctgccctacatcaacaacaccgagctgagccagaaccggcgcctcaccatcctggcgacccaggagatcctgtcccggagccacagcgggcgccaggagtccatgagcaacgccatccagggctccatcacgaaggagtgccacaacgccaagggggtcggctgcatcagcccgcgcttcggcatccccatcgggaacctcaccgcctgcggcgactcccccaactacaagatctacaagacccccgagaagctgtacaagagcaacaacaagggggaggtgtggtgctccaacgacgtgcactgcctgaacgacttcgagccggcggacgaggaggtcatcaacaagatcaagaagctgacctgcttcctgacggacgtgagcgtggaggtcgacatcttctccgtggccgccagcacgtgcaagatggccgacaagggcgtgtgcaccgtcaacggggccaagtggaacatcatcaagtgcgactccggcctgtactacttcaccgaccaccgggagggccaggacaccgggaacgacttcggcgagtactgcatcagccactcctgcaacaccgagcgcttccccatcaaccccgacaccctcaaggactgcacctgggagttccacagccggaagtccaagtacatcagcacgatctccctggagagcctggaggagttccgccgggcgatggccgagaagctctcccacaccctgaccatctacaacttcaagcccaccgccaacctgccgcacatccgccccacgtacaagttcatcaccgccaacggggtggagaacagcgacggcatcgagagcgcctacatcctctccagcatccccgcgctcgggggcatctccgtgggctacaacgtccagaccaaggacaacttccccctgctggacatcatcgtgttcatcaagagcgccgtgatccggaccacgtacaaccacatctacgacaccgggccgaccatcggcatcaacacccagcacgacgagcactgcaccgggccctgccccgccgtcgtgccccacaaggagaactggatgacgttctcccaggagcgcaccagccggtggggctgcgaggagttcgggtgcctggccatcaacaccggctgcgtgttcggctcctgccaggacatcatccacccggagaccaaggtctaccgcaaggccgtggaggaggaggtggtcctgacggtgtgcatcaacttccccgggaacagctactgcaccgagatcaacgcgatcgagcccaagatcaccgacgagatcgagctccagttcaagaccgtggacacgaagaccctgccgaacctgctcgccgtccagaaccacaagctgtactccggccagatcaacgacctggggagcttctcccagggctgcgggaacgtgcagaagaccaaccacagcatcctcggcatgggcaccgtgaagttcgactacgtctgccacggggcctcccggaaggacgtgacggtgcgccggtgctacaacaacaacttcgacagctgcaagctgctgaaggaggagacctccctcatcttcgccgacaaccacgagaccctggaggtcgcgcacaccaagcacctgatcggcgagctccagttcaagatcatgctgggggacatccgctacaagagcttcgccgagtcccccgagctggagatcgacgccaagtgcgtgggctgccccagctgcttcgagtcctacagctgcaacttccagatcgtgacgaacatcgacaccgtctgcagcgtggagggcccctgcaccctcttccacaaccggatcatcatctccgccaacaagcagagctacgggctgaagatgtcctgccagaccaagccgaaccagaacgaggagttcatcatctgcaaccgcaagtacagcgtgctgttcacgaccatcgacaagaacgacaagatcgaggtcaacaccggcgaccagacctcctacatctacgagaaggacagccggtgcaagacgtggctctgccgcgtgcgggacgaggggatctccgtgctgttcgagcccctgaaggccttcttcggcagctacttctccatcatcttctacgtcgtggtggggatcatcgtcctcttcctgatcgtgtacatcttcctgcccatgttcttcaagctcaaggacgtgctgaagcgcaacgagtacctgtacctccaggagctgaagcacaagtga

SEQ ID NO: 12569 - RNA, 4305 nt, synthetic construct
  misc_feature 1..4305: note = derived and/or modified CDS sequence (opt1) from PLAV(75V5758)__KX100128.1__GP
  source 1..4305: mol_type = other RNA
atggagctgctcatcatcatcctgctgctcggcagcgccgcctccagccccgtgtccacccgctgcttccacgggggccagctgatcgcggagagccggtccgccaccagcatctccgagttctgcctgaaggacgacgtcagcatgatcaagtccgaggtgacgtacaccaagaacgacaccgggatctacggccacaacaaggtgttccgcagctggaccatcaaggactggaagctctgcaacccgatccccacggccgggggctccatcaacgtcatcgaggtgaacagcgacctgtccctggccaccaaggcctacgtgtgcagccgggactgcaccatcaccatcgacaaggaggacgcgcagatcatcttccagacggacaagctcaaccacttcgaggtctccggcaccaccctgagctccgggtggttcaagaccaaggccagcgtgacgctggaccggacctgcgagcacatcaaggtgacctgcggcaagaagtccctccagttccacgcctgcttcaagcaccacatgagctgcatccgcttcttccaccacaccatcctgcccgggacgatggtcagctccatgtgccagaacatcgagctgatcatcatcatcggcctcaccctggccatcttcatcctgatggtgatcctcaccaagacctacatctgctacctgctgatgcccgtgttcatgccgatcgcgtacatctacgggtgggcctacaacaagagctgcaagaagtgcaactgctgcggcctcgcctaccaccccttcacgaactgcggctcccactgcgtctgcgggctgaagttcgaggccagcgaccgcatgcggatccaccgcgagtccggcctgtgccaggggtacaagagcctccggatcgcccgcatgctgtgcaagtccaagggcagctccctggtgatcagcggcctcctgtccatgctgctcctgagcttcatcacccccatcgaggggaccctgaccaactaccccaacgagaagcagtacacgctcgaggagatcgcggacgtggtcgagggcatcatgaccgagcagcacctgaaggagtacgtggtgttctacacctccctgttcgggggcctcatcctgctgctcaccctgatcctgagcatcacgatcaacaaggtcaccgacctcctggcctccaccaacgtgatctactgcgaggagtgcagcatgtaccactccaagaaggggatcaagtacaacggcgacttcaccaacaagtgcggcttctgcacgtgcagcgagcaggaggacgtggagggggtcgtgatccacaaggtgtcccggaagtgcacctacaagtaccagctgaagtgggtccgcgtgatcatgatcatcctcgccctgctgctcaccatccagaacaccgtcctgatcgtggccgccgaggtggactgctggacgaagaagtccatcgagatcgactgcatcggcccgctgctgaacatcgggagctgcaccgacaagagcggcaagacctacgagaccgaggtcaacaagctcgtgcggcagagcaaggtgacccaggcggacgccgagcagatctccgtcctggggaacacgctggacagcgccatcaaggccatccgctcccagaagacctacgagaccatgcacttcctcgagaccgtgttcctgatgaagaactgcgactactacagctccttcgagcacaacagcggctactcccagacgaagtggcggctgatcgccaagaccagccacttcgacatctgctcccgccacagcgcgcaccacttctgccggtgcgtgaacgagggcaccaagtgccagaacggggactgggacttcgccggcgagatgaacaacacctacaactccaagaacgacttctacctccacgacctggacctgttctacaccctcttcgagaacgccttccccgggaccaccgagagcctgttctaccagctgctccagaagaagaacaccacgggcgcctccaagctgctggggaagctcatcaccaagtacggcaacaacaacatgttcgtcggcatctggaagttcgggcagtacctgctgaagctcccctacatcaacgacaccgagctgagcgccgaccgcaagtccaccatcatgaagtcccagcaggtcctgagccggagccagacgggccgccaggagagcctctccagcgcgacccccgggaccgccaccaaggagtgctccaacgccaaggacatcggctgcatcagcccgcggttcggcatccccatcgggaacctgacggcctgcggcgactcccccaactacaagatctacaagacccccgagaagatctacaagagcaacaacaagggggaggtgtggtgctccgacgacgtgcactgcctggcggacttcgagccggccgaggaggaggtggtgaaccgcatcaagcagatgacctgcttcctcaccgacgtcacgaccaagaccgacgtgttcagcatcgccgtgtccacgtgcaagatggtcgacaagggcgtgtgcacggtgaacgacgccaagtggaacatcctgaagtgcaacagcgggctgtactacttcaccgaccaccgcgacggccaggacaccggcaacgacttcggggagtactgcatctcccacagctgcaacaccgagcggttccccatcaaccccgacgtcctcaaggactgcatctgggagtaccactcccgcaagagcaagtacatctccacgatcagcctggagtccctggacgagttccggcgcgccatgagcgacaagctcagccacaccctgatgatctacaacttcaagcccaccgcgaacctgccgcacatcaagcccgcctacaagttcatcaccgccaacggcatcgagaactccgacgggatcgacagcgcctacatcctctccagcatccccgccctgggcgggatgtccgtgggctacaacgtgcagacgaaggacaacttccccctgctcgacatcatcgtcttcatcaagagcgcgatcatcaagaccacctacaaccacatctacgacaccggcccgaccatcgggatcaacacgcagcacgacgagcactgcaccggcccctgccccaccctgatcccccacaaggagaactggctgaccttctcccaggagcggacgagccgctgggggtgcgaggagttcggctgcctcgccatcaacaccgggtgcgtgttcggctcctgccaggacatcatccacccggaggccaaggtgtaccggaaggccatcgaggaggaggtcgtgctgaccgtgtgcatcaccttccccggcaacacgtactgcaccgagatcaacgccatcgagcccaagatcaccgacgagatcgagctgcagttcaagaccgtcgacacgaagaccctcccgaacctgctgatggtgcacaaccacaagctctacagcgggcagatcaacgacctgggctccttcagccaggggtgcggcaacgtgcagaagaccaaccagtccgtcatcggggcgggcaccgtgaagttcgactacgtgtgccacggcgccagccgcaaggacgtcatcgtgcggcgctgctacaacaacaactacgagtcctgcaagctgctcaaggaggagacgagcctgatcttcgccgacaaccacgagaccctggaggtggccaacaccaagcacctcatcggggagctgcagttcaagatcatgctgggcgacatccggtacaagtccttcgcggagagccccgagctcgaggtcgacgccaagtgcgtggggtgcccctcctgcttcgagagctacagctgcaacttccagatcgtgaccaacatcgacacggtctgctccgtgaacggcccctgcaccctgttccacaaccgcctgatcatcagcgccaccaagcagtcctacggcctcaagatgagctgctcccggaagccggagcccaccgaggagttccagatctgcaaccgcaagtacagcgtgctgttcacgaccatcgacaagaacgacaagatcgagatcaacaccggggaccagacctcctacatctacgagaaggacaaccggtgcaagacgtggctgtgccgcgtccgggacgagggcatcagcgtgatcttcgagcccctcaaggccttcttcgggtcctacttcagcatcatcttctacgtgatcgtcggcatcatcgtgctgttcctgatcgtgtacatcttcctccccatgttcttcaagctgcgcgacatcctgaagcggaacgagtacctctacctgcaggagctgaagcacaagtga

SEQ ID NO: 12570 - RNA, 4317 nt, synthetic construct
  misc_feature 1..4317: note = derived and/or modified CDS sequence (opt1) from POTV(89-3380)__EU004189.1__GP
  source 1..4317: mol_type = other RNA
atggagcccccgatgaagctgttcctcatcctggccaccgccgtggcggccgtctacagcctgcccgcctcccgctgcttcagcgacggcatcatcatcaaggagaagcaggactccaaggccgtgagcgagttctgcctcaaggacgacgtgtccatgatcaagagccacgtcgtgtactccaagaacgagagcgggatcttcgccaactcccagatcctgcggaagtggatcatcaaggactggaagctgtgcagccccctccccaccgcgggcgggcagatcaacgtgatcgagatcaaccacgacctgacgctgtccaccaagacctacgtctgcaccacggactgcaccatcggcatcgacaaggagaacgcccagatcaccttccagaccaacaagctcaactacttcgaggtgagcgggacgaccatctccagcggctggttcaagtccaagaccagcgtgtccctggaccagacctgcgagcacctgaaggtcagctgcggcaagaagtccatgcagttccacgcctgcttcaagcagcacatgagctgcatccgctacctccacaagacggccctgccggggtacatggcggccagcatctgctccaacatcgagctgatcatcatgaccaccctcaccctggccatcttcatcctgctctgcatcatcacgaagacctacatctgctacctgctgatgcccctcttcatgcccatcgcctacatctacggctggctgtacaacaagagctgcaagaagtgcaactgctgcgggctgtcctaccaccccttcaccaactgcggcagctactgcgtgtgcggggccaagttcgagacctccgaccggatgcgcatccaccgggagagcggcctctgccagggctacaagtccctgcgcgtggcgcggaagctgtgcaagagcaaggggtccagcctcgtcatctccgtgacgctgagcgtgttcatcttctccttcatcaccccgatcggcggggtcatcatcaacgacaagctgagcgaggagaagtactccatcaaccagatgatggacgccatcgtggacctcgagaacttcagccacaacgtgtccggcacccagcaggtcatcagcgtgatcttcctgctgatctcctgcctcttcctgctgctcacctaccgcctgaacaagatcatccagcacctggcccggagcggcctcctgttctgcgaggagtgcagcatgtaccactccaagaaggacatcaagtacaacggggacttcacgaacaagtgcggcttctgcacgtgcgggcagcccgaggaccccgagggcctgaacctccacatcctgagccagaactgcacctacaagcagcagttcaagtgggtgaagatcatcatctccatcctgctcagcctgatcatcatcgagtccagcatgatcctggccgccgcggagaccgactgcttctccgagaagcagatcagcgagttctgcctcgggcccctgctgtccatcagctcctgcgaggacaagaacagccgcaccttcaagggcgaggcccagaagctggtcgccctcaagaagatcacctccgacgaggccatgctgatcgagagcatgggcgccaaggtggaggacgcgctgaagatgatccaggcccagaagtccccggacagcatgtacaccatggagtacgtgttcctcaacacctactgcgactactactccctgttcgagcacaacagcgggtacagccagatcaagtggcggtacatcctgaagacgcaccagttcgacgcctgcgcccgccactccaacaaccacttctgccggtgcatgagcgacggcatgcactgcccctccctcgactgggacatcgccgacgagctgaacaacacctacatcaccaagcccaacttcttcaagcacgactacaacctgctcctggacgtcatcaccgcggccttccccgggacgggcgccgtgttcgtcatcgacgcctgcaagaaggcgaacgccaccgccatcaagaccttcagcaacaacatcatcgcccgcttcccgtacaacaacctgctcaagggggtgatgaagttcctgcagtacatctccaagcaccccagcttcaagaagtaccagcccgacacccggcactacgacctgatccccgtggccccgaccgcgcgcggccggtccctcggccgcagcaactcctacagcgacgcccaggtcgggccgcccacgaaggactgccagaagctgaaggaggtgggctgcctgtcccccaagttcgggctccccctggagagcatcatctcctgcggcagctcccccaactacaagctgtacaagaagccccagaagtactacaagagcaacaacaaggagaacacctggtgctccaaggacgtgcactgcctccacgacttcgagcccatcaccgaggacgtcctggagaaggtgaaggtgatgacctgctgggagatcgagccggggacgatcgaggacatcttcaccatcgccagcgagacctgcaagatcaacgaccggggcgtctgcgaggtgaacgccgccaagtggaagatcgtgaagtgcgagaccggcctgtactactacacggaccaccgcgagggggacgacaccggctccgacctcgggcactactgcctgacccacaagtgcgcgggcggccggtaccccatcaaccccgagatcctgcagaactgcatctgggagttccacagccagaagtcccagtacatcaaccaggtcgacctcgagcagatcgaggagtacaagaaggccctgaccgagaagctgacgcacaccctcaaccactacaacttcctgccgaccaagaacctgccccacatcagccccaactacaagtacgtgaccctcaacgggcaggagacgagcgacggcatcgagaactcctacatcgtgagcgagatccccgccatcgccgggacctccatcggcctgaaggtccagaccaagaacaacgggaacatcttcgacctgatcatctacgtgaagcgcgccgacatcatcgcgagctacaaccacatctacgacaccggcccgacgatcggccacaacgtggagcacgaggagctctgcaccgggcagtgcccccagcacatccccgccaaggccaactggctgaccttctcccaggagcgcaccagccggtggggctgcgaggagttcgggtgcctggccatcaacacgggctgcgtctacgggtcctgccaggacatcatcaagcccgtggcgaaggtgtaccgcaagagcaccgaggagaaggtcgagctcgagctgtgcatcgtgctgccggaccggaacttctgcaccaccctcaacgccctggagcccaagatcacggaggagatcgagctgcagttcaagaccatcgaccaggtgtccctccccaacatcgtcctgctgcgcgaccacaagctgttcaagggccagatcaacgacctgggcaccttcgggcagaactgcggcaacgtgcagaagaccaaccagagcatcctgggggccggcacggtgcggttcgactacctctgccactccgccagccgcaaggacatcatcatccggcgctgctacaacaacaactacgactcctgcaaccacctccagctggccgagagcctcatcttcctggacaaccacgagaccctggaggtccggaagcccaaccacatcctcgggaccctgtccatgaagctgatgctcggcgacttccagtacaagaccttcgcgaaggacatcgagctggacttcacgggccgctgcgtggggtgcatcggctgcttcgaggggttcgtgtgcgagatgcacatcaccaccaccgtcgaggcgacctgcaacctggaggccagctgccagttcttccacaaccagctccacatcaagccggacgtgctgaagtactacacgaagatgacctgccagaccgacgagtacatcccctccaagatcaagatctgcaacaaggagtacaagatcaccatcggcaaggtgcggaagaacgacaagatcgagatcgacaacagcgaccagacgagctacatcaaggagaaggacgagcgctgcaagacctggctgtgccgggtccgcgacgaggggatctccgtgatcttcgagcccctcctgaacatcttcggcaactacggccggatcgccgtggccgtcatcagcgccatcctggccctcatcgtgctggtgtacatcctgatgcccatctgcatgaagatccgcgacatcctcaagaccaacgagaaggagttcctgatcgagtccaagtacaagtga

SEQ ID NO: 12571 - RNA, 4311 nt, synthetic construct
  misc_feature 1..4311: note = derived and/or modified CDS sequence (opt1) from TENV(TSV-FE3-66FB)__FJ943508.1__GP
  source 1..4311: mol_type = other RNA
atggagatcttcttcatcgccctgctcgccatcgcgaacagcgtgaactccacgcccctggccacccgctgcttccacggcgggcagctgatcgccgagagcaagtccgccacgagcctctccgagttctgcctgaaggacgacgtcagcatgatcaagtccgagatctactacgtgaagaacgagaccggcatcttcagccacaacaaggtgctgcggtcctggaccatcaaggactggaagttctgcaacccggtccccaccgccgggggcagcatcaacgtgatcgaggtgaactccgacatgagcctcgcgacgaagacctacgtctgctcccgcgactgcaccatcaccatcgaccgggaggaggcccagatcatcttccagacggagaagctgaaccacttcgaggtgagcgggaccaccctgtccagcggctggttcaagtccaaggccagcgtgaccctcgaccgcacgtgcgagcacctgaaggtgacctgcggcaagaagtccctgcagttccacgcctgcttcaagcaccacatgagctgcatccggttcttccacaacaccatgctccccgggcgcatcgtcaacagcatgtgccagaacatcgagctgatcatcatcctgggcctcaccatcgtgatcttcatcctgatggtcatcctgacgaagacctacatctgctacatcctcatgcccctgttcatgccgatcgcgtacatctacgggtgggcctacaacaagtcctgcaagaagtgcaactgctgcggcctggcctaccaccccttcaccaactgcgggagccactgcgtgtgcggcctcaagttcgaggcctccgaccggatgcgcatccaccgggagagcggcctgtgccaggggtacaagtccctgcgcatcgcccggctcctgtgcaagagcaagggctccagcctggtgatctccatcctcctgagcatgctgctcctgtccttcgtcacccccatcgagggggcgctgacgaactacccccagagcaagctctactccctggaggagatcgccgacgtggtggagggcctgatcaccgagcacaacgtcaaggagtacatcgtgttctacaccagcctcttcggcgggctgatcctgctcctggccttcatcctgtccatcatgctcaccaaggtgacgagcatgctggcccgcaccaacgtcatctactgcgaggagtgctccatgtaccacagcaagaccggcatcaagtacaacggggacttcaccaacaagtgcggcttctgcacgtgcgacgagcaggaggacgccgaggggatcatcatccacaaggtgtccaagaagtgcacctacaagtaccagctgaagtgggcgcggatcatcatgatcatcctcatcgtgctgctgaccacccagaacacgatcctcatcgtcgccgccgaggtggactgctgggagcgcgccaccctgagccaggagtgcatcggcccgctgcagaagatcgaggactgccagaacaaggaggagaagacctacatgagcgaggccaacaagctggtctcccagagcaagatcacccaggcggacgccgaccaggtgtccgtgctcggcgacacgatcgacagcgccatcaaggccatccggtcccagaagacctaccagaccatgcacctcctggagaccgtcttcctgatgaagaactgcgactactacagcaccttcgagcacaactccgggtacagccaggccaagtggcgcctgatggcgaagacgaaccacttcgacatctgctcccggcacagcaaccaccacttctgccgctgcgtgaccgagggcaccaagtgccagaacggggactgggacttcgccggcgagatgaactccacctacaacaccaagagcgacttctaccagcacgacctgaacctcttcttctccctgtacgagagcgccttccccgggaccgccgagtccctgttctaccagctcatcagcgagaagaacaccaccggcgcgtcccagctgctgggccagatcatcaagaagttcgccaacaacaacatgctcatcggggtgtggaagttcggccagtacctgctgacgctcccctacgtcaacaccaccaagctgagcaagagccgggaggagaccatcctgacgaaccaccagcgcctcgtgcggtcctacaccgggcgccagcagagcatggccaacgccgaggtgggcgagtccaccaagaactgcctgaacgccaagaacgtcgggtgcatcagcccccgcttcggcgtgccgatcggcaacctgaccgtgtgcggggagtccacgaactacaaggtctacaagacccccgcgaagatctacaagagcaacaaccggcccaagacctggtgctccgaggacgtgcactgcctcagcaacttcgagcccgcctccgccgaggtggtcaacaagatcaagcgcatgacctgcttcctgacggacgtgaccaccaacgtggacgtcttcagcatcgccatctccacgtgcaagatggccgacaagggcgtgtgcaccgtgaacgacgcgcggtggagcatcctgaagtgcgactccgggctcctgtacttcaccgaccaccgcgagggccaggacaccggcaacgacttcggggagtactgcatcagccacaactgcaacaccgagcggtacccgatcaaccccgacatcatcaaggactgcatctgggagtaccactcccgcaagagcaagtacatctccgccatcaacctggagagcctcgaggagttccggcgcgccatgtccgagaagctgagccacacgctggtcatctacaacttcaagcccaccgccaacctcccccacatcaagccgagctacaagtccatcaccgtgaacggcatcgagaacagcgacgggatcgagtccgcctacatcctgagcaacatccccgcgatcggcgggatgtccgtgggctacaacgtcctgaccaaggacggcttccccctcctggacatcatcatcttcatcaagagcgccgtgatcaagacgacctacaaccacatctacgacaccgggcccaccatcggcatcaacacgctgcacgacgagaagtgcaccgggccgtgcccctccatcatcccccacaaggagaactggctcaccttcagccaggagcggacctcccgctggggctgcgaggagttcgggtgcctggccatcaacaccggctgcgtgttcggcagctgccaggacatcatccggcccgagacgaagatctaccgcaaggccgtcgaggaggaggtgatcctgaacgcgtgcatcaacttcccggggaacacctactgcaccgagatcaacgccatcgagcccaagatcaccgacgagatcgagctccagttcaagacggtggacaccaagaccctgcccaacctgctcgccgtccagaaccacaagctgtactccggccagatcaacgacatcgggaccttcagccagggctgcgggaacgtgcagaagacgaaccagaccatgctgggcaccggcaccgtgcggttcgactacgtctgccacggggcctcccgcaaggacatcatcgtgcggcgctgctacaacaacaactacgagagctgcaagctcctgaaggaggagaagtccctgatcttcgccgacaaccacgagacgctcgaggtggcgaacacccggcacctcctgggcgagctgcagttcaagatcatgctgggggacatccgctacaaggccttcgccgagaagccggagctggagatcgacgccaagtgcgtcggctgccccagctgcttcgagtcctacagctgcaacttccagatcgtgtccaacgtggacaccgtctgctacatcgaggggccctgcaccctcttccacaaccggatcatcatcaagacgatgaagcaggcctacggcatcaagatgagctgcaagaccaagcccgcgccgagcgaggagttcaagatctgcggccgcacctacaacgtggccttcaacaccgtggagaagaacgacaagatcgagatcaacacgggggaccagacctcctacatcagcgagaaggacgaccgctgcaagacctggctgtgccgggtccgcgacgagggcatctccgtgatcttcgagcccctgaagaacctcttcgggaactacttcaacatcgccttctacatcatcatcggcctgatcgccctgttcctcaccatctacatcttcctgcccatgttcttcaagctgcgggacgtgctcaagcgcaacgagtacctgtacctgcaggagctcaagcacaagtga

SEQ ID NO: 12572 - RNA, 4311 nt, synthetic construct
  misc_feature 1..4311: note = derived and/or modified CDS sequence (opt1) from TENV(TSV-FL06)__FJ943506.1__GP
  source 1..4311: mol_type = other RNA
atggagatcttcttcatcgccctgctcgccatcgcgagctccgtgaacagcacgcccctggccacccgctgcttccacggcgggcagctgatcgccgagtccaagagcgccacgtccctcagcgagttctgcctgaaggacgacgtctccatgatcaagagcgagatctactacgtgaagaacgagaccggcatcttctcctacaacaaggtgctgcggagctggaccatcaaggactggaagttctgcaacccggtccccaccgccgggggctccatcaacgtgatcgaggtgaacagcgacatgtccctcgcgacgaagacctacgtctgcagccgcgactgcaccatcaccatcgaccgggaggaggcccagatcatcttccagacggagaagctgaaccacttcgaggtgtccgggaccaccctgagctccggctggttcaagagcaaggcctccgtgaccctcgaccgcacgtgcgagcacctgaaggtgacctgcggcaagaagtccctgcagttccacgcctgcttcaagcaccacatgagctgcatccggttcttccacaacaccatgctccccgggcgcatcgtcaactccatgtgccagaacatcgagctgatcatcatcctgggcctcaccatcgtgatcttcatcctgatggtcatcctgacgaagacctacatctgctacatcctcatgcccctgttcatgccggtggcgtacatctacgggtgggcctacaacaagagctgcaagaagtgcaactgctgcggcctggcctaccaccccttcaccaactgcgggtcccactgcgtgtgcggcctcaagttcgaggccagcgaccggatgcgcatccaccgggagtccggcctgtgccaggggtacaagagcctgcgcatcgcccggctcctgtgcaagtccaagggcagctccctggtcatcagcatcctcctgtccatgctgctcctgagcttcgtgacccccatcgagggggcgctgacgaactacccccagtccaagctctacagcctggaggagatcgccgacgtggtcgagggcctgatcaccgagcacaacgtgaaggagtacatcgtgttctacacctccctcttcggcgggctgatcctgctcctggccttcatcctgagcatcatgctcaccaaggtcacgtccatgctggcccgcaccaacgtgatctactgcgaggagtgcagcatgtaccactccaagaccggcatcaagtacaacggggacttcaccaacaagtgcggcttctgcacgtgcgacgagcaggaggacgccgaggggatcatcatccacaaggtgagcaagaagtgcacctacaagtaccagctgaagtgggcgcggatcatcatgatcatcctcatcgtcctgctgaccacccagaacacgatcctcatcgtggccgccgaggtcgactgctgggagcgcgccaccctgagccacgagtgcatcggcccgctgcagaagatcgaggactgccagaacaaggaggagaagacctacatgtccgaggccaacaagctggtgagccagtccaagatcacccaggcggacgccgaccaggtgagcgtcctcggcgacacgatcgactccgccatcaaggccatccggagccagaagacctaccagaccatgcacctcctggagaccgtgttcctgatgaagaactgcgactactactccaccttcgagcacaacagcgggtactcccaggccaagtggcgcctgatggcgaagacgaaccacttcgacatctgcagccggcactccaaccaccacttctgccgctgcgtgaccgagggcaccaagtgccagaacggggactgggacttcgccggcgagatgaacagcacctacaacacgaagtccgacttctaccagcacgacctgaacctcttcttcagcctgtacgagtccgccttccccgggaccgccgagagcctgttctaccagctcatctccgagaagaacaccaccggcgcgagccagctgctgggccagatcatcaagaagttcgccaacaacaacatgctcatcggggtctggaagttcggccagtacctgctgacgctcccctacgtgaacaccaccaagctgagcaagtcccgggaggagaccacgctgaccaaccaccagcgcctcgtgcggagctacaccgggcgccagcagtccatggccaacgccgaggtcggcgagagcaccaagaactgcctgaacgccaagaacgtggggtgcatcagcccccgcttcggcgtgccgatcggcaacctgacggtctgcggggagagcaccaactacaaggtgtacaagacccccgcgaagatctacaagtccaacaaccggcccaagacctggtgcagcgaggacgtgcactgcctctccaacttcgagcccgccagcgccgaggtcgtgaacaagatcaagcgcatgacgtgcttcctgaccgacgtgaccaccaacgtcgacgtgttctccatcgccatcagcacgtgcaagatggccgacaagggcgtgtgcaccgtcaacgacgcgcggtggtccatcctgaagtgcgacagcgggctcctgtacttcaccgaccaccgcgagggccaggacaccggcaacgacttcggggagtactgcatctcccacaactgcaacacggagcggtacccgatcaaccccgacatcatcaaggactgcatctgggagtactacagccgcaagtccaagtacatcagcgccatcaacctggagtccctcgaggagttccggcgcgccatgagcgagaagctgagccacaccctggtgatctacaacttcaagcccaccgccaacctcccccacatcaagccgtcctacaagagcatcaccgtgaacggcatcgagaactccgacgggatcgagagcgcctacatcctgtccaacatccccgcgatcggcgggatgagcgtcggctacaacgtgctgacgaaggacggcttccccctcctggacatcatcatcttcatcaagtccgccgtgatcaagaccacctacaaccacatctacgacaccgggcccacgatcggcatcaacaccctgcacgacgagaagtgcaccgggccgtgccccagcatcatcccccacaaggagaactggctcaccttctcccaggagcggaccagccgctggggctgcgaggagttcgggtgcctggccatcaacacgggctgcgtcttcggctcctgccaggacatcatccggcccgagaccaagatctaccgcaaggccgtggaggaggaggtgatcctgaacgcgtgcatcaacttcccggggaacacctactgcaccgagatcaacgccttcgagcccaagatcacggacgagatcgagctccagttcaagaccgtcgacaccaagaccctgcccaacctgctcgccgtgcagaaccacaagctgtacagcggccagatcaacgacatcgggacgttctcccagggctgcgggaacgtgcagaagaccaaccagaccatgctgggcaccggcacggtccggttcgactacgtgtgccacggggccagccgcaaggacatcatcgtgcggcgctgctacaacaacaactacgagtcctgcaagctcctgaaggaggagaagtccctgatcttcgccgacaaccacgagaccctcgaggtcgcgaacacccggcacctcctgggcgagctgcagttccgcatcatgctgggggacatccggtacaaggccttcgccgagaagccggagctggagatcgacgccaagtgcgtgggctgccccagctgcttcgagagctactcctgcaacttccagatcgtgagcaacgtcgacaccgtgtgctacatcgaggggccctgcaccctcttccacaaccgcgtgatcatcaagaccatgaagcaggcctacggcatcaagatgagctgcaagaccaagcccgcgccgtccgaggagttcaagatctgcggccgcacctacaacgtcgccttcaacacggtggagaagaacgacaagatcgagatcaacaccggggaccagaccagctacatctccgagaaggacgaccggtgcaagacctggctgtgccgcgtgcgggacgagggcatcagcgtcatcttcgagcccctgaagaacctcttcgggaactacttcaacatcgccttctacatcatcatcggcctgatcgccctgttcctcacgatctacatcttcctgcccatgttcttcaagctgcgcgacgtgctcaagcggaacgagtacctgtacctgcaggagctcaagcacaagtga

SEQ ID NO: 12573 - RNA, 4305 nt, synthetic construct
  misc_feature 1..4305: note = derived and/or modified CDS sequence (opt1) from TLAV(61D240)__KX100119.1__GP
  source 1..4305: mol_type = other RNA
atgctgttcctcctgatcctggccttcctcggcttcagcacctccaaccccatcgccacccgctgcttccacgggggccagctgatcgcggagagcaagtccgccacgagcatctccgagttctgcctgaaggacgacgtgagcatgctcaagtccgaggtcgtgtacaccaagaacgacaccgggctgttcggccacaacaaggtgttccggagctggaccatcaaggactggaagctgtgcaacccgatccccacggccgggggcaccatcaacgtcatcgaggtgaacaaggacctctccctgatgaccaagacctacatctgcagccgcgactgcacgatcaccatcgacaaggaggaggcccagatcatcttccagaccgacaagctgaaccacttcgaggtgtccggcaccacgctcaacagcgggtggttcaagtccaaggccagcgtcaccctggaccggacctgcgagcacgtgaaggtgacctgcggcaagaagtccctgcagttccacgcgtgcttcaagcaccacatgagctgcgtccgcttcttccacaacacgatcctccccgggaacatgatcacctccatgtgccagaacatcgagctgatcatcatcctgggcctcaccctggccatcttcatcctgatggtgatgctcaccaagacgtacatctgctacctgctgatgcccatcttcatgccgatcgcctacctctacgggtgggcctacaacaagagctgcaagaagtgcaactgctgcggcctggcgtaccaccccttcaccaactgcggctcccactgcgtgtgcgggctgaagttcgaggccagcgaccggatgcgcatccaccgggagagcggcctctgccaggggtacaagtccctgcgcatcgcccggctgctctgcaagagcaagggctccagcctggtcatctccggcctgctcagcatgctgatcctgtccttcgtgacccccatcgaggggaccatcacgagctaccccgagtcccgcaagtacaccctcgaggagatcaccgacgtggtcgagggcctggtgagcgagcagaacatcaaggagtacatcgtgttctacacctccctgttcgggagcctcatcctgctgctcgccttcatcatgtccatcacgctgagcaagatcacctccatcctggcccggcgcaacgtcatctactgcgaggagtgcagcatgtaccactccaagcggggcatcaagtacaacggggacttcaccaacaagtgcggcttctgcacgtgcaacgagcaggaggacgcggagggcctcgtgatccacaaggtgagcaagcgctgcacctacaagtaccagctgaagtgggccaaggtcctgatggtgaccctcgtgctgctgctgatcgcccagaacaccatcctcatcgtcgccgccgggaccgactgctggacgaagaagtccctggacatcgactgcatcggcccgatgctggacatcgggagctgcaccaacaagaacacccggaactacgacaccgaggcgcagaagctcgtgagccagtccaaggtcagccagctggacgccgaccaggcctccctgctcggcaacagcatcgactccgccatcaaggccatccgcgcgcagaagacctaccccacgatgcacctcctggagaccatcttcctcatgaagaactgcgactactacaccagcttcaaccacaactccgggtacagccaggccaagtggcggctgatcgccaagaccggccacttcgacatctgctcccgccacagcacgcaccacttctgccggtgcatcaacgacggcaccaagtgccagaacggggactgggacttcgccggcgagatgaacgagacctacaactccaagaacgacttctacagccacgacctgaacctcttctacaccatcttcgagaacgccttccccgggacgaccgagtccctgttctaccagctgatccagaagaagaacaccaccggcgcgagcaagatcctcgggaagctgatcacgaagtacggcaacaagaacatgttcgtgggcgtgtggaagttcgggcagtacctgctcaccctgccctacatcaacaacaccgagctgtcccagaaccgccggcagaccatcctcgccacgcaggagagcctgtcccgcagccacagcggccgccaggagtccatgagctccgccatccaggggagcgtcaccaaggagtgccacaacgccaaggacgtgggctgcatctccccgcggttcggcatccccatcgggaacctgaccgcgtgcggcgacagccccaactacaagatctacaagacccccgagaagctctacaagtccaacaacaagggggaggtgtggtgcagcaacgacgtccactgcctgaacgacttcgagccggccgacgaggaggtggtgaacaaggtcaagaagctgacgtgcttcctcaccgacgtgtccgtgaagaccgacatcttcagcgtcgccgcctccacgtgcaagatggccgacaagggcgtgtgcaccgtgaacgacgcgaagtggaacatcatcaagtgcgacagcgggctgtactacttcaccgaccaccgcgagggccaggacaccggcaacgacttcggggagtactgcatctcccacagctgcaacaccgagcggttccccatcaaccccgacatcctgaaggactgcacgtgggagttccactcccgcaagagcaagtacatctccaccatcagcctcgagtccctggaggagttccggcgcgccatgaccgagaagctgagccacaccctcacgatctacaacttcaagcccaccgccaacctgccgcacatccggcccacctacaagttcatcaccgccaacggcgtcgagaacagcgacgggatcgagtccgcctacatcctgagctccatccccgcgctcggcgggatcagcgtgggctacaacgtgcagacgaaggacaacttccccctgctggacatcatcgtcttcatcaagtccgccgtgatccgcaccacctacaaccacatctacgacaccggcccgaccatcgggatcaacacgcagcacgacgagcactgcaccggcccctgccccgccgtggtcccccacaaggagaactggatcaccttcagccaggagcggacctcccgctgggggtgcgaggagttcggctgcctcgccatcaacacggggtgcgtgttcggcagctgccaggacatcatccacccggagaccaaggtgtaccggaaggccgtcgaggaggaggtgatcctgaccgtgtgcatcaacttccccggcaacaactactgcaccgagatcaacgcgatcgagcccaagatcacggacgagatcgagctgcagttcaagaccgtcgacaccaagaccctcccgaacctgctggccgtgcagaaccacaagctctactccgggcagatcaacgacctgggcagcttctcccaggggtgcggcaacgtgcagaagacgaaccacagcatcctggggatgggcaccgccaagttcgactacgtctgccacggcgcctcccgcaaggacgtgatcgtgcggcgctgctacaacaacaacttcgacagctgcaagctcctgaaggaggagacctccctgatcttcgcggacaaccacgagaccctcgaggtcgcccacacgaagcacctgatcggggagctgcagttcaagatcatgctcggcgacatccggtacaagagcttcgccgagtcccccgagctggagatcgacgccaagtgcgtggggtgccccagctgcttcgagtcctacagctgcaacttccagatcgtgaccaacatcgacaccgtctgcagcgtggagggcccctgcaccctgttccacaaccgcatcatcatctccgccaacaagcagagctacggcctcaagatgtcctgccagacgaagccgaaccagaacgaggagttcatcatctgcaaccggaagtacagcgtgctgttcaccaccatcgacaagaacgacaagatcgaggtcaacaccggggaccagacgtcctacatctacgagaaggacagccgctgcaagacctggctgtgccgggtgcgcgacgagggcatctccgtgctgttcgagcccctgaaggcgttcttcgggagctacttctccatcatcttctacgtcgtggtgggcatcatcgtcctgttcctcatcatctacatcttcctgcccatgttcttcaagctgaaggacgtgctcaagcgcaacgagtacctgtacctgcaggagctcaagcacaagtga

SEQ ID NO: 12574 - RNA, 4305 nt, synthetic construct
  misc_feature 1..4305: note = derived and/or modified CDS sequence (opt1) from NRIV(9800535)__AY593725.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatgatcatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtgtgcggcctgaagttcgaggcgagcgaccggatgcgcatccaccgggagtccggcctgtgccaggggtacaagagcctccgcgtcgcccggctgctgtgcaagtccaagggcagctccctcgtgatcagcatcctgctgtccatgctcatcctgagcttcgtgacccccatcgaggggaccctgaccaactacccggagtcccgcaagtacgacctcgaggagatcgccgacgtcctggagggcttcatcgtggagaagggcatcaaggagtacgtggtcttctacacgagcatcttcggggccctgctcctgctgatcgccctcgtgatcaccatcaccctgaacaaggtgaccgagtacctgacgaacatcaacgtcctctactgctacgagtgctccatgtaccacagcaagaagaacatcaagtacatcggcgacttcaccaacaagtgcgggttctgcacgtgcggcgagctggaggaccaggaggggctgaagatccacaaggtgtcccggaagtgcatctacaagtaccagctcacctggagcaagatcatcatgaccatcctggtctgcctgctgatcgcgcagaacaccatcctcatcgtggccgcctccgacgactgctggaccaagaagtccctggagatggagtgcatcggccccctgcagcaggtcgacacgtgcgacgacaaggccagccgcagctactccggcgaggcccggaagctcgtgcgcgcgagcaagatcagcgacctggacgccgcccaggtggggctgctcggctccaccatcgagagcgccatcgcctccatccggaagcagcgcacctaccccaccatgcacctcctggagagcgtgttcctcgggaagcactgcgactactacaagaccttcgagcacaactccggctacagccaggcgaagtggcggctgaccgccaagacgcaccacttcgacatctgctcccgccacagcacccaccacttctgccggtgcatctccgacgggaccaagtgccagaacggcgacctggacttcgccggcgagatgaacagcacctaccagtccaagaaggacttcttcgagcacgacttcaagctgttctgcacgctggtcgagaacgccttccccgggaccaccgagagcctgttctacgagatgctctccaagaagaacaccacgggcatcaagcagctgctggacaagctcacccgcaagttcgggaacaacaacatgttcgtgggcatctggaagttcgggcagtacctgatgagcctgccgtacatcaacgagacctccctcacccccgcccagatcagcaagatcctggaggtgacggaccagcaccaccggtccatcagcggccgccaggagagcctggcgtccgccacccccggcagcaagtccaaggagtgcgggcacgccaagaaggtcagctgcatcagcccccgcttcagcgtgccgatggagggcctcatggcctgcggggactcccccaactacaagatctacaagacccccaccaagctgtacaagagcaacaacaagggcgaggtgtggtgctccggcgacgtccactgcagccaggagctgtcccccgcgagccaggagtccgtggaccggatcaagcagatcacgtgcttcctcaccgagccggaggtgagcgacgacgtcttctccatcgccatcagcacgtgcaaggtgcaggacaagggggtgtgcaccgtcaacgaggaccgctggaacgtgatcaagtgcgactccggcctgatctactacaccgaccagcgggacgggcaggacaccggcaacgacttcggggagtactgcctgagccactcctgccgcatcgagcggttccccatcaaccccgccatcatccgcgactgcctctgggagtaccacagccgcaagagcaagtacatcacctccctggacctggagaacctcgaggagttcaagcgggccatcagcgagaagctgtcccacaccctgatcgtgtacaacttcaagcccacggccaacctcccgcacatcaagcccgtctacaagtacatcaccgtgcagggcgtggagaacagcgacggcgtcgactccgcgtacatcgccgccagcatgcccgccctgtccgggaccagcatcggctacaacatcatgtcccgggacaacttccccctgttcgacatcatcatcttcatcaagagcgccatcatcaaggcgacctacaaccacatctacgacacggggccgaccatcggcatcaacgtgatgcacgacgagcactgcaccgggcagtgccccaccgacatcccccacaaggagaactggatcacgttcgcccaggagcgcacctcccggtggggctgcgaggagttcggctgcctcgccgtgaacaccgggtgcgtcttcggcagctgccaggacatcatccgcccggagaccaaggtgtaccggaaggccgtggaggagtccgtcctgctgaccgtgtgcatcacgtaccccgggaagaccttctgcaccgagatcaacgccatcgagcccaagatcaccgacgagctcgagctgcagttcaagacggtggacaccaagaccctgcccaacatcctcgcggtccagaaccacaagctgtacagcggccagatcaacgacctggggtccttcagccagggctgcggcaacatccagcgcaccaactccagcatcatcgggacgggcaccgccaagttcgactacgtgtgccacggggcctcccggaaggacatcatcgtgcgccggtgctacaacaacaactacgagagctgcaagctcctgaaggaggagcagagcctgatgttcgccgacaaccacgagaccatcgacgtcgcgaacgtgcgccacctcctgggcgacctgcagttcaagctcatgctgggggacctgcggtacaagtccttcgccgagaacccggacctcgagatcgaggccaagtgcgtgggctgccccagctgcttcacctcctacagctgctccttcaagatcgccagcaacatcgacacggtctgctccatcgagggcccctgcaccaccttccacaaccgcctgatgatcaccagcacgaagcaggactacgggatcaagatgtcctgcaagaccaagcccaaggagaccgaggagttccagatctgcaagaagacctacacggtgctgttcaccaccgtggagaagaacgacaagatcgagatcagcaccggcgaccagacgtccttcatccaggagcgcgacgaccggtgcaagacctggctctgccgcgtccgggacgaggggatcagcgtgatcttcgagccgatccgcgccttcttcggctcctacttcagcatcgcgttctacgtggtcatctccatcatcgtgctgttcctggccatctacatcttcctccccatggtgttcaagctgcgggacgtcctgaagcgcaacgagtacctctacctgcaggagatcaagcacaagtga

SEQ ID NO: 12575 - RNA, 4305 nt, synthetic construct
  misc_feature 1..4305: note = derived and/or modified CDS sequence (opt1) from NRIV(GSA/TS7/5170/WT)__KM514677.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagcggaacaacaccggcctgttcgcccacagcaaggtgctgcgcaactggatcatcaaggactggaagaactgcaaccccgtccccaccgccgggggctccatcaacgtgatcgaggtgaacacggacctcagcctgaccaccaagacctacgtctgctcccgggactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccgcatgcggatccaccgcgagtccggcctgtgccaggggtacaagagcctccgggtggcccgcctgctgtgcaagtccaagggcagctccctcgtgatcagcatcctgctgtccatgctcatcctgagcttcgtcacccccatcgaggggaccctgaccaactacccggagtcccggaagtacgacctcgaggagatcgccgacgtgctggagggcttcatcgtggagaagggcatcaaggagtacgtcgtgttctacacgagcatcttcggggccctgctcctgctgatggccctcgtgatcaccatcaccctgaacaaggtcaccgagtacctgacgaacatcaacgtgctctactgccacgagtgctccatgtaccacagcaagaagaacatcaagtacatcggcgacttcaccaacaagtgcgggttctgcacgtgcggcgagctggaggaccaggaggggctgaagatccacaaggtctcccgcaagtgcatctaccggtaccagctcacctggagcaagatcatcatgaccatcctggtgtgcctgctgatcgcgcagaacaccatcctcatcgtggccgcctccgacgactgctggaccaagaagtccctggagatggagtgcatcggccccctgcagcaggtcgacacgtgcgacgacaaggccagccgcagctactccggcgaggccaagaagctcgtgcgggcgagcaagatcagcgacctggacgccgcccaggtggggctgctcggctccaccatcgagagcgccatcgcctccatccgcaagcagcggacctaccccaccatgcacctcctggagagcgtcttcctcgggaagcactgcgactactacaagaccttcgagcacaactccggctacagccaggcgaagtggcgcctgaccgccaagacgcaccacttcgacatctgctcccggcacagcacccaccacttctgccgctgcatctccgacgggaccaagtgccagaacggcgactgggacttcgccagcgagatgaactccacctaccagagcaagaaggacttcttcgagcacgacttcaagctgttctgcacgctcgtggagaacgccttccccggcaccaccgagtccctgttctacgagatgctgagcaagaagaacaccacggggatcaagaacctcctggacaagctgacccggaagttcggcaacaacaacatgttcgtggggatctggaagttcggccagtacctcatctccctgccgtacgtcaacgagaccagcctgacccccgcccaggtgtccaagatcctcgaggtgacggaccagcaccaccgcagcatcagcgggcgccaggagtccctggcgagcgccacctccggcagcaagtccaaggagtgcggccacgccaagaaggtcagctgcatcagcccccggttcagcgtgcccatggaggggctgatggcctgcggcgactccccgaactacaagatctacaagacccccgcgaagctctacaagagcaacaacaagggggaggtgtggtgctccggcgacgtccactgcagccaggagctgtcccccgccagccaggagtccgtggaccgcatcaagcagatcacgtgcttcctgaccgagcccgaggtgagcgacgacgtcttctccatcgccatcagcacgtgcaaggtgcaggacaagggcgtgtgcaccgtcaacgaggaccggtggaacgtgatcaagtgcgactccgggctcatctactacaccgaccagcgcgacggccaggacaccgggaacgacttcggcgagtactgcctgagccacagctgccggatcgagcgcttcccgatcaaccccaccatcatctccgactgcctgtgggagtaccacagccggaagtccaagtacatcaccagcctcgacctggagaacctggaggagttcaagcgcgccatctccgagaagctcagccacaccctgatcgtgtacaacttcaagcccacggccaacctgccccacatcaagccggtctacaagtacatcaccgtgcagggggtggagaactccgacggcgtcgacagcgcgtacatctccgccagcatgcccgccctctccggcaccagcatcgggtacaacatcatgtcccgggacaacttccccctgttcgacatcatcatcttcatcaagagcgccatcatcaaggccacctacaaccacatctacgacacgggccccaccatcgggatcaacgtgatgcacgacgagcactgcaccggccagtgcccgaccgacatcccccacaaggagaactggatcacgttcgcgcaggagcgcacctcccggtgggggtgcgaggagttcggctgcctggccgtgaacaccggctgcgtcttcgggagctgccaggacatcatccgccccgagaccaaggtgtaccggaaggccgtggaggagtccgtcctcctgaccgtgtgcatcacgtacccgggcaagaccttctgcaccgagatcaacgccatcgagcccaagatcaccgacgagctggagctccagttcaagacggtggacaccaagaccctgcccaacatcctggccgtccagaaccacaagctctacagcgggcagatcaacgacctgggctccttcagccaggggtgcggcaacatccagaagaccaacagctccatcatcggcacggggaccgcgaagttcgactacgtgtgccacggcgccagccgcaaggacatcatcgtgcggcgctgctacaacaacaactacgagtcctgcaagctgctcaaggaggagcagagcctgatgttcgccgacaaccacgagaccatcgacgtcgccaacgtgcggcacctcctgggggacctgcagttcaagctgatgctcggcgacctgcgctacaagtccttcgcggagaaccccgacctggagatcgaggccaagtgcgtggggtgcccgagctgcttcacctcctacagctgctccttcaagatcgccagcaacatcgacacggtctgctccatcgagggcccctgcaccaccttccacaaccggctcatgatcaccagcacgaagcaggactacggcatcaagatgtcctgcaagaccaagcccaaggagaccgaggagttccagatctgcaagaagacctacacggtgctgttcaccaccgtggagaagaacgacaagatcgagatcagcaccggggaccagacgtccttcatccaggagcgcgacgaccgctgcaagacctggctgtgccgggtccgcgacgagggcatcagcgtgatcttcgagcccatccgggccttcttcgggtcctacttcagcatcgccttctacgtggtcgtgatcatcatcgtgctgttcctggcgatctacatcttcctgccgatggtcttcaagctccgcgacgtgctgaagcggaacgagtacctgtacctccaggagatcaagcacaagtga

SEQ ID NO: 12576 - RNA, 4305 nt, synthetic construct
  misc_feature 1..4305: note = derived and/or modified CDS sequence (opt1) from NRIV(TND/S1/19801/WT)__KM514679.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagcggaacaacaccggcctgttcgcccacagcaaggtgctgcgcaactggatcatcaaggactggaagaactgcaaccccgtccccaccgccgggggctccatcaacgtgatcgaggtgaacacggacctcagcctgaccaccaagacctacgtctgctcccgggactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccgcatgcggatccaccgcgagtccggcctgtgccaggggtacaagagcctccgggtggcccgcctgctgtgcaagtccaagggcagctccctcgtgatcagcatcctgctgtccatgctcatcctgagcttcgtcacccccatcgaggggaccctgaccaactacccggagtcccggaagtacgacctcgaggagatcgccgacgtgctggagggcttcatcgtggagaagggcatcaaggagtacgtcgtgttctacacgagcatcttcggggccctgctcctgctgatggccctcgtgatcaccatcaccctgaacaaggtcaccgagtacctgacgaacatcaacgtgctctactgccacgagtgctccatgtaccacagcaagaagaacatcaagtacatcggcgacttcaccaacaagtgcgggttctgcacgtgcggcgagctggaggaccaggaggggctgaagatccacaaggtctcccgcaagtgcatctaccggtaccagctcacctggagcaagatcatcatgaccatcctggtgtgcctgctgatcgcgcagaacaccatcctcatcgtggccgcctccgacgactgctggaccaagaagtccctggagatggagtgcatcggccccctgcagcaggtcgacacgtgcgacgacaaggccagccgcagctactccggcgaggccaagaagctcgtgcgggcgagcaagatcagcgacctggacgccgcccaggtggggctgctcggctccaccatcgagagcgccatcgcctccatccgcaagcagcggacctaccccaccatgcacctcctggagagcgtcttcctcgggaagcactgcgactactacaagaccttcgagcacaactccggctacagccaggcgaagtggcgcctgaccgccaagacgcaccacttcgacatctgctcccggcacagcacccaccacttctgccgctgcatctccgacgggaccaagtgccagaacggcgactgggacttcgccagcgagatgaactccacctaccagagcaagaaggacttcttcgagcacgacttcaagctgttctgcacgctcgtggagaacgccttccccggcaccaccgagtccctgttctacgagatgctgagcaagaagaacaccacggggatcaagaacctcctggacaagctgacccggaagttcggcaacaacaacatgttcgtggggatctggaagttcggccagtacctcatctccctgccgtacgtcaacgagaccagcctgacccccgcccaggtgtccaagatcctcgaggtgacggaccagcaccaccgcagcatcagcgggcgccaggagtccctggcgagcgccacctccggcagcaagtccaaggagtgcggccacgccaagaaggtcagctgcatcagcccccggttcagcgtgcccatggaggggctgatggcctgcggcgactccccgaactacaagatctacaagacccccgcgaagctctacaagagcaacaacaagggggaggtgtggtgctccggcgacgtccactgcagccaggagctgtcccccgccagccaggagtccgtggaccgcatcaagcagatcacgtgcttcctgaccgagcccgaggtgagcgacgacgtcttctccatcgccatcagcacgtgcaaggtgcaggacaagggcgtgtgcaccgtcaacgaggaccggtggaacgtgatcaagtgcgactccgggctcatctactacaccgaccagcgcgacggccaggacaccgccaacgacttcggggagtactgcctgagccacagctgccggatcgagcgcttcccgatcaaccccaccatcatctccgactgcctgtgggagtaccacagccggaagtccaagtacatcaccagcctcgacctggagaacctggaggagttcaagcgcgccatctccgagaagctcagccacaccctgatcgtgtacaacttcaagcccacggcgaacctgccccacatcaagccggtctacaagtacatcaccgtgcagggcgtggagaactccgacggggtcgacagcgcctacatctccgccagcatgcccgccctctccggcaccagcatcggctacaacatcatgtcccgggacaacttccccctgttcgacatcatcatcttcatcaagagcgccatcatcaaggcgacctacaaccacatctacgacacggggcccaccatcggcatcaacgtgatgcacgacgagcactgcaccgggcagtgcccgaccgacatcccccacaaggagaactggatcacgttcgcccaggagcgcacctcccggtggggctgcgaggagttcgggtgcctggccgtgaacaccggctgcgtcttcggcagctgccaggacatcatccgccccgagaccaaggtgtaccggaaggccgtggaggagtccgtcctcctgaccgtgtgcatcacgtacccggggaagaccttctgcaccgagatcaacgccatcgagcccaagatcaccgacgagctggagctccagttcaagacggtggacaccaagaccctgcccaacatcctggcggtccagaaccacaagctctacagcggccagatcaacgacctggggtccttcagccagggctgcgggaacatccagaagaccaacagctccatcatcggcacgggcaccgccaagttcgactacgtgtgccacggggccagccgcaaggacatcatcgtgcggcgctgctacaacaacaactacgagtcctgcaagctgctcaaggaggagcagagcctgatgttcgccgacaaccacgagaccatcgacgtcgcgaacgtgcggcacctcctgggcgacctgcagttcaagctgatgctcggggacctgcgctacaagtccttcgccgagaaccccgacctggagatcgaggccaagtgcgtgggctgcccgagctgcttcacctcctacagctgctccttcaagatcgccagcaacatcgacacggtctgctccatcgaggggccctgcaccaccttccacaaccggctcatgatcaccagcacgaagcaggactacggcatcaagatgtcctgcaagaccaagcccaaggagaccgaggagttccagatctgcaagaagacctacacggtgctgttcaccaccgtggagaagaacgacaagatcgagatcagcaccggcgaccagacgtccttcatccaggagcgcgacgaccgctgcaagacctggctgtgccgggtccgcgacgaggggatcagcgtgatcttcgagcccatccgggccttcttcggctcctacttcagcatcgcgttctacgtggtcgtgatcatcatcgtgctgttcctggccatctacatcttcctgccgatggtcttcaagctccgcgacgtgctgaagcggaacgagtacctgtacctccaggagatcaagcacaagtga

SEQ ID NO: 12577 - RNA, 4305 nt, synthetic construct
  misc_feature 1..4305: note = derived and/or modified CDS sequence (opt1) from NRIV(9800521)__JX857326.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatgatcatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtgtgcggcctgaagttcgaggcgagcgaccggatgcgcatccaccgggagtccggcctgtgccaggggtacaagagcctccgcgtcgcccggctgctgtgcaagtccaagggcagctccctcgtgatcagcatcctgctgtccatgctcatcctgagcttcgtgacccccatcgaggggaccctgaccaactacccggagtcccgcaagtacgacctcgaggagatcgccgacgtcctggagggcttcatcgtggagaagggcatcaaggagtacgtggtcttctacacgagcatcttcggggccctgctcctgctgatggccctcgtgatcaccatcaccctgaacaaggtgaccgagtacctgacgaacatcaacgtcctctactgccacgagtgctccatgtaccacagcaagaagaacatcaagtacatcggcgacttcaccaacaagtgcgggttctgcacgtgcggcgagctggaggaccaggaggggctgaagatccacaaggtgtcccggaagtgcatctacaagtaccagctcacctggagcaagatcatcatgaccatcctggtctgcctgctgatcgcgcagaacaccatcctcatcgtggccgcctccgacgactgctggaccaagaagtccctggagatggagtgcatcggccccctgcagcaggtcgacacgtgcgacgacaaggccagccgcagctactccggcgaggcccggaagctcgtgcgcgcgagcaagatcagcgacctggacgccgcccaggtggggctgctcggctccaccatcgagagcgccatcgcctccatccggaagcagcgcacctaccccaccatgcacctcctggagagcgtgttcctcgggaagcactgcgactactacaagaccttcgagcacaactccggctacagccaggcgaagtggcggctgaccgccaagacgcaccacttcgacatctgctcccgccacagcacccaccacttctgccggtgcatctccgacgggaccaagtgccagaacggcgactgggacttcgccggcgagatgaacagcacctaccagtccaagaaggacttcttcgagcacgacttcaagctgttctgcacgctcgtcgagaacgccttccccgggaccaccgagagcctgttctacgagatgctgtccaagaagaacaccacgggcatcaagcagctcctggacaagctgacccgcaagttcgggaacaacaacatgttcgtgggcatctggaagttcgggcagtacctcatgagcctgccgtacgtgaacgaggcctccctgacccccgcgcagatcagcaagatcctcgaggtcaccgaccagcaccaccggtccatcagcggccgccaggagagcctggcctccgccacgcccggcagcaagtccaaggagtgcgggcacgccaagaaggtgagctgcatcagcccccgcttcagcgtgccgatggagggcctgatggcgtgcggggactcccccaactacaagatctacaagacccccaccaagctctacaagagcaacaacaagggcgaggtctggtgctccggcgacgtgcactgcagccaggagctgtcccccgccagccaggagtccgtggaccggatcaagcagatcacgtgcttcctgaccgagccggaggtcagcgacgacgtgttctccatcgccatcagcacgtgcaaggtgcaggacaagggggtctgcaccgtgaacgaggaccgctggaacgtgatcaagtgcgactccggcctcatctactacaccgaccagcgggacgggcaggacaccggcaacgacttcggggagtactgcctgagccactcctgccgcatcgagcggttccccatcaaccccgccatcatccgcgactgcctgtgggagtaccacagccgcaagagcaagtacatcacctccctcgacctggagaacctggaggagttcaagcgggccatcagcgagaagctctcccacaccctgatcgtctacaacttcaagcccaccgcgaacctgccgcacatcaagcccgtgtacaagtacatcacggtgcagggcgtcgagaacagcgacggcgtggactccgcctacatcgccgccagcatgcccgccctctccgggaccagcatcggctacaacatcatgtcccgggacaacttccccctgttcgacatcatcatcttcatcaagagcgcgatcatcaaggccacctacaaccacatctacgacaccgggccgacgatcggcatcaacgtgatgcacgacgagcactgcaccgggcagtgccccaccgacatcccccacaaggagaactggatcaccttcgcccaggagcgcacgtcccggtggggctgcgaggagttcggctgcctggccgtcaacaccgggtgcgtgttcggcagctgccaggacatcatccgcccggagaccaaggtgtaccggaaggccgtcgaggagtccgtgctcctgaccgtgtgcatcacctaccccgggaagacgttctgcaccgagatcaacgcgatcgagcccaagatcaccgacgagctggagctccagttcaagaccgtcgacacgaagaccctgcccaacatcctggccgtgcagaaccacaagctctacagcggccagatcaacgacctggggtccttcagccagggctgcggcaacatccagcgcaccaactccagcatcatcgggaccggcacggccaagttcgactacgtgtgccacggggcctcccggaaggacatcatcgtccgccggtgctacaacaacaactacgagagctgcaagctgctcaaggaggagcagagcctgatgttcgcggacaaccacgagaccatcgacgtggccaacgtgcgccacctcctgggcgacctgcagttcaagctgatgctcggggacctgcggtacaagtccttcgccgagaacccggacctggagatcgaggccaagtgcgtcggctgccccagctgcttcacctcctacagctgctccttcaagatcgccaccaacatcgacacggtgtgcagcatcgagggcccctgcaccaccttccacaaccgcctcatgatcacctccacgaagcaggactacgggatcaagatgagctgcaagaccaagcccaaggagaccgaggagttccagatctgcaagaagacctacacggtgctgttcaccaccgtcgagaagaacgacaagatcgagatctccaccggcgaccagacgagcttcatccaggagcgcgacgaccggtgcaagacctggctgtgccgcgtgcgggacgaggggatctccgtgatcttcgagccgatccgcgcgttcttcggcagctacttctccatcgccttctacgtcgtgatcagcatcatcgtgctgttcctggccatctacatcttcctgcccatggtcttcaagctccgggacgtgctgaagcgcaacgagtacctgtacctccaggagatcaagcacaagtga

SEQ ID NO: 12578 - RNA, 4305 nt, synthetic construct
  misc_feature 1..4305: note = derived and/or modified CDS sequence (opt1) from NRIV(Adrar)__KJ716849.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccggatgcgcatccaccgggagtccggcctgtgccaggggtacaagagcctccgcgtggcccggctgctgtgcaagtccaagggcagctccctcgtgatcagcatcctgctgtccatgctcatcctgagcttcgtcacccccatcgaggggaccctgaccaactacccggagtcccgcaagtacgacctcgaggagatcgccgacgtgctggagggcttcatcgtggagaagggcatcaaggagtacgtcgtgttctacacgagcatcttcggggccctgctcctgctgatggccctcgtgatcaccatcaccctgaacaaggtcaccgagtacctgacgaacatcaacgtgctctactgccacgagtgctccatgtaccacagcaagaagaacatcaagtacatcggcgacttcaccaacaagtgcgggttctgcacgtgcggcgagctggaggaccaggaggggctgaagatccacaaggtctcccggaagtgcatctacaagtaccagctcacctggagcaagatcatcatgaccatcctggtgtgcctgctgatcgcgcagaacaccatcctcatcgtggccgcctccgacgactgctggaccaagaagtccctggagatggagtgcatcggccccctgcagcaggtcgacacgtgcgacgacaaggccagccgcagctactccggcgaggccaagaagctcgtgcgggcgagcaagatcagcgacctggacgccgcccaggtggggctgctcggctccaccatcgagagcgccatcgcctccatccgcaagcagcggacctaccccaccatgcacctcctggagagcgtcttcctggggaagcactgcgactactacaagaccttcgagcacaactccggctacagccaggcgaagtggcgcctgaccgccaagacgcaccacttcgacatctgctcccggcacagcacccaccacttctgccgctgcatctccgacgggaccaagtgccagaacggcgactgggacttcgccggcgagatgaacagcacctaccagtccaagaaggacttcttcgagcacgacttcaagctgttctgcacgctcgtggagaacgccttccccgggaccaccgagagcctgttctacgagatgctgtccaagaagaacaccacgggcatcaagaagctcctggacaagctgacccggaagttcgggaacaacaacatgttcgtgggcatctggaagttcgggcagtacctcatcagcctgccgtacgtcaacgagacctccctgacccccgcccaggtgagcaagatcctcgaggtgacggaccagcaccaccgctccatcagcggccggcaggagagcctggcgtccgccacccccggcagcaagtccaaggagtgcgggcacgccaagaaggtcagctgcatcagcccccgcttcagcgtgccgatggagggcctgatggcctgcggggactcccccaactacaagatctacaagacccccgcgaagctctacaagagcaacaacaagggcgaggtgtggtgctccggcgacgtccactgcagccaggagctgtcccccgccagccaggagtccgtggaccgcatcaagcagatcacgtgcttcctgaccgagccggaggtgagcgacgacgtcttctccatcgccatcagcacgtgcaaggtgcaggacaagggggtgtgcaccgtcaacgaggaccggtggaacgtgatcaagtgcgactccggcctcatctactacaccgaccagcgcgaggggcaggacaccggcaacgacttcggggagtactgcctgagccactcctgccggatcgagcgcttccccatcaaccccgccatcatcagcgactgcctgtgggagtaccacagccggaagtccaagtacatcaccagcctcgacctggagaacctggaggagttcaagcgcgccatctccgagaagctcagccacaccctgatcgtgtacaacttcaagcccaccgcgaacctgccgcacatcaagcccatctacaagtacatcacggtccagggcgtggagaactccgacggcgtggacagcgcctacatcgccgcctccatgcccgccctcagcgggacctccatcggctacaacatcatgagccgggacaacttccccctgttcgacatcatcatcttcatcaagtccgcgatcatcaaggccacctacaaccacatctacgacaccgggccgacgatcggcatcaacgtcatgcacgacgagcactgcaccgggcagtgccccaccgacatcccccacaaggagaactggatcaccttcgcccaggagcgcacgagccggtggggctgcgaggagttcggctgcctggccgtgaacaccgggtgcgtgttcggctcctgccaggacatcatccgcagcgagaccaaggtctaccggaaggccgtggaggagtccgtgctcctgaccgtctgcatcacctacccggggaagacgttctgcaccgagatcaacgcgatcgagcccaagatcaccgacgagctggagctccagttcaagaccgtggacacgaagaccctgcccaacatcctggccgtgcagaaccacaagctctacagcggccagatcaacgacctggggtccttcagccagggctgcggcaacatccagaagaccaacctgtccatcatcgggaccggcacggccaagttcgactacgtctgccacggggccagccgcaaggacatcatcgtgcggcgctgctacaacaacaactacgagagctgcaagctcctgaaggaggagcagtccctgatgttcgcggacaaccacgagaccatcgacgtggccaacgtccggcacctcctgggcgacctgcagttcaagctcatgctgggggacctgcgctacaagagcttcgccgagaaccccgacctcgagatcgaggccaagtgcgtgggctgcccgtcctgcttcaccagctactcctgcagcttcaagatcgcctccaacatcgacaccgtgtgcagcatcgagggcccctgcacgaccttccacaaccggctgatgatcacctccaccaagcaggactacgggatcaagatgagctgcaagacgaagcccaaggagaccgaggagttccagatctgcaagaagacctacaccgtcctgttcacgaccgtggagaagaacgacaagatcgagatctccaccggcgaccagaccagcttcatccaggagaaggacgaccgctgcaagacgtggctctgccgggtgcgcgacgaggggatctccgtcatcttcgagcccatccgcgcgttcttcggcagctacttctccatcgccttctacgtggtgatcagcatcatcgtcctgttcctggccatctacatcttcctcccgatggtgttcaagctgcgggacgtgctgaagcgcaacgagtacctctacctgcaggagatcaagcacaagtga

SEQ ID NO: 12579 - RNA, 4305 nt, synthetic construct
  misc_feature 1..4305: note = derived and/or modified CDS sequence (opt1) from NRIV(DakArD28542)__JX857317.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccggatgcgcatccaccgggagtccggcctgtgccaggggtacaagagcctccgcgtggcccggctgctgtgcaagtccaagggcagctccctcatcatcagcatcctgctgtccatgctcatcctgagcttcgtgacccccatcgaggggaccctgaccaactacccggagtcccgcaagtacgacctcgaggagatcgccgacgtcctggagggcttcatcgtggagaagggcatcaaggagtacgtggtcttctacacgagcatcttcggggccctgttcctcctgatggccctggtgatcaccatcaccctcaacaaggtgaccgagtacctgacgaacatcaacgtcctgtactgccacgagtgctccatgtaccacagcaagaagaacatcaagtacatcggcgacttcaccaacaagtgcgggttctgcacgtgcggcgagctcgaggaccaggaggggctgaagatccacaaggtgtcccggaagtgcatctacaagtaccagctgacctggagcaagatcatcatgaccatcctcgtctgcctgctgatcgcgcagaacaccatcctgatcgtggccgcctccgacgactgctggaccaagaagtccctcgagatggagtgcatcggccccctgcagcaggtcgacacgtgcgacgacaaggccagccgcagctactccggcgaggccaagaagctggtgcgggcgagcaagatcagcgacctcgacgccgcccaggtggggctgctgggccccaccatcgagtccgccatcgccagcatccgcaagcagcggacctactccaccatgcacctcctggagagcgtgttcctggggaagcactgcgactactacaagaccttcgagcacaactccggctacagccaggcgaagtggcgcctcaccgccaagacgcaccacttcgacatctgctcccggcacagcacccaccacttctgccgctgcatctccgacgggaccaagtgccagaacggcgactgggacttcgccggcgagatgaacagcacctaccagtccaagaaggacttcttcgagcacgacctgaagctgttctgcacgctcgtcgagaacgccttccccgggaccaccgagagcctgttctacgagatgctgtccaagaagaacaccacgggcgtgaagaagctcctggacaagctgacccggaagttcgggaacaacaacatgttcgtgggcatctggaagttcgggcagtacctcatgagcctgccgtacgtcaacgagacctccctgacccccgcccaggtggcgaagatcctcgaggtgacggaccagcaccaccgcagcatctccggccggcaggagagcctggccagcgccacccccggctccaagagcaaggagtgctcccacgccaagaaggtcagctgcatcagcccccgcttcagcgtgccgatggaggggctgatggcgtgcggcgactcccccaactacaagatctacaagacccccgccaagctctacaagagcaacaacaagggggaggtgtggtgctccggcgacgtccactgcagccaggagctgtcccccgccagccaggagtccgtggaccgcatcaagcagatcacgtgcttcctgaccgagccggaggtgagcgacgacgtcttctccatcgccatcagcacgtgcaaggtgcaggacaagggcgtgtgcaccgtcaacgaggaccggtggaacgtgatcaagtgcgactccgggctcatctactacaccgaccagcgcgacggccaggacaccgggaacgacttcggcgagtactgcctgagccactcctgccggatcgagcgcttccccatcaaccccgccatcatcagcgactgcctgtgggagtaccacagccggaagtccaagtacatcaccagcctcgacctggagaacctggaggagttcaagcgcgcgatctccgagaagctcagccacaccctgatcgtgtacaacttcaagcccaccgccaacctgccgcacatcaagcccgtctacaagtacatcacggtgcagggggtggagaactccgacggcgtcgacagcgcctacatcgccgcctccatgcccgcgctcagcggcacctccatcgggtacaacatcatgagccgggacaacttccccctgttcgacatcatcatcttcatcaagtccgccatcatcaaggccacctacaaccacatctacgacaccggcccgacgatcgggatcaacgtgatgcacgacgagcactgcaccggccagtgccccaccgacatcccccacaaggagaactggatcaccttcgcccaggagcgcacgagccggtgggggtgcgaggagttcggctgcctggccgtgaacaccggctgcgtcttcgggtcctgccaggacatcatccgcccggagaccaaggtgtaccggaaggcggtggaggagagcgtcctcctgaccgtgtgcatcacctaccccggcaagacgttctgcaccgagatcaacgccatcgagcccaagatcaccgacgagctggagctccagttcaagaccgtggacacgaagaccctgcccaacatcctggccgtccagaaccacaagctctactccgggcagatcaacgacctgggcagcttctcccaggggtgcggcaacatccagaagaccaacagctccatcatcggcaccgggacggccaagttcgactacgtgtgccacggcgcgagccgcaaggacatcatcgtgcggcgctgctacaacaacaactacgagagctgcaagctgctcaaggaggagcagtccctgatgttcgccgacaaccacgagaccatcgacgtcgccaacgtgcggcacctcctcggggacctgcagttcaagctgatgctcggcgacctgcgctacaagagcttcgccgagaacccggacctggagatcgaggccaagtgcgtggggtgcccctcctgcttcaccagctactcctgcagcttcaagatcgcgtccaacatcgacaccgtctgcagcatcgagggcccctgcacgaccttccacaaccggctcatgatcacctccaccaagcaggactacggcatcaagatgagctgcaagacgaagcccaaggagaccgaggagttccagatctgcaagaagacctacaccgtgctgttcacgaccgtggagaagaacgacaagatcgagatctccaccggggaccagaccagcttcatccaggagcgcgacgaccggtgcaagacgtggctgtgccgcgtccgcgacgagggcatctccgtgatcttcgagccgatccgggccttcttcgggagctacttctccatcgccttctacgtggtcgtgagcatcatcgtgctgttcctggccatctacatcttcctgcccatggtcttcaagctccgcgacgtgctgaagcggaacgagtacctgtacctccaggagatcaagcacaagtga

SEQ ID NO: 12580 - RNA, 4305 nt, synthetic construct
  misc_feature 1..4305: note = derived and/or modified CDS sequence (opt1) from NRIV(SUD-HKV141)__JX857323.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtcagcgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccggatgcgcatccaccgggagtccggcctgtgccaggggtacaagagcctccgcgtggcccggctgctgtgcaagtccaagggcagctccctcatcatcagcatcctgctgtccatgctcatcctgagcttcgtgacccccatcgaggggaccctgaccaactacccggagtcccgcaagtacgacctcgaggagatcgccgacgtcctggagggcttcatcgtggagaagggcatcaaggagtacgtggtcttctacacgagcatcttcggggccctgttcctcctgatggccctggtgatcaccatcaccctcaacaaggtgaccgagtacctgacgaacatcaacgtcctgtactgccacgagtgctccatgtaccacagcaagaagaacatcaagtacatcggcgacttcaccaacaagtgcgggttctgcacgtgcggcgagctcgaggaccaggaggggctgaagatccacaaggtgtcccggaagtgcatctacaagtaccagctgacctggagcaagatcatcatgaccatcctcgtctgcctgctgatcgcgcagaacaccatcctgatcgtggccgcctccgacgactgctggaccaagaagtccctcgagatggagtgcatcggccccctgcagcaggtcgacacgtgcgacgacaaggccagccgcagctactccggcgaggccaagaagctggtgcgggcgagcaagatcagcgacctcgacgccgcccaggtggggctgctgggccccaccatcgagtccgccatcgccagcatccgcaagcagcggacctactccaccatgcacctcctggagagcgtgttcctggggaagcactgcgactactacaagaccttcgagcacaactccggctacagccaggcgaagtggcgcctcaccgccaagacgcaccacttcgacatctgctcccggcacagcacccaccacttctgccgctgcatctccgacgggaccaagtgccagaacggcgactgggacttcgccggcgagatgaacagcacctaccagtccaagaaggacttcttcgagcacgacctgaagctgttctgcacgctcgtcgagaacgccttccccgggaccaccgagagcctgttctacgagatgctgtccaagaagaacaccacgggcgtgaagaagctcctggacaagctgacccggaagttcgggaacaacaacatgttcgtgggcatctggaagttcgggcagtacctcatgagcctgccgtacgtcaacgagacctccctgacccccgcccaggtggcgaagatcctcgaggtgacggaccagcaccaccgcagcatctccggccggcaggagagcctggccagcgccacccccggctccaagagcaaggagtgcgggcacgccaagaaggtctcctgcatcagcccccgcttctccgtgccgatggagggcctgatggcgtgcggggacagccccaactacaagatctacaagacccccgccaagctctacaagtccaacaacaagggcgaggtgtggtgcagcggcgacgtccactgctcccaggagctgacccccgccagccaggagtccgtggaccgcatcaagcagatcacgtgcttcctgaccgagccggaggtgagcgacgacgtcttctccatcgccatcagcacgtgcaaggtgcaggacaagggggtgtgcaccgtcaacgaggaccggtggaacgtgatcaagtgcgactccggcctcatctactacaccgaccagcgcgacgggcaggacaccggcaacgacttcggggagtactgcctgagccactcctgccggatcgagcgcttccccatcaaccccgccatcatcagcgactgcctgtgggagtaccactcccgcaagagcaagtacatcaccagcctcgacctggagaacctggaggagttcaagcgggcgatctccgagaagctcagccacaccctgatcgtgtacaacttcaagcccacggccaacctgccgcacatcaagcccgtctacaagtacatcaccgtgcagggcgtggagaactccgacggcgtcgacagcgcctacatcgccgcctccatgcccgcgctcagcgggacctccatcggctacaacatcatgagccgggacaacttccccctgttcgacatcatcatcttcatcaagtccgccatcatcaaggccacctacaaccacatctacgacacggggccgaccatcggcatcaacgtgatgcacgacgagcactgcaccgggcagtgccccaccgacatcccccacaaggagaactggatcacgttcgcccaggagcgcaccagccggtggggctgcgaggagttcggctgcctggccgtgaacaccgggtgcgtcttcggctcctgccaggacatcatccgcccggagaccaaggtgtaccggaaggcggtggaggagagcgtcctcctgaccgtgtgcatcacgtaccccgggaagaccttctgcaccgagatcaacgccatcgagcccaagatcaccgacgagctggagctccagttcaagacggtggacaccaagaccctgcccaacatcctggccgtccagaaccacaagctctactccggccagatcaacgacctggggagcttctcccagggctgcggcaacatccagaagaccaacagctccatcatcgggacgggcaccgccaagttcgactacgtgtgccacggggcgagccgcaaggacatcatcgtgcggcgctgctacaacaacaactacgagtcctgcaagctgctcaaggaggagcagagcctgatgttcgccgacaaccacgagaccatcgacgtcgccaacgtgcggcacctcctgggcgacctgcagttcaagctgatgctcggggacctgcgctacaagagcttcgccgagaacccggacctggagatcgaggccaagtgcgtgggctgcccctcctgcttcaccagctactcctgcagcttcaagatcgtctccaacatcgacacggtgtgcagcatcgagggcccctgcaccaccttccacaaccggctcatgatcacctccacgaagcaggactacgggatcaagatgagctgcaagaccaagcccaaggagaccgaggagttccagatctgcaagaagacctacacggtgctgttcaccaccgtcgagaagaacgacaagatcgagatctccaccggcgaccagacgagcttcatccaggagcgcgacgaccggtgcaagacctggctgtgccgcgtgcgcgacgaggggatctccgtgatcttcgagccgatccgggcgttcttcggcagctacttctccatcgccttctacgtcgtggtgagcatcatcgtcctcttcctggccatctacatcttcctgcccatggtgttcaagctccgcgacgtcctgaagcggaacgagtacctgtacctccaggagatcaagcacaagtga

SEQ ID NO: 12581 - RNA, 4305 nt, synthetic construct
  misc_feature 1..4305: note = derived and/or modified CDS sequence (opt1) from NRIV(SUD-HKV66)__JX857320.1__GP
  source 1..4305: mol_type = other RNA
atgctgctcctgctggtgctcctgatcccctgctacgtcagcgcctccccggtggtgacccgctgcttccacggcgggcagctgatcgccgagaagaagtcccagaccgcggtctccgagttctgcctcaaggacgacgtgagcacgatcaagtccgagatcacctacgagaagaacaacaccggcctgttcgcccacagcaaggtgctgcggaactggatcatcaaggactggaagaactgcaaccccgtccccaccgccgggggctccatcaacgtgatcgaggtgaacacggacctcagcctgaccaccaagacctacgtctgctcccgcgactgcacgatcaccgtggacaaggaggacgcccagatcatcttccagaccgagaagctgaaccacttcgaggtgagcgggaccacgctctccagcggctggttcaagaccaaggcctccgtcaccctggaccggacctgcgagcacatcaaggtgacgtgcggcaagaagaccctgcagttccacgcgtgcttcaagcaccacatgagctgcatccgcttcttccacgggaccatcctccccggcaccatggccacgtccatctgccagaacatcgagctgatcatcatcatcagcctgaccctcatcatcttcatcctgatggtgatcctgaccaagacctacatctgctacctcctgatgccgctgttcatgcccatcgcctacttctacgggtggtcctacaacaagagctgcaagaagtgctcctgctgcggcctcgcctaccaccccttcacgaactgcgggagccactgcgtctgcggcctgaagttcgaggcgagcgaccggatgcgcatccaccgggagtccggcctgtgccaggggtacaagagcctccgcgtggcccggctgctgtgcaagtccaagggcagctccctcatcatcagcatcctgctggccatgctcatcctgtccttcgtgacccccatcgaggggaccctgaccaactacccggagagccgcaagtacgacctcgaggagatcgccgacgtcctggagggcttcatcgtggagaagggcatcaaggagtacgtggtcttctacacgtccatcttcggggccctgttcctcctgatggcgctggtgatcaccatcaccctcaacaaggtgaccgagtacctgacgaacatcaacgtcctgtactgccacgagtgcagcatgtaccactccaagaagaacatcaagtacatcggcgacttcaccaacaagtgcgggttctgcacgtgcggcgagctcgaggaccaggaggggctgaagatccacaaggtgagccggaagtgcatctacaagtaccagctgacctggtccaagatcatcatgaccatcctcgtctgcctgctgatcgcccagaacaccatcctgatcgtggccgccagcgacgactgctggaccaagaagtccctcgagatggagtgcatcggccccctgcagcaggtcgacacgtgcgacgacaaggccagccgctcctacagcggcgaggcgaagaagctggtgcgggcctccaagatcagcgacctcgacgccgcccaggtgcgcctgctggggcccaccatcgagagcgccatcgcgtccatccggaagcagcgcacctacagcaccatgcacctcctggagtccgtgttcctgggcaagcactgcgactactacaagaccttcgagcacaacagcgggtactcccaggccaagtggcggctcaccgccaagacgcaccacttcgacatctgcagccgccactccacccaccacttctgccggtgcatcagcgacgccaccaagtgccagaacggcgactgggacttcgccggggagatgaactccacctaccagagcaagaaggacttcttcgagcacgacctgaagctgttctgcacgctcgtcgagaacgcgttccccggcaccaccgagtccctgttctacgagatgctgagcaagaagaacaccacgggcgtgaagaagctcctggacaagctgacccgcaagttcgggaacaacaacatgttcgtgggcatctggaagttcgggcagtacctcatgtccctgccgtacgtcaacgagaccagcctgacccccgcccaggtggccaagatcctcgaggtgacggaccagcaccaccggtccatcagcggccgccaggagtccctggccagcgcgacccccgggagcaagtccaaggagtgcggccacgccaagaaggtcagctgcatcagcccccgcttcagcgtgccgatggagggcctgatggcctgcggggactcccccaactacaagatctacaagacccccgccaagctctacaagagcaacaacaagggcgaggtgtggtgctccggggacgtccactgcagccaggagctgacccccgcctcccaggagagcgtggaccggatcaagcagatcacgtgcttcctgaccgagccggaggtgtccgacgacgtcttcagcatcgcgatctccacgtgcaaggtgcaggacaagggcgtgtgcaccgtcaacgaggaccgctggaacgtgatcaagtgcgacagcggcctcatctactacaccgaccagcgggacgggcaggacaccggcaacgacttcggggagtactgcctgtcccacagctgccgcatcgagcggttccccatcaaccccgccatcatctccgactgcctgtgggagtaccacagccgcaagtccaagtacatcaccagcctcgacctggagaacctggaggagttcaagcgggccatcagcgagaagctctcccacaccctgatcgtgtacaacttcaagcccacggccaacctgccgcacatcaagcccgtctacaagtacatcaccgtgcagggcgtggagaacagcgacggggtcgactccgcctacatcgcggccagcatgcccgccctctccggcaccagcatcggctacaacatcatgtcccgcgacaacttccccctgttcgacatcatcatcttcatcaagagcgccatcatcaaggccacctacaaccacatctacgacacggggccgaccatcggcatcaacgtgatgcacgacgagcactgcaccgggcagtgccccaccgacatcccccacaaggagaactggatcacgttcgcgcaggagcggacctcccgctggggctgcgaggagttcgggtgcctggccgtgaacaccggctgcgtcttcggcagctgccaggacatcatccggccggagaccaaggtgtaccgcaaggccgtggaggagtccgtcctcctgaccgtgtgcatcacgtaccccgggaagaccttctgcaccgagatcaacgccatcgagcccaagatcaccgacgagctggagctccagttcaagacggtggacaccaagaccctgcccaacatcctggcggtccagaaccacaagctctacagcggccagatcaacgacctggggtccttcagccagggctgcgggaacatccagaagaccaactccagcatcatcggcacgggcaccgccaagttcgactacgtgtgccacggggcctcccggaaggacatcatcgtgcgccggtgctacaacaacaactacgagagctgcaagctgctcaaggaggagcagtccctgatgttcgccgacaaccacgagaccatcgacgtcgccaacgtgcgccacctcctcggcgacctgcagttcaagctgatgctcggggacctgcggtacaagagcttcgcggagaacccggacctggagatcgaggccaagtgcgtgggctgccccagctgcttcacctcctacagctgctccttcaagatcgccagcaacatcgacacggtctgctccatcgaggggccctgcaccaccttccacaaccgcctcatgatcaccagcacgaagcaggactacggcatcaagatgtcctgcaagaccaagcccaaggagaccgaggagttccagatctgcaagaagacctacacggtgctgttcaccaccgtggagaagaacgacaagatcgagatcagcaccggcgaccagacgtccttcatccaggagcgggacgaccgctgcaagacctggctgtgccgcgtccgggacgaggggatcagcgtgatcttcgagccgatccgcgccttcttcggctcctacttcagcatcgccttctacgtggtcgtgtccatcatcgtgctgttcctggcgatctacatcttcctgcccatggtcttcaagctccgggacgtgctgaagcgcaacgagtacctgtacctccaggagatcaagcacaagtga

SEQ ID NO: 12582 - RNA, 4344 nt, synthetic construct
  misc_feature 1..4344: note = derived and/or modified CDS sequence (opt1) from BWAV(M459)__NC_034490.1__GP
  source 1..4344: mol_type = other RNA
atggccatgttcgagctgatcgtgctcctggccttcagctacgtcaccggcgtgccccaggagctgacccgctgcttcaccgggggctccgtggtccggcagcactggagcaagaacgcgatctccgagctctgcctgaaggacgacgtgagcatcatcaagtccgagatcgagtacaagaagaacgagaccgggaccttcgccctgagcaagatctaccgcaagtggatcaccacggactgggagaagtgccagccgcagaagtccaccggcgggcacatcagcgtgctcgaggtccggcacgacctgaccctggcctccgccacctacatctgcggcaacccctgcacgatcaacgtggaccgcgagatggcccaggtgcacctccagaccgagggcgtcaaccacttcgagatcagcgggaccaccatcaagtccggctggttcaagacgaccacctacatcaccctggaccagacgtgcgagcacctgaaggtgagctgcgggaagcagtccgtgcagttccacgcgtgcttcaagcagcacatggcctgcgtccggttcctccaccgcaccatcctgcccggcaacatggccaacagcatctgccagaacatcgagatcatcatcctgctcgccctgaccctgtccatcttcatcctcctgtgcatcctgaccaagacgtacatctgctacatcctcctgcccatcttcatcccgatcagctacatctacgggtacttctacaaccggtcctgcaagaagtgcagccagtgcggcctggtgtaccaccccttcaccgagtgcggccgcaactgcgtgtgcggggcgcggtacgacacctccgagcgcatgaagctccaccggctgagcggcctgtgccccgggtacaagagcctcaaggccgcccgcgtcctgtgcaagtccaagggcagcgcctccatcctgagcatcctcatctccctgctgatcctcaccttcgtgacgcccatcaacggcctgatgctgaaggacaccgacatcaccaacctcaagatcgacaccctgccggacgacatgctggagctcatccacaacgtggactacctgaagctgatcctcgagatcaacatcacgatcttcgggttcatcctgatcatcatcctgttcatgctcctgatgttctaccggtaccagcacatcttcatcagcatctacgtcatcgactgcaaggagtgcaacatgtaccactccaagagcggcctgcgctacaacggggacttcaccaacaagtgcatgacctgcacgtgcggcgaggtggacgacatggaggggctcaacaagcacaagaagcggtacaactgcctgatcaagtacaagacgaccatcctgcagcacttcttcctgtccatcctcgtgtgcctgatcctgaaggagagcgtcctcttcgccgcggcccagtccgaggagatcatcaagtgcctggagcaggagagcctgacctccaagtgcaccggccccctcctgaagacgccccagtgcaccgagcagcagaagaacctcctcttcatcgagatcgccaagcagatggagaaggacaacatcatcaccagcctggacaacgccctgatcgccaagctccccaacgagatcgcgggctccatggccatcctggacaccaagaagtactaccacgagcagatcaccctggagtacgccatcctcagcaagtactgcgactactacaagaagtacgaggggaacacgggctactcccagaccacctggcgcacctacctgcggagccaggacctggagatctgcctcatcctgccgtaccagttcttctgccgctgcttcaagtccgggacgggctgcatcgacaccaagatggagatcaagagcaccatggacacctactacagctcccaccagacgaagttcgacagcgacctgaactacatgctccacgtgatccacctggccttccgggggtccgccaccagctacatcgcgaagtgcctgatcgagaagaactacaccgagaccatctcctacctcacgaagatccaggagaagtaccccaacaaccagctgctgaaggtggccatcttcttcaccaaccacctcctgaaccagagcctggtcgagaacttcgaggtgtccaccgagtggagccgctacaagcactccaccgcccagcccgagcacgagtggaagaagggcagcgagctcaagatgctggaccccaacaagctgaagacgggcccggccatccagacctgcctccacatcaaggacctgcactgcatcagcccccggagccgcgcccccacctccgggatcatcacgtgcggcctgaacgaccaggcgtgcgtctaccgcaagcccgacaagaagatctacgccagccacatgacccagcacgggttctgcgtgatggacggccactgcctcaagccgttcgagcccatctccggggagatgctgcagatcatcaagaagtccaagtgctggaccgaggacatcgaggacctgatcaccgagggccaggacaagggccggatctcctgccagcccatcgacgtggggaactgcaacgtcagcggcaacctctggaccatcacgctgtgcagcgacaagaagttctactacaccgacaacaagcacgtgcacgacaactccaaggacatcgggtactactgcatggaggagaactgcaagatcccccgcttcccgatccaccccgacttcgtgaaggactgcgagtgggacctgaaccacatcaagatcgaccacctcaagcagatcaacatcgaggacatcaacagctacaagaagatcctgaccgagaagctgaccacggccctcaactccttcaagtacaagggcaacgagaacctgccccacagcatccccaagtacaagtacatcaccatccagggcacccagaccatcgacgggatcgagaacgccttcatcgaggtcgagatcccggcgctgtccggcagcgccacggggttcaagatctccagccgggacggcatcgagctgttcgacgccatcctgtacgtgaagcaggcctccttcagctccgtgtacaagaagctgtacgtcaccgggcccaccatcggcatcaacaccaagcacgacgagcgctgcacgggcgcctgccccatgaccctcccgcacagctacgggtggctgaccttctccaaggagcggaccagccagtggggctgcgaggagtacgggtgcctggcgatctccgacggctgcgtgttcgggagctgccaggacatcatcaaggacgacctcaccatctaccgcaaggagacggaggagctgtccctggccgagatctgcatcaccttcatgcacaacaccttctgcaccagcatcgactccacgacccccaccatcaccgacatcctcgaggcccagttcaagacggtggagagcttcaagctgcccaacaccgtcggcctgaagatgcacaagctctacatcggcaccatcaacgacatcggggtgtacaagaaggcctgcggcaacgtgcagaagtacaacaacaccatcctggggagcggctcccccaagttcgactacgtctgccacctggccaagcggaaggacgtgatcctccgcaagtgcttcgacaacgactacaacagctgcaagctgctgaaggtggcgaacgacctccggatcgaggaggacggggagaagctgaaggtcatcaactacaagaaggtgatgggcacgctgaagttcaaggccatcttcggcgacatcaagtacaagtccttcacccaggacgtggacatcgacgccgaggcgacctgcgtcgggtgcctcaactgcttcgagaacatcaactgcgagatcaaggtgcagagcccgctggagaccacgtgcgaggtggagtccagctgcgacctgttcaccacccgcatcctcttccaccaggacatccacaagtacgccctgaagctgatctgctccaaggaggccagctccaagttctggatccggttctgcaacaaggagatcaagagctccatcagcctcatcaacgccgcccccatcctggagctggcccccatcgaccagacctcctacgtcaaggaggaggacgagcgctgcggcacgtggatgtgccgggtggcgcaggaggggatcggcgtgatcttcgagcccttcaagaacctcttcgggagctacctgggcatcttctacatcatcatcatcgtcatcatcctgctcgtgctgttcgtgtacatcttcctgccgatgatcctcaagctgaaggagatcctgcagaagaacgaggtcgcctaccagcgcgacatgaagatccggtga

SEQ ID NO: 12583 - RNA, 4344 nt, synthetic construct
  misc_feature 1..4344: note = derived and/or modified CDS sequence (opt1) from BWAV(UgAr1888)__KJ867186.1__GP
  source 1..4344: mol_type = other RNA
atggccatcttcaagctgatcgtgctcctggccttcagctacgcgaccggcgtcccccaggagctgtcccgctgcttcaccgggggcagcgtggtgcggcagcactggtccaagaacgccatcagcgagctctgcctgaaggacgacgtctccatcatcaagagcgagatcgagtacaagaagaacgagacggggaccttcgccctgaacaagatctaccgcaagtggatcaccaccgactgggagaagtgccagccgcagaagtccacgggcgggcacatcagcgtgctcgaggtgcggcacgacctgaccctggcctccgccacctacatctgcggcaacccctgcaccatcaacgtcgaccgcgagatggcccaggtgcacctccagacggagggcgtgaaccacttcgagatcagcgggaccaccatcaagtccggctggttcaagaccacgacctacatcaccctggaccagacctgcgagcacctgaaggtcagctgcgggaagcagtccgtgcagttccacgcgtgcttcaagcagcacatggcctgcgtgcggttcctccaccgcacgatcctgcccggcaacatggccaacagcatctgccagaacatcgagatcatcatcctgctcgcgctgaccctgtccatcttcatcctcctgtgcatcctgaccaagacctacatctgctacatcctcctgcccatcttcatcccgatcagctacatctacgggtacttctacaaccggtcctgcaagaagtgcagccagtgcggcctggtctaccaccccttcacggagtgcggccgcaactgcgtgtgcggggcccggtacgacacctccgagcgcatgaagctccaccggctgagcggcctgtgccccgggtacaagagcctcaagaccgcccgcgtgctgtgcaagtccaagggcagcgcctccatcctgagcatcctcatctccctgctgatcctcaccttcgtcacgcccatcaacggcctgatgctgaaggacaccgacatcaccaacctcaagatcgacaccctgccggacgacatgctggagctcatccacaacgtggactacctgaagctgatcctcgagatcaacatcatgatcttcgggttcatcctgatcatcatcctgttcatgctcctgatgttctaccggtaccagcacatcttcatcagcatctacgtgatcgactgcaaggagtgcgacatgtaccactccaagagcggcctgcgctacaacggggacttcacgaacaagtgcatgacctgcacgtgcggcgaggtcgacgacatggaggggctcaacaagcacaagaagcggtacaactgcctgatcaagtacaagaccaccatcctgcagcacttctccctgagcatgctcgtgtgcctgatcctgaaggagtccgtcctcttcgccgcggcccagcccgaggagatcatcaagtgcctggagcaggagagcctgacctccgagtgcaccggccccctcctgaagacgccccagtgcaccgagcagcagaagaacctcctcttcatggagatcgccaagcagatggagaaggacaacgtgatcaccagcctggacaacgccctgatcgccaagctcccgaacgagatcgcgggctccatggccatcctggacaccaagaagtactaccacgagcagatcaccctggagtacgccatcctcagcaagtactgcgactactacaagaagtacgaggggaacaccggctactcccagacgacctggcgcacctacctgcggagccaggacctggagatctgcctcatcctgccctaccagttcttctgccgctgcttcaagtccgggaccggctgcatcgacacgaagatcgagttcaagagcaccatggacacctactacagctcccaccagaccaagttcgacagcgacctgaactacatgctccacgtgatccacctggccttccgggggtccgccacgagctacatcgcgaagtgcctgatcgagaagaactacaccgagaccatctcctacctcaccaagatccaggagaagtaccccaacaaccagctgctgaaggtggccatcttcttcacgaaccacctcctgaaccagagcctggtcgagaacttcgaggtgtccaccgagtggagccgctacaagcactccgccacccagcccgagcacgagtggaagaagggcagcgagctcaagatcctggactccaacaagctgaagaccggcccggccatccagacgtgcctccacatcaaggacctgcactgcatcagcccccggtcccgcgcccccaccagcgggatcatcacgtgcggcctgaacgaccaggcgtgcgtctaccgcaagcccaacaaggagatctacgcctcccacatgacccagcacgggttctgcatcatggacggccactgcctcaagccgttcgagcccatcagcggggagatgctgcagatcatcaagaagtccaagtgctggaccgaggacatcgaggacctgatcaccgagggccaggacaagggccggatcagctgccagcccatcgacgtggggaactgcaacgtgagcggcaacctctggaccatcaccctgtgctccgacaagaagttctactacacggacaacaagcacgtccacgacagctccaaggacgtggggtactactgcatggaggagaactgcaagatcccccgcttcccgatccaccccgacttcgtgaaggactgcgagtgggacctgaaccacatggagatcgaccacctcaagcagatcaacatcgaggacatcaacagctacaagaagatcctgaccgagaagctgatcaccgccctcaactccttcaagtacaagggcaacgagaacctgccccacagcatccccaagtacgagtacatcaccatccagggcacgcagaccatcgacgggatcgagaacgccttcatcgaggtcgagatcccggcgctgtccggcagcgccaccgggttcaagatctccagccgggacggcatcgagctgttcgacgccatcctgtacgtgaagcaggcctccttcagctccgtgtacaagaagctgtacgtcaccgggcccacgatcggcatcaacaccaagcacgacgagcgctgcaccggcgcctgccccgtgaccctcccgcacagctacgggtggctgacgttctccaaggagcggaccagccagtggggctgcgaggagtacgggtgcctggcgatctccgacggctgcgtgttcgggagctgccaggacatcatcaaggacgacctcaccgtctaccgcaaggagaccgaggagctgtccctggccgagatctgcatcaccttcatgcacaacacgttctgcaccagcatcgacagcaccacccccacgatcaccgacatcctcgaggcccagttcaagaccgtggagtccttcaagctgcccaacaccgtgggcctgaagatgcacaagctctacatcggcacgatcaacgacatcggggtctacaagaaggcctgcggcaacgtgcagaagtacaacaacaccatcctggggagcggctcccccaagttcgactacgtgtgccacctggccaagcggaaggacgtcatcctccgcaagtgcttcgacaacgactacaacagctgcaagctgctgaaggtggcgaacgacctccggatcgaggaggacggggagaagctgaaggtgatcaactacaagaaggtcatgggcaccctgaagttcaaggccatcttcggcgacgtgaagtacaagtccttcacccaggacgtggacatcgacgccgaggccacgtgcgtcgggtgcctcaactgcttcgagaacatcaactgcgagatcaaggtgcagagcccgctggagacgacctgcgaggtggagtccagctgcgacctgttcaccacccgcatcctcttccaccaggacatccacaagtacgccctgaagctgatctgctccaaggaggcgaccagcaagttctggatccggttctgcaagaaggagatcaagtccagcatctccctcatcaacgccgcccccatcctggagctggcccccatcgaccagaccagctacgtcaaggaggaggacgagcgctgcggcacctggatgtgccgggtggcgcaggaggggatcggcgtgatcttcgagcccttcaagaacctcttcgggtcctacctgggcatcttctacatcatcatcatcgtcatcatcctgctcgtgctgttcgtgtacatcttcctgccgatgatcctcaagctgaaggagatcctgcagaagaacgaggtcgcctaccagcgcgacatgaaggtgcggtga

SEQ ID NO: 12584 - RNA, 4332 nt, synthetic construct
  misc_feature 1..4332: note = derived and/or modified CDS sequence (opt1) from BWAV/PGAV(SAAr1)__KJ867177.1__GP
  source 1..4332: mol_type = other RNA
atgatctgcatctgcatcttcgtggccatcttccccgccatctacgcgatcccggacagctactcccgctgcttcaccggcgggaccgtcgtgaaggagatgtggagcaaggacgccgtgacggagctgtgcatcaaggacgacgtctccatcgtgaagaccgagaccagctacaagaagaacggcaccgggacgttcgccctcaacaaggtgacccggaagtggctgatgaccgactgggagaagtgcaagccccagaagtccagctccggccacatcaacgtcatcgaggtgcgcgacgacctgaccctcgccacgagcacctacatctgctccagctcctgcaccatcaacgtggaccgggagaccgcccagatccagctgaacacggacagcatcaaccacttcgagatcgcggggaccaccatcaagaccggctggttcaagtccacgaccctggtcgccctcgaccagacctgcgagcacctgaaggtgagctgcggcaagcagtccgtgcagttccacgcctgcttcaaccagcacatgagctgcgtccgcttcctgcaccggaccatcctccccgggaacatggccaagtccatctgccagaacatcgagatcatcatcctggtgggcctgatcatcctcatcttcctgctgctctgcatcctgacgaagacctacatctgctacatcctgctccccatcttcatcccgctgagctacgcgtacgggtacttctacaacaaggcctgcaagaagtgctcccagtgcggcctggtgtaccaccccttcaccgagtgcgggagcaactgcgtctgcggcgcccgctacgacaccagcgagcggatgaagctccaccgcatctccggcctgtgccccgggtacaagagcctgcggacggcccgcgtgctctgcaagtccaagggcagcgcctccatcctgagcatcctgatctccatcctcatcctgatgttcgtgacccccatcaacgggtacatgatcaccaacgagttcgacgagggcaagctgaccgtcgacagcctcccggacgacatgctgtccatgatcagccggctgtccgcgctccagttcatcttcacgctgaacatcgcctgcagcgtgctggtgaccctcctgacctgcctgttcctcatcatcttctaccgcttccagcaccggttcctgtccaagtacgccatcaactgcaccgagtgcgacatgtaccaccagaagaagggcctgatctacaacggggacttcacgaacaagtgcatgacctgcacgtgcggcgaggtcaacgacatggaggggctcaacaagcacaagaagcgctacaactgcctgatcaagtacaaggccgcctggttcctgaacctcaccatcaccatcatctgcctgatgctgatcaaggacggcagcatgatggcggccgccgagaccaacatcgagacctgcatggccaagccctccctcaccaccgactgcacggggcccttcctgaagatcaccaagtgcgacgagagccagaaggccctgcccttccaggagatcgcgaagcagctggtgaagtccaacgtgctcaccctgctggacaagcacatcgtcgagaagctcccgaacgagatcgccggcagcctgtccatcctggacaagaagcagcactaccacgagcagctcgccgtggagtacggcatcctgagcaagtactgcgactactacgagctgtacaagagcaactccgggtacagccagtccacctggggcacgtacctccggagccacgacttcgagatctgcctgctgctcccctaccagtacgtctgccgctgcttcaagtccgggaccggctgcaccgacaccaagttcgagttcgagcagaagatgaacgagacgtacaacagcaagaacgacatgtacaactccgacttcaccctggccctgaccgtgctccacctggccatgcgggggaccgcgagcacgtacatcatcgacaacgtgctgcagaagaactactccaacgtcatcgagtacctcaacaccaccaagaacaacttcaagagcaaccaggtgttcggcgtgctggtcgacttcaccatctacctgctccgccacgcctcctacgccaagtacaacctgccccagagcctgaagaagttccggtccgtgagctccgacctcacgaccatcagcggccgctccagcgggcagaacatcgtgagcgacctgcaccagggcgacgtcatcaagacctgcctgaacatcaagcagctcaactgcatctcccccaagagccggaccacgaccaccaacctgatcacgtgcgggtccagccagatctccgtgtacaacctgccgcgcggccagctctacgagagcgtgaccaccgagcacgggacctgcgccggcgacggccactgcctgaccgacttcatgcccatcaactccgacttcctggcgacgctcaagaagtccaagtgctggaccaccgacatccccaacatcatcaagctggtcgagagcgacgggaagatcagctgccagcccatcgacgtgggctcctgcaacgtgagcgggaacatctggaccatcacgaagtgctccgacaacaagtactactacaccgacaacaagcacgtccacgacgacgagaaggacatcggccactactgcatggaggagacctgcaagttcgtgcgcttcccgatcaacgacaagttcgtgagcaactgcgagtgggacctgaaccacatcgagatcaacaagctcaaccaggtcgagctggacaacatcaacgcctacaagaaggtgctgaccgagaagctcacgtccagcctgtccgtgttcaagtacaagctgacccagaacctcccccacgtcatccccaagttcaagtacatcaccatccagggcacccagaccgtggacgggatcgagaacagcttcatcgaggtggagatccccgccctgtccggcgccgccagcgggttcaagatcatgacgaaggagaacaacgagctgttcgacgcgatcctctacgtcaagcaggccagcttctccagcatctacaagaagatctacaccaccggcccgaccatcgggatcaacacgaagcacgacgagaagtgcaccggcgcctgccccgtgaacctgccccactccaccggctggctgaccttcgccaaggagcggacgagcacctgggggtgcgaggagtacggctgcctcgccatcaacgacgggtgcgtgttcggctcctgccaggacatcatcaaggacgagatgtacatcttcaagaaggagaccgaggaggtcgcgctggtggagatctgcatcagcttcaaccacaagaccttctgcacggacgtggactccaccacccccatcatcaccgacacgctggaggcccagttcaagaccgtcgagagctacaagctcccgaaccacgtggccctgaagcagcacaagctgtacgtggggcagatcaacgacttcggcgtctacaagaaggcctgcggcaacgtgcagaagatcaacaacaccatctacggggagggcacgccccgcttcgactacctctgccacctggccaagcggaaggacgtgctggtccgcaagtgcttcgacaacgactacaactcctgcagcctcctgaccatcgcggacgacctgcggctcgaggaggacggggagaagctgaaggtgatcaactaccgcaaggtgctgggctccatgaagttcaaggccctcttcggggacatccggtacaagagcttcaccgaggacatcgagctggacgtcgaggcctcctgcgccggctgcatcaactgcttcgacaacatccactgcgagatcaagctgaccaacggcctcgacaccagctgctccttcgagagctcctgcgacgcgttcaacagccgcatcctgttcaactccaaccagcacgtgtacagcacgaagctgatctgcaccaaggagcagaccaaggccttcgagatcaagatctgcgggaagaccatcaaggccgacctcgtggtcacggaggccaagcccatcctggagctgaccccgatcgaccagaccagctacatcaaggaggaggacacccggtgcggcacgtggttctgccgcctcaccaaggaggggttctccgtgctgctggagcccttcaagaacctcttcggcagctacctggggatcgcctacaccatcatcatcgcgctgctctgcctgttcgtgttcatctacatcatcctgcccatgatcatgaagctcaaggaggtcctgaagcagaacgagatcgcctaccagaaggagcagaagaagcggtga

SEQ ID NO: 12585 - RNA, 4332 nt, synthetic construct
  misc_feature 1..4332: note = derived and/or modified CDS sequence (opt1) from BWAV/PGAV(191B-07)__KJ867180.1__GP
  source 1..4332: mol_type = other RNA
atgatctacatctacatcttcgtggccatcttccccgccatctacgcgatcccggacagctactcccgctgcttcaccggcgggaccgtcgtgaaggagatgtggagcaaggacgccgtgacggagctgtgcatcaaggacgacgtctccatcgtgaagaccgagaccagctacaagaagaacggcaccgggacgttcgccctcaacaaggtgacccggaagtggctgatgaccgactgggagaagtgcaagccccagaagtccagctccggccacatcaacgtcatcgaggtgcgcgacgacctgaccctcgccacgagcacctacatctgctccagctcctgcaccatcaacgtggaccgggagaccgcccagatccagctgaacacggacagcatcaaccacttcgagatcgcggggaccaccatcaagaccggctggttcaagtccacgaccctggtcgccctcgaccagacctgcgagcacctgaaggtgagctgcggcaagcagtccgtgcagttccacgcctgcttcaaccagcacatgagctgcgtccgcttcctgcaccggaccatcctccccgggaacatggccaagtccatctgccagaacatcgagatcatcatcctggtgggcctgacgatcctcatcttcctgctgctctgcatcctgaccaagacctacatctgctacatcctgctccccatcttcatcccgctgagctacgcgtacgggtacttctacaacaaggcctgcaagaagtgctcccagtgcggcctggtgtaccaccccttcaccgagtgcgggagcaactgcgtctgcggcgcccgctacgacacgagcgagcggatgaagctccaccgcatctccggcctgtgccccgggtacaagagcctgcggaccgcccgcgtgctctgcaagtccaagggcagcgcctccatcctgagcatcctgatctccatcctcatcctgatgttcgtgacccccatcaacgggtacatgatcaccaacgagttcgacgagggcaagctgacggtcgacagcctcccggacgacatgctgtccatgatcagccggctgtccgcgctccagttcatcttcaccctgaacatcgcctgcagcgtgctggtgaccctcctgacctgcctgttcctcatcatcttctaccgcttccagcaccggttcctgtccaagtacgccatcaactgcacggagtgcgacatgtaccaccagaagaagggcctgatctacaacggggacttcaccaacaagtgcatgacctgcacgtgcggcgaggtcgacgacatggaggggctcaacaagcacaagaagcgctacaactgcctgatcaagtacaaggccgcctggttcctgaacctcaccatcaccatcatctgcctgatgctgatcaaggacggcagcatgatggcggccgccgagtccaacatcgagacctgcatggccaagcccagcctcaccaccgactgcacggggcccttcctgaagatcaccaagtgcgacgagtcccagaaggccctgcccttccaggagatcgcgaagcagctggtcaagagcaacgtgctcaccctgctggacaagcacatcgtggagaagctcccgaacgagatcgccggctccctgagcatcctggacaagaagcagcactaccacgagcagctcgccgtggagtacggcatcctgagcaagtactgcgactactacgagctgtacaagtccaacagcgggtactcccagagcacctggcggacgtacctccgctcccacgacttcgagatctgcctgctgctcccctaccagtacgtctgccggtgcttcaagagcggcaccgggtgcaccgacaccaagttcgagttcgagcagaagatgaacgagacgtacaactccaagaacgacatgtacaacagcgacttcaccctggccctgaccgtgctccacctggccatgcgcggcaccgcgtccacgtacatcatcgacaacgtgctgcagaagaactacagcaacgtcatcgagtacctcaacaccaccaagaacaacttcaagtccaaccaggtgttcggggtgctggtcgacttcaccatctacctgctccggcacgccagctacgccaagtacaacctgccccagtccctgaagaagttccgcagcgtgtccagcgacctcacgaccatctccggccggagcagcggccagaacatcgtgtccgacctgcaccagggggacgtcatcaagacctgcctgaacatcaagcagctcaactgcatcagcccccgctcccgcaccacgaccaccaacctgatcacgtgcggcaccagccagatctccgtgtacaacctgccgcgggggcagctctacgagagcgtgaccaccgagcacgggacctgcgccgacgacggccactgcctgacggacttcatgcccatcaactccgacttcctggcgaccctcaagaagtccaagtgctggaccaccgacatccccaacatcatcaagctggtcgagagcgacggcaagatcagctgccagcccatcgacgtgggctcctgcaacgtgagcgggaacatctggacgatcaccaagtgctccgacaacaagtactactacaccgacaacaagcacgtccacgacgacgccaaggacatcggccactactgcatggaggagacctgcaagttcgtgcgcttcccgatcaacgacaagttcgtgagcaactgcgagtgggacctgaaccacatcgagatcaacaagctcaaccaggtcgagctggacaacatcaacgcctacaagaaggtgctgacggagaagctcacctccagcctgtccgtgttcaagtacaagctgacccagaacctcccccacgtcatccccaagttcaagtacatcaccatccaggggacccagacggtggacggcatcgagaacagcttcatcgaggtggagatccccgccctgtccggcgccgcgagcgggttcaagatcatgaccaaggagaacaacgagctgttcgacgccatcctctacgtcaagcaggccagcttctccagcatctacaagaagatctacaccaccggcccgacgatcgggatcaacaccaagcacgacgagaagtgcaccggcgcctgccccgtgaacctgccccacaacaccgggtggctgacgttcgccaaggagcggacctccacctggggctgcgaggagtacggctgcctcgcgatcaacgacgggtgcgtgttcggcagctgccaggacatcatcaaggacgagatgtacatcttcaagaaggagaccgaggaggtcgccctggtggagatctgcatctccttcaaccacaagacgttctgcaccgacgtggacagcaccacccccatcatcacggacaccctggaggcccagttcaagaccgtcgagtcctacaagctcccgaaccacgtggccctgaagcagcacaagctgtacgtggggcagatcaacgacttcggcgtctacaagaaggcctgcgggaacgtgcagaagatcaacaacaccatctacggcgagggcacgccccgcttcgactacctctgccacctggcgaagcggaaggacgtgctggtccgcaagtgcttcgacaacgactacaacagctgctccctcctgaccatcgccgacgacctgcggctcgaggaggacagcgagaagctgaaggtgatcaactaccgcaaggtgctggggtccatgaagttcaaggccctcttcggcgacatccggtacaagagcttcaccgaggacatcgagctggacgtcgaggcctcctgcgcggggtgcatcaactgcttcgacaacatccactgcgagatcaagctgaccaacggcctcgacacgagctgctccttcgagagctcctgcgacgccttcaacagccgcatcctgttcaactccaaccagcacgtgtacagcaccaagctgatctgcaccaaggagcagaccaaggccttcgagatcaagatctgcgggaagacgatcaaggccgacctcgtggtcaccgaggccaagcccatcctggagctgaccccgatcgaccagaccagctacatcaaggaggaggacacgcggtgcggcacctggttctgccgcctcaccaaggagggcttctccgtgctgctggagcccttcaagaacctcttcgggagctacctgggcatcgcgtacaccgtgatcatcgccctgctctgcctgttcgtcttcatctacatcatcctgcccatgatcatgaagctcaaggaggtgctgaagcagaacgagatcgcctaccagaaggagcagaagaagcggtga

SEQ ID NO: 12586 - RNA, 4326 nt, synthetic construct
  misc_feature 1..4326: note = derived and/or modified CDS sequence (opt1) from CEV(283)__KX817313.1__GP
  source 1..4326: mol_type = other RNA
atgatcttcatgctgatcctcttcgccgtggccgcggccagccccgtctaccagcgctgcttccaggacggcgccatcgtgaagcagaacccgtccaaggaggccgtgaccgaggtctgcctgaaggacgacgtgagcatgatcaagaccgaggcccggtacacgaagaactccaccggggtgttcagcaacaacgtcgcgatccgcaagtggctggtgtccgactggcacgactgccggccccgcaaggtggtcggcgggcacatcaacgtgatcgaggtgggcgacgacctcaccctgcacaccgagagctacgtctgctccgccgactgcacgatcggggtggacaaggagaccgcccaggtgcggctgcagaccgacaccacgaaccacttcgagatcgccggcaccaccgtcaagagcggctggttcaagtccaccacgtacatcagcctcgaccagacctgcgagcacctgaaggtgtcctgcgggcccaagagcatccagttccacgcgtgcttcaaccagcacatgtcctgcgtgcgcttcctgcaccggaccatcctccccggcagcatcgccaactccatctgccagaacgtcgagatcatcatcctggtgaccctggccctcctgatcttcatcctgctcagcatcatctccaagacgtacatctgctacctgctgatgccgatcttcatccccatcgcctacatctacgggctcatctacaacaagagctgcaagaagtgcaagctgtgcggcctggtgtaccaccccttcaccgagtgcgggacccactgcgtctgcggcgcccgctacgacacctccgaccggatgaagctccaccgcgcgagcggcctgtgccccgggtacaagagcctgcgggccgcccgcgtgatgtgcaagtccaagggcccggccagcatcctctccatcatcacggccgtgctgatcctgaccttcgtcacccccatcaacgcgatgatggtgggggagagcaaggagaccttcgagctcgaggagctgcccgacgacatgctggagatggccaacaacctcaacacgtactacatgctgtgcgtcgccaactacgccgtgacctggtccctgctcatcgtggccctgatcatcggcctgctgttcaagaagtaccagcaccggttcctggacatctacgcgatgtactgcgaggagtgcgacatgtaccacgaccgcagcggcatcaagtggaacggggacttcaccaacaagtgcggccactgcacgtgcgggcagtacgaggacgcctccggcctgctcgtccaccggaagacctacaactgcctgatccagtacaagagcaagtggatcatgaacttcctggtgacctacgtgatcctcgtcctgctgaaggactccgtggtgatcgtccaggccaagggggtggacttcagcgagtgcatcgaggccgagaaggtgcgctggaactgcaccggccccttcgtcaacctcggcaactgcgagaagaagcagaagaaggagccgtactccaacatcgccgcgcagctgaaggggctgggcgccatcagcatcctcgacgtgcccatcatcgcctccatccccgaggacatcgccggggcgctgcggtacatcgaggaccagcgcagctaccactcccagctgaccgtggagtacgccatgctgacgcggtactgcgactactacacccagttcagcgacaactccggctacagccagaccacctggcgcgtctacctccggtcccacgacttcgaggcctgcgtgctgtaccccaaccagcacttctgccgctgcgtgaagcacggggacaagtgcagcagctccaactgggacttcgccagcgagatgaagaactactactccggcaagcagagcaagttcgacaaggacctgaacctcgccctgacgtccctgcaccacgcgttccgcggcaccagctccagctacatcgccgggctcctgtccagcaaggccaacgacgagctggtccagtacacctccaagatccgggagaagttcccgggcaacgccctcctgaaggccgtgatcgactacatcgcgtacatgaaggggctgaccgagatgagcaacttcaagaaggacgagttctgggacgagctcgtgtacgtccccgaccccaccaagcccccgaagctgtcccgcagctccggcacggtgtacgacttcaagagcgccacctccaacctgggggagaagaactgcaaggacgtgaagggcgtcgtgtgcctcagcccccggagcggcgtgacctacgactccatcatcgcctgcggggagggcagctcccccaacatctaccgcatccccaagaccggggtctaccagagcaactccgagccgagcaactactgcgtgtccgacagccactgcctggaggacttcgaggtgatcaaccaggaggagctggacgccatcaagaagtcccggtgctgggaggtcgactacctctacgccaaccccagcaagcagtccgacggcatccgcagctgccggatgcgcgacgcgggccactgcaacgtgacgaccaaccggtggcccatcatccagtgcgacgacaacaagtactactactccgagctgcagcgcgactacgacaaggagcaggacatcgggcacttctgcctgagcccccggtgcaccaccgtgcgcttcccgatccaccccaagcacgtctccaactgcgactggcaggtcagccactccacggtggacaaggtggacgtgcacaacctcgaggacatcgagcagtaccggaaggccatcacccagaagctgcagaacagcctgtccatcttcaagtacgcccgcaccaagaacctcccccacatcaagccgatctacaagtacatcaccatcgagggcacggagaccgccgaggggatcgagagcgcgtacatcgagagcgagatccccgccctggccggcacctccatcgggttcaagatcaacaccaaggagggcaagcacctcctcgacgtgatcgcctacgtcaagcaggccagctactccagcctgtacaacaagatgtacgtgacgggccccaccgtggggatcaacaccaagcacgacgagctgtgcaccggcccctgcccggtcaacgtgccccactccgacgggtggctcacgttcgcgcgggagcgcaccagctcctggggctgcgaggagttcgggtgcctggccatcagcgacggctgcgtgttcggctcctgccaggacctgatcaaggaggagctcgccgtctaccggaaggagaccgaggaggccaccaacgtggagctgtgcctgacgttcagcgacaagacctactgcaccgagctcaaccccatcacccccatcatcacgaacctgttcgaggtgcagttcaagaccgtcgagacctactccctgccgcgcgtggtggccgtccagaaccacgagatccggatcgggcagatcaacgacctcggcatctacagcaaggggtgcggcaacgtgcagaaggtcaacaacaccatctacgggaacggcgtgcccaagttcgactacctgtgccacctggcgtcccgcaaggaggtgatcgtccgcaagtgcttcgacaacgacttccaggcctgcaagttcctccagagcccgccctcctaccggctggaggaggacgacggcagcatcacggtgatcgactacaagaagatcctggggaccatcaagatgaaggccatcctcggcgacgtgaagtacaagaccttcgccgagaacatcgacatcaccgccgagggggtctgcacgggctgcgtgaactgcttcgagaacatccactgcgagctgaccatccacaccaccatcgaggcgtcctgccccgtgaccagcccctgcacgctgttccacgaccgcatcctcatcacccccgacgagcacaagtacgccatgaaggtcatctgcaccgagaagcagaccgggacgctgcccttcaagatctgcaactccaaggtggacgccaccctgaccctcgtggaggccaagccgatcctggagctggcgagcgtcgaccagaccgcctacatccgggagaaggacgagcgctgcaagacgtggatgtgccgggtgcgcgacgagggcatccaggtgatcctcgagcccttcaagaacctgttcggcagctacatcgggatcttctacacctccatcctgatcgtcatcaccatcttcatcatcatctacgtgatcctccccatctgcttcaagctgaaggacaccctgcagaagcacgaggacgcctacaagcgggagatgaagatccgctga

SEQ ID NO: 12587 - RNA, 4326 nt, synthetic construct
  misc_feature 1..4326: note = derived and/or modified CDS sequence (opt1) from CEV(BFS283)__AF123483.1__GP
  source 1..4326: mol_type = other RNA
atgatcttcatcctgatcctcttcgccgtggccgcggccagccccgtctaccagcgctgcttccaggacggcgccatcgtgaagcagaacccgtccaaggaggccgtgaccgaggtctgcctgaaggacgacgtgagcatgatcaagaccgaggcccggtacacgaagaactccaccggggtgttcagcaacaacgtcgcgatccgcaagtggctggtgtccgactggcacgactgccggccccgcaaggtggtcggcgggcacatcaacgtgatcgaggtgggcgacgacctcaccctgcacaccgagagctacgtctgctccgccgactgcacgatcggggtggacaaggagaccgcccaggtgcggctgcagaccgacaccacgaaccacttcgagatcgccggcaccaccgtcaagagcggctggttcaagtccaccacgtacatcagcctcgaccagacctgcgagcacctgaaggtgtcctgcgggcccaagagcatccagttccacgcgtgcttcaaccagcacatgtcctgcgtgcgcttcctgcaccggaccatcctccccggcagcatcgccaactccatctgccagaacgtcgagatcatcatcctggtgaccctggccctcctgatcttcatcctgctcagcatcatctccaagacgtacatctgctacctgctgatgccgatcttcatccccatcgcctacatctacgggctcatctacaacaagagctgcaagaagtgcaagctgtgcggcctggtgtaccaccccatcaccgagtgcgggacccactgcgtctgcggcgcccgctacgacacctccgaccggatgaagctccaccgcgcgagcggcctgtgccccgggtacaagagcctgcgggccgcccgcgtgatgtgcaagtccaagggcccggccagcatcctctccatcatcacggccgtgctgatcctgaccttcgtcacccccatcaacgcgatgatggtcgggggcagcaaggagaccttcgagctcgaggagctgcccgacgacatgctggagatggccaacaacctcaacacgtactacatgctgtgcgtgaccaactacgccgtgacctggtccctgctcatcatcgccctggccatcggcctgctgttcaagcggtaccagcaccgcttcctggacatctacgcgatgtactgcgaggagtgcgacatgtaccacgaccggagcgggatcaagtggaacggcgacttcaccaacaagtgcgggcagtgcacgtgcggccagtacgaggacgcctccgggctgctcgtgcaccgcaagacctacaactgcctgatccagtacaagagcaagtggatcatgaacttcctgatcacctacgtcatcctcgtgctgctgaaggactccgtggtcatcgtgcaggccaagggcaccgacttcagcgagtgcatcgacgccgacaagatcaagtggaactgcacgggccccttcgtgaacctcgggaactgcgagaagaagcagaagaaggagccgtactccaacatcgccgcgcagctgaagggcctgagcgccatctccatcctcgacgtccccatcatcgccagcatccccgaggacatcgccggggcgctgcggtacatcgaggaccagcgctcctaccacagccagctgaccgtggagtacgccatgctgacccggtactgcgactactacacccagttctccgacaacagcggctactcccagacgacctggcgcgtgtacctccggagccacgtcttcgaggcctgcatcctgtaccccaaccagcacttctgccgctgcgtgaagcacggggacaagtgcagctccagcaactgggacttcgcctccgagatgaagaactactacagcggcaagcagaacaagttcaacaaggacctgaacctcgccctgacctccctgcaccacgcgttccgcggcaccagctccagctacatcgccgggctcctgtccaccaaggccaacgacgagctggtgcagtacacgagcaagatccgggagaagttcccgggcaacgccctcctgaaggccatcatcgactacatcgcgtacatgaaggggctgaccgagatgtccaacttcaagaaggacgagttctgggacgagctcgtctacgtgcccgaccccaccaagcccccgaagctgagccgcggctccgagaccgtgtacgacttcaagagcgccacgtccaacctgggggagaagaactgcaaggacgtcaagggcgtggtgtgcctcagcccccggtccggcgtcacctacgacagcatcatcgcctgcggggagggcagctcccccaacatctacaagatccccaagaccggggtgtaccagagcaactccgagccgagcaactactgcgtgtccgacagccactgcctggaggacttcgaggtcatctcccaggaggagctggacgccatcaagaagtcccgctgctgggaggtggactacctctacgccaacccgcccaagcagtccgacggcgtgcggagctgccgcatgaaggacgcgggccactgcaacgtcaccacgaaccggtggcccatcatccagtgcgacgacaacaagtactactactccgagctgcagcgcgactacgacaaggagcaggacatcgggcacttctgcctgagcccccggtgcgccaccgtgcgcttccccatccaccccaagcacatctccaactgcgactggcaggtcagccactccaccgtggacaaggtgaacgtgcacaacctcgaggacatcgagcagtaccggaaggccatcacccagaagctgcagaacagcctgtccatcttcaagtacgcccgcacgaagaacctcccgcacatcaagcccatctacaagtacatcaccatcgagggcaccgagaccgcggaggggatcgagagcgcctacatcgagtccgagatccccgccctggccggcacgagcatcgggttcaagatcaacaccaaggagggcaagcacctcctcgacgtcatcgcctacgtgaagcaggcgagctactccagcctgtacaacaagatgtacgtgaccggccccaccgtcgggatcaacacgaagcacgacgagctgtgcaccggcccgtgccccgtgaacgtgccccactccgacgggtggctcaccttcgcccgggagcgcaccagctcctggggctgcgaggagttcgggtgcctggccatcagcgacggctgcgtcttcggctcctgccaggacctgatcaaggaggagctcacggtgtaccggaaggagaccgaggaggccaccaacgtggagctgtgcctgaccttcgccgacaagacgtactgcaccgagctcaaccccgtcaccccgatcatcaccaacctgttcgaggtgcagttcaagacggtggagacctacagcctgccccgcgtcgtggcggtgcagaaccacgagatccggatcgggcagatcaacgacctcggcgtctactccaaggggtgcggcaacgtgcagaaggtgaacaacaccatctacgggaacggcgtccccaagttcgactacctgtgccacctggccagccgcaaggaggtgatcgtccggaagtgcttcgacaacgacttccaggcctgcaagttcctccagagcccgcccagctaccgcctggaggaggacgacggctccatcaccgtgatcgactacaagaagatcctggggacgatcaagatgaaggccatcctcggcgacgtgaagtacaagaccttcgccgagaacatcgacatcaccgcggagggggtctgcaccggctgcatcaactgcttcgagaacatccactgcgagctgaccatccacacgaccatcgaggccagctgccccgtgacctccccctgcaccctgttccacgaccgcatcctcatcacgcccgacgagcacaagtacgccatcaaggtgatctgcaccgagaagcagaccgggaccctgccgttcaagatctgcaacagcaagatcgacgccacgctgaccctcgtcgaggcgaagcccatcctggagctggcccccgtggaccagaccgcctacatccgggagaaggacgagcgctgcaagacctggatgtaccgggtgcgcgacgagggcatccaggtcatcctcgagcccttcaagaacctgttcggctcctacatcgggatcttctacacgagcatcctggtggtgatcgccatgttcatcatcgtctacgtgatcctcccgatctgcttcaagctgaaggacaccctgcagcggcacgaggacgcctacaagcgcgagatgaagatccggtga

SEQ ID NO: 12588 - RNA, 4329 nt, synthetic construct
  misc_feature 1..4329: note = derived and/or modified CDS sequence (opt1) from CHATV(Mohko ILO8-3)__KF719222.1__GP
  source 1..4329: mol_type = other RNA
atgatgatcttcatcctgatcctcttcgccgtgagcgccgcgtcccccgtctaccagcgctgcttccaggacggcgccatcgtgaagcagaacccgagcaaggaggccgtgaccgaggtctgcctgaaggacgacgtgtccatgatcaagaccgaggcccggtacgtgaagaacgccacggggatctacagcaacaacgtcgcgatccgcaagtggctggtgtccgactggcacgactgccggccccgcaaggtgagcggcgggcacatcaacgtcatcgaggtgggcgacgacctctccctgcacaccgagagctacgtgtgctccgccgactgcaccatcggggtcgacaaggagaccgcccaggtgcggctgcagacggacaccaccaaccacttcgagatcgccggcaccacggtcaagagcggctggttcaagtccaccacctacatcaccctcgaccagacgtgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcaccctgaccctcctgatcttcgtgctgctctccatcctgagcaagacgtacatctgctacctgctcatgccgatcttcatccccatcgcctacatctacgggatcatctacaacaagtcctgcaagaagtgcaagctgtgcggcctggtgtaccaccccttcaccgagtgcgggacccactgcgtctgcggcgcccgctacgacaccagcgaccggatgaagctccaccgcagctccggcctgtgccccgggtacaagagcctgcgggccgcgcgcgtgatgtgcaagtccaagggcccggccagcatcctctccatcatcacggccatcctggtgctgaccttcgtcacccccatcaacagcatggtgatcggggagtccaaggaggtcttcgagctcgaggagctgcccgacgacatgctggagatggccctcaagatcaacctgtactacttcgtgtgcgtgatcaactacgccgtcacctggagcctggtgatcgtggcgctcctgatcgccctgatcttcaagaagtaccagcaccggttcctcaacctgtacgccatgtactgcgaggagtgcgacatgtaccacgaccgcatcggcctgaagcggaacggcgacttcacgaacaagtgccgccagtgcacgtgcgggcagtacgaggacgccaccggcctcatgacccaccggaagacctacaactgcctggtccagtacaagtccaagtggatcctgaacttcctcatcacctacatgatcctgaccctgatcaaggacagcgccatcatcgtgcaggcggccgggaccgacttctccgcctgcctcgaggcccagagcgtggactggaactgcacgggccccttcctgaacctggggaactgccagaagcagcagaagaaggagtcctacgccaacatcgcgacccagctcaagggcctgcaggccatcagcgtcctggacgtgccgatgatcgccaacatccccgaggacatcgccggcgcgctgcgctacatcgaggagaaggacaccttccacgtgcagctcaccgccgagtacgccatgctgacgcggtactgcgactactacacccagttcgccgacaactccgggtacagccagaccacctggcgcgtctacctgcggtcccacgacttcgacgcctgcatcctctaccccaaccagcacttctgccgctgcgtgaagcacggcgacaagtgcagctccagcaactgggacttcgcgaacgagatgaagaactactacagcgggaagcagaacaagttcgacaaggacctgaacctggccctcatggccgtgcaccacgccttccgcggcacctccagcgcctacatcgcgacgatgctgtccaagaagtccaacaacgacctggtcacctacaccaacaagatcaaggagaagttccccgggaacgccctcctgaaggccatcatggactacatcagctacatgaagggcctgagcgagatgaccaacttcaagtacgacgagttctgggacgacctcctgcacaagccgtcccccacgaacgccccgcccctgagccgggactccgagcccagctacaacttcaagtccgtgatcagctcccgcagcgtgaagtcctgcaagaacgtcaagaacgtggtgtgcctcagcccccggtccggcgtcagctacgacagcatcctggcctgcggggagcccaacggcccctccgtgtacaagaagccgagcgacggggtgttccagtccaacagcgacaagaccatgtactgcctggcggactcccactgcctcgaggacttcgaggtcgtgagccaggaggagctggacgccatcaagaagtccaagtgctgggtgaccgagtaccccaacgtcaagctgagcaagctctccgacggcatcaccagctgccgcatgaaggactccgggaagtgcaacgtggccgccaaccggtggcccatcatccagtgcgagaacgacaagttctactacagcgagctgcagaacgactacgacaagacgcaggacatcggccacttctgcctgtcccccggctgcagcaccatccgcttcccgatcaaccagaagcacatctccaactgcaactggcaggtcagccggtccagcatcgcgaagatcgacgtgcacgacatcgaggacatcgaccagtaccgcaaggccatcacccagaagctccagaccgggctgtccctgttcaagtacgccaagacgaagaacctcccccacatcaagcccatctacaagtacatcaccatcgagggcaccgagaccgccgaggggatcgagagcgcctacatcgagagcgagatcccggcgctggccggcacgtccatcggcttcaagatcaacagcaaggaggggaagcacctcctggacatcgtgggctacgtgaagtccgccagctactccagcgtctacaccaagctgtactccaccgggcccaccagcggcatcaacacgaagcacgacgagctgtgcaccgggccctgccccgtgaacatcaaccaccagaccggctggctcaccttcgccaaggagcggacgtccagctggggctgcgaggagttcgggtgcctggccatctccgacggctgcgtgttcgggagctgccaggacatcgtccgcgacgagctgtccgtgtaccggaaggagaccgaggaggtgaccgacgtcgagctctgcctgaccttcagcgacaagacgtactgcaccaacctgaacccgatcacccccatcatcaccgacctcttcgaggtgcagttcaagacggtggagacctactccctgccccgcatcgtcgcgatccagaaccacgaggtgaagatcggccagatcaacgacctgggggtgtacagcaagggctgcggcaacgtccagaaggtgaacgggaccgtgtacggcaacggggtccccaagttcgactacctctgccacctggcctcccggaaggaggtgatcgtgcgcaagtgcttcgacaacgactaccaggcctgcaagttcctgcagaccccggccagctaccggctcgaggagtccagcggcacggtcaccgtgatcgactacaagaagatcctggggaccatcaagatgaaggccatcctgggcgacgtcaagtacaagaccttcgcggacaacgtggacatgaccgccgagggcagctgcgccgggtgcatcaactgcttcgagaacatccactgcgagctcacgctgcacaccaccatcgacgcctcctgccccgtgaccagcccctgcacggtcttccacgaccgcatcctgatcacccccaacgagcacaagtacgcgatgaaggtgatctgcaccgagaagccgggcaacaccctcacgatcaagatctgcgggaccaagatcgacgcctccctggccctgatcgacgccaagcccatcctcgagctggcccccgtggaccagaccgcgtacatccgggagaaggacgagcgctgcaagacctggatgtgccgggtccgcgacgagggcctccaggtgatcctggagcccttcaagaacctgttcgggagctacatcggcatcttctacacgttcatcatctgcatcatcgtgctgctcatcgtcatctacatcgtgctgccgatctgcttcaagctgcgcgacaccctccggcagcacgaggacgcctacaagcgcgagatgaagatccggtga

SEQ ID NO: 12589 - RNA, 4329 nt, synthetic construct
  misc_feature 1..4329: note = derived and/or modified CDS sequence (opt1) from CHATV(Mohko M07-1)__KF719225.1__GP
  source 1..4329: mol_type = other RNA
atgatgatcttcatcctgatcctcttcgccgtgagcgccgcgtcccccgtctaccagcgctgcttccaggacggcgccatcgtgaagcagaacccgagcaaggaggccgtgaccgaggtctgcctgaaggacgacgtgtccatgatcaagaccgaggcccggtacgtgaagaacgccacggggatctacagcaacaacgtcgcgatccgcaagtggctggtgtccgactggcacgactgccggccccgcaaggtgagcggcgggcacatcaacgtcatcgaggtgggcgacgacctctccctgcacaccgagagctacgtgtgctccgccgactgcaccatcggggtcgacaaggagaccgcccaggtgcggctgcagacggacaccaccaaccacttcgagatcgccggcaccacggtcaagagcggctggttcaagtccaccacctacatcaccctcgaccagacgtgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcaccctgaccctcctgatcttcgtgctgctctccatcctgagcaagacgtacatctgctacctgctcatgccgatcttcatccccatcgcctacatgtacgggatcatctacaacaagtcctgcaagaagtgcaagctgtgcggcctggtgtaccaccccttcaccgagtgcgggacccactgcgtctgcggcgcccgctacgacaccagcgaccggatgaagctccaccgcagctccggcctgtgccccgggtacaagagcctgcgggccgcgcgcgtgatgtgcaagtccaagggcccggccagcatcctctccatcatcacggccatcctggtgctgaccttcgtcacccccatcaacagcatggtgatcggggagtccaaggaggtcttcgagctcgaggagctgcccgacgacatgctggagatggccctcaagatcaacctgtactacttcgtgtgcgtgatcaactacgccgtcacctggagcctgatcatcgtggcgctcctgatcgccctgatcttcaagaagtaccagcaccggttcctcaacctgtacgccatgtactgcgaggagtgcgacatgtaccacgaccgcatcggcctgaagcggaacggcgacttcacgaacaagtgccgccagtgcacgtgcgggcagtacgaggacgccaccggcctcatgacccaccggaagacctacaactgcctggtgcagtacaagtccaagtggatcctgaacttcctcatcacctacatggtcctgaccctgatcaaggacagcgccatcatcgtgcaggcggccgggaccgacttctccgcctgcctcgaggcccagagcgtggactggaactgcacgggccccttcctgaacctggggaactgccagaagcagcagaagaaggagtcctacgccaacatcgcgacccagctcaagggcctgcaggccatcagcgtcctggacgtgccgatgatcgccaacatccccgaggacatcgccggcgcgctgcgctacatcgaggagaaggacaccttccacgtgcagctcaccgccgagtacgccatgctgacgcggtactgcgactactacacccagttcgccgacaactccgggtacagccagaccacctggcgcgtctacctgcggtcccacgacttcgacgcctgcatcctctaccccaaccagcacttctgccgctgcgtgaagcacggcgacaagtgcgggagctccaaccgcgacttcgcgaacgagatgaagaactactacagcggcaagcagaacaagttcgacaaggacctgaacctggccctcatggccgtgcaccacgccttccgggggaccagctccgcctacatcgcgacgatgctgagcaagaagtccaacaacgacctggtcacctacaccaacaagatcaaggagaagttccccggcaacgccctcctgaaggccatcatggactacatcagctacatgaagggcctgtccgagatgaccaacttcaagtacgacgagttctgggacgacctcctgcacaagccgagccccacgaacgccccgcccctgtcccgcgacagcgagccctcctacaacttcaagagcgtgatctccagccggtccgtcaagagctgcaagaacgtgaagaacgtggtgtgcctcagcccccgcagcggggtctcctacgacagcatcctggcctgcggcgagcccaacgggcccagcgtgtacaagaagccgtccgacggcatcttccagagcaactccgacaagaccatgtactgcctggcggacagccactgcctcgaggacttcgaggtggtctcccaggaggagctggacgccatcaagaagtccaagtgctgggtgaccgagtaccccaacgtgaagctgtccaagctcagcgacgggatcacctcctgccggatgaaggacagcggcaagtgcaacgtcgccgccaaccgctggcccatcatccagtgcgagaacgacaagttctactactccgagctgcagaacgactacgacaagacgcaggacatcggccacttctgcctgagccccgggtgctccaccatccggttcccgatcaaccagaagcacatcagcaactgcaactggcaggtctcccgcagctccatcgcgaagatcgacgtgcacgacatcgaggacatcgaccagtaccggaaggccatcacccagaagctccagaccggcctgagcctgttcaagtacgccaagacgaagaacctcccccacatcaagcccatctacaagtacatcaccatcgaggggaccgagaccgccgagggcatcgagtccgcctacatcgagagcgagatcccggcgctggccggcacgagcatcgggttcaagatcaactccaaggagggcaagcacctcctggacatcgtggggtacgtcaagagcgcctcctacagctccgtgtacaccaagctgtacagcaccggccccacctccgggatcaacacgaagcacgacgagctgtgcaccggcccctgccccgtgaacatcaaccaccagaccggctggctcaccttcgccaaggagcgcacgagctcctgggggtgcgaggagttcggctgcctggccatcagcgacgggtgcgtgttcggctcctgccaggacatcgtgcgggacgagctgagcgtctaccgcaaggagaccgaggaggtgaccgacgtggagctctgcctgaccttctccgacaagacgtactgcaccaacctgaacccgatcacccccatcatcaccgacctcttcgaggtccagttcaagacggtggagacctacagcctgccccggatcgtggcgatccagaaccacgaggtcaagatcgggcagatcaacgacctgggcgtgtactccaagggctgcgggaacgtgcagaaggtcaacggcaccgtgtacgggaacggcgtgcccaagttcgactacctctgccacctggccagccgcaaggaggtcatcgtgcggaagtgcttcgacaacgactaccaggcctgcaagttcctgcagaccccggcctcctaccgcctcgaggagaacagcgggacggtgaccgtcatcgactacaagaagatcctgggcaccatcaagatgaaggccatcctgggcgacgtgaagtacaagaccttcgcggacaacgtcgacatgaccgccgaggggtcctgcgccggctgcatcaactgcttcgagaacatccactgcgagctcacgctgcacaccaccatcgacgccagctgccccgtgaccagcccctgcacggtgttccacgaccggatcctgatcacccccaacgagcacaagtacgcgatgaaggtcatctgcaccgagaagccggggaacaccctcacgatcaagatctgcggcaccaagatcgacgcctccctggccctgatcgacgccaagcccatcctcgagctggcccccgtggaccagaccgcgtacatccgcgagaaggacgagcggtgcaagacctggatgtgccgcgtgcgcgacgaggggctgcaggtcatcctcgagcccttcaagaacctgttcggcagctacatcggcatcttctacacgttcatcatctgcatgatcgtgctgctcatcgtgatctacatcgtcctgccgatctgcttcaagctgcgggacaccctccgccagcacgaggacgcctacaagcgggagatgaagatccgctga

SEQ ID NO: 12590 - RNA, 4329 nt, synthetic construct
  misc_feature 1..4329: note = derived and/or modified CDS sequence (opt1) from CHATV(Mohko M07-2-83)__KF719228.1__GP
  source 1..4329: mol_type = other RNA
atgatgatcttcatcctgatcctcttcgccgtgagcgccgcgtcccccgtctaccagcgctgcttccaggacggcgccatcgtgaagcagaacccgagcaaggaggccgtgaccgaggtctgcctgaaggacgacgtgtccatgatcaagaccgaggcccggtacgtgaagaacgccacggggatctacagcaacaacgtcgcgatccgcaagtggctggtgtccgactggcacgactgccggccccgcaaggtgagcggcgggcacatcaacgtcatcgaggtgggcgacgacctctccctgcacaccgagagctacgtgtgctccgccgactgcaccatcggggtcgacaaggagaccgcccaggtgcggctgcagacggacaccaccaaccacttcgagatcgccggcaccacggtcaagagcggctggttcaagtccaccacctacatcaccctcgaccagacgtgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcaccctgaccctcctgatcttcgtgctgctctccatcctgagcaagacgtacatctgctacctgctcatgccgatcttcatccccatcgcctacatgtacgggatcatctacaacaagtcctgcaagaagtgcaagctgtgcggcctggtgtaccaccccttcaccgagtgcgggacccactgcgtctgcggcgcccgctacgacaccagcgaccggatgaagctccaccgcagctccggcctgtgccccgggtacaagagcctgcgggccgcgcgcgtgatgtgcaagtccaagggcccggccagcatcctctccatcatcacggccatcctggtgctgaccttcgtcacccccatcaacagcatggtgatcggggagtccaaggaggtcttcgagctcgaggagctgcccgacgacatgctggagatggccctcaagatcaacctgtactacttcgtgtgcgtgatcaactacgccgtcacctggagcctgatcatcgtggcgctcctgatcgccctgatcttcaagaagtaccagcaccggttcctcaacctgtacgccatgtactgcgaggagtgcgacatgtaccacgaccgcatcggcctgaagcggaacggcgacttcacgaacaagtgccgccagtgcacgtgcgggcagtacgaggacgccaccggcctcatgacccaccggaagacctacaactgcctggtgcagtacaagtccaagtggatcctgaacttcctcatcacctacatggtcctgaccctgatcaaggacagcgccatcatcgtgcaggcggccgggaccgacttctccgcctgcctcgaggcccagagcgtggactggaactgcacgggccccttcctgaacctggggaactgccagaagcagcagaagaaggagtcctacgccaacatcgcgacccagctcaagggcctgcaggccatcagcgtcctggacgtgccgatgatcgccaacatccccgaggacatcgccggcgcgctgcgctacatcgaggagaaggacaccttccacgtgcagctcaccgccgagtacgccatgctgacgcggtactgcgactactacacccagttcgccgacaactccgggtacagccagaccacctggcgcgtctacctgcggtcccacgacttcgacgcctgcatcctctaccccaaccagcacttctgccgctgcgtgaagcacggcgacaagtgcgggagctccaactgggacttcgcgaacgagatgaagaactactacagcggcaagcagaacaagttcgacaaggacctgaacctggccctcatggccgtgcaccacgccttccgcgggaccagctccgcctacatcgcgacgatgctgagcaagaagtccaacaacgacctggtcacctacaccaacaagatcaaggagaagttccccggcaacgccctcctgaaggccatcatggactacatcagctacatgaagggcctgtccgagatgaccaacttcaagtacgacgagttctgggacgacctcctgcacaagccgagccccacgaacgccccgcccctgtcccgggacagcgagccctcctacaacttcaagagcgtgatctccagccgctccgtcaagagctgcaagaacgtgaagaacgtggtgtgcctcagcccccggagcggggtctcctacgacagcatcctggcctgcggcgagcccaacgggcccagcgtgtacaagaagccgtccgacggcatcttccagagcaactccgacaagaccatgtactgcctggcggacagccactgcctcgaggacttcgaggtggtctcccaggaggagctggacgccatcaagaagtccaagtgctgggtgaccgagtaccccaacgtgaagctgtccaagctcagcgacgggatcacctcctgccgcatgaaggacagcggcaagtgcaacgtcgccgccaaccggtggcccatcatccagtgcgagaacgacaagttctactactccgagctgcagaacgactacgacaagacgcaggacatcggccacttctgcctgagccccgggtgctccaccatccgcttcccgatcaaccagaagcacatcagcaactgcaactggcaggtctcccggagctccatcgcgaagatcgacgtgcacgacatcgaggacatcgaccagtaccgcaaggccatcacccagaagctccagaccggcctgagcctgttcaagtacgccaagacgaagaacctcccccacatcaagcccatctacaagtacatcaccatcgaggggaccgagaccgccgagggcatcgagtccgcctacatcgagagcgagatcccggcgctggccggcacgagcatcgggttcaagatcaactccaaggagggcaagcacctcctggacatcgtggggtacgtcaagagcgcctcctacagctccgtgtacaccaagctgtacagcaccggccccacctccgggatcaacacgaagcacgacgagctgtgcaccggcccctgccccgtgaacatcaaccaccagaccggctggctcaccttcgccaaggagcggacgagctcctgggggtgcgaggagttcggctgcctggccatcagcgacgggtgcgtgttcggctcctgccaggacatcgtgcgcgacgagctgagcgtctaccggaaggagaccgaggaggtgaccgacgtggagctctgcctgaccttctccgacaagacgtactgcaccaacctgaacccgatcacccccatcatcaccgacctcttcgaggtccagttcaagacggtggagacctacagcctgccccgcatcgtggcgatccagaaccacgaggtcaagatcgggcagatcaacgacctgggcgtgtactccaagggctgcgggaacgtgcagaaggtcaacggcaccgtgtacgggaacggcgtgcccaagttcgactacctctgccacctggccagccggaaggaggtcatcgtgcgcaagtgcttcgacaacgactaccaggcctgcaagttcctgcagaccccggcctcctaccggctcgaggagaacagcgggacggtgaccgtcatcgactacaagaagatcctgggcaccatcaagatgaaggccatcctgggcgacgtgaagtacaagaccttcgcggacaacgtcgacatgaccgccgaggggtcctgcgccggctgcatcaactgcttcgagaacatccactgcgagctcacgctgcacaccaccatcgacgccagctgccccgtgaccagcccctgcacggtgttccacgaccgcatcctgatcacccccaacgagcacaagtacgcgatgaaggtcatctgcaccgagaagccggggaacaccctcacgatcaagatctgcggcaccaagatcgacgcctccctggccctgatcgacgccaagcccatcctcgagctggcccccgtggaccagaccgcgtacatccgggagaaggacgagcgctgcaagacctggatgtgccgggtgcgcgacgaggggctgcaggtcatcctcgagcccttcaagaacctgttcggcagctacatcggcatcttctacacgttcatcatctgcatgatcgtgctgctcatcgtgatctacatcgtcctgccgatctgcttcaagctgcgcgacaccctccggcagcacgaggacgcctacaagcgcgagatgaagatccggtga
